United States Patent 10,407,724 (METHODS AND COMPOSITIONS FOR SCREENING AND TREATING DEVELOPMENTAL DISORDERS) - sequence listing, part 6

SEQ ID NO: 93 - DNA, 3437234 bp, Homo sapiens (residues 1,718,618-3,437,234 of 3,437,234)
cctttcctcttgtgaattcttcaagaagaacggaaatgtttgcttccactgtgcaagtccccagattggttaacattctctgtaatgaaggattctgtcttgagtggcctcatgaatatgaagcactgtatgtcattgtgtcttttgggtccatgcccttaagaaaggctattttttcttagatgtgggatatcattacaattaccttctacagaaactagggctgctcatttctgattagcaataaatatctttaaagaatggtgcacagtttggagaaaatttgaacaagtaaacatacctgtgaacagttagatatctttcctatttaactcacaactttctcagtcactgctcaatgtgatactcattttcacacaagtttatgaagaattaattcattctgatatggtgttactcctcagtattttttgttatcaaataatcctaaaccaatttttctaggtgttaatgaccttgtaacttttcttttgctttcatttgccccaattatcacggtatcagggaaggtctgactacatcatattgtaaactctttgagaattggtacccttcttttacttctttgtacttacttaatcctctctatggaaaatgatccataaatatatattgataaaacaattggttacaacttgtcagtgaaatgaacagttagcattcccaagatcccaattttttctcagcctgctgctccgtttttagacccaatagaaatggaaaaacaaaatcatatcctaagatatgctgattagtgtgaacatcccaaaagggtctttttccaataagaaaagaacctcatacaaattttaccaatcgctataaggattttccccccgttggatgtgttaaaaaaaaaactgcacaatgttggccttcatcattgaaattcactatttttgggtatgaagagaactaactgagtcaaaagcctgtctcattttaaagacagtccatccttttcagaaaacttaccctttaaacttggttaacttaaacagagtgggttaaataaaatttgaaatagagatataaacatatttcccactattaactagtgtgtgtgaatatcctctaagtaaattcttcattaacctaggcatgcatgggaactggagtccagggggcccagagggggtgatgtctgtgtgtgtttcctattgctgctgtcacaaactaccaaacgcattgagtctgcagacaacacacattgattatcctacaattctggacatcagaagccgcaattaagtcataagggggaagaaatgtgttggcaggactgcactcctcctgcaggccctggggagaattcatttcctttccttttccagtcctagaggccggctccattcctttgttcataacaccattcagtgaacaatcccagcacgcccagctctgcagacatcaccgcatctctgtctgactctggccctctccactccctctcagaaggacacttgtggtcacatttggcccattggctaatccaggattacacccccatctcaagatctctaatttaacgacatctgcaaagcccctttgccatataaggtcaggtagtcaaaggttgtggggactagggtgtagcatctttgaggagctgttattcagcctttagcacaaagggtgtctggctggtagaaggtcctctgcagcccagagggtctggctgactctattctccgtttccccacttttctttccaatgtgccacatttcttcatttctctcctctcctaccttttattttgcatgtgccctgttcttagtcattgcaaaaggaccaaggcaggagtaatgaatatatacctttaatacatcaaggggatatacagcctgtacatgataacatgagctctcaattctggatgagttatgaaatgagataggggaagacacaagggattgtggcagcctgaaatatgccccattgtgcactcagcaacaggcatgataagcagctcaatgccacgtcttcatcacagtcccagagtaaatgtgttttattgatttttatgtttaaaagtctcatctactcaagtagtgtgtttaatgctacaagtacaacaaaaataagttaaaactctaacaggcaaaacaagtcttacaatatattgaaaaagctgcagcaatttgtttaactatttgcaagtttatttatacagtagttgacttttcagttatccttttggtttctcctagcttttagtaaacaatataagtgctcttgtccaatttaaggatgatcactttgaaaaccatacaaaggtttggtgctgggagaatttcttcccacagcgattacttgaagatgtgagtttctattggaaggtgaaagaccactgttgataaaagtttaaaaaaatcatttacatttaaatttaaattgagagatgcttgtcccattagcaataatttttatagagcaagtaaatcttcatttatctatcatccccaaagtttattctaagcacaattgtaaagcatttcctggatgggcacagtggcttacgcctgtaatcctagcactttggaaggtggaggcaggcagatcaacttgagggcaagagttcaagaccagcctggctaacatggtggaacaccatctctactaaaaatacaaaaaaattagctgggtgtggtggtgcaagcctgtaatcccagctacttgggaaactgaggcatgagaattgcttgagcctggaaagcagaggttgtagcgagccaagattgtgccactgcactccagcctgggtgacagagtgctactctgtctcaaagaaaaaaagcattttcccacctccctttcctgttcttctggcctccttgtttacccctaattcacgctttgctggtacctagtgctattgtgcacttcccagcctctccagagactcctggtgcagagcctcagctgggctagccctccttaccccctgcttccttccagaatcttccatgaaacttcaaagatcttttcttcagaggactgtcatcaggtccctaccagttatcccacgtcagacaacctgatttttgtgaaggcactggtatgcttctgtcatcctctctggaatggctggaaatacaggactttaactagaattcccagtgtgaattctttagaacacaagtttcctagcaggtgaatagttgccacataaaaaaataggttcagttaccaaataaatcttggaaatttgtagtgtgcattggcacatgtgagaataaaatactccaaataacttatttaaggtcacttaacacaatatttcccatcataccatctacaggaccaggggacctgagacctcgtcaagaataaagggtctttaaagatgaaccatcatcctcagtaatggacaggaaaccattttggaaagcatcagcacaaagcaaagcagagaagttgctcagctggtgtttgggattgaaagcctttaacagcaagggcaagaacactcaactcaaatgcaggtggaagaagggagaccgttggttcacttattataaaatgtaagagtagatttgtttcagctggggcttggcctccactaacaaatgttaggaaagtcaactcaaactttagcagaagaaggaaaattcttgggttgtttactaaaaatcccaaaatgaggataggccgaggcattctaacatagtcattggggactggtgtttttctatctcctggctctgacttctgcctctttgatttcattctcaggaccccaggtggtgtctttgccagctctgaactcacatcttcctcactgcaaaggaaaagtcagaaaagtcttcttgcatttcactgattctgctgattggatgacataatcctctctgaacccatcatggtggccagggagataccatactctgattggtcaagtctgagtcctgggaccagggcaagggccaactccacccaatgcacatggtcagaagataggcaagatagtggtctgcaagagaaaaattgtggcattattaccagaagtagagtgaatgggtttttggtggctggaatacaactgcagctgagaggaaaccattagccagcatgtggttttgtctttatgtatttaaagcaattcagttttacaggattaaagaattagcaggttagtggtgcagataatcaagatgcctgcagttattatagaaaatgctagataaagaagatgtccccagaatatgaagcaaagtttagcctctgaaaatgtgactatccaaaattcacctcatagagtattcatcagtgctctgttccttagtaagttggtttccttaagggtaaggactttatctccacctccctgttactcagcataatactttgtgctgaagaacttgttagaagaccattcttcactgaattaatgaataaatttgcagatataatttaagatgatatttttaaaatatatgtcctggggtgcttggaaaacacccctgtccagtaaaaagggaatgttttttggaccatactgtgctaacagggaaaatcggtaacctaataagttgttctgaacgtgtctgaaggctatgggaaagcaaaatcttggtctaggagaagtctaggaagggagaacaaagagctggggctttacaaaatcaatgggagaggggccctgtgcagctgtctaagtctggtcagcctgctatagactggcaggcttataaacaatagaaattacttctcacagctctggaggctggaagtccaaggccaggatggcagcatggttgagttctggtgagggtgcccttctgggttacagacggctgacttctcactataacctcacaggacagtgggagtgaggggcttccattggtatacatatataggcactgatgccactcgcaagggctctgcttctgtgacctaatcaccccccaaaggctctacctcctaacaccatcaccttgggatttcaatatatagattttggggggacacaaactcaaactagcttaattctgtgtagctttcttctctcctgtatctgacccacaaattcaagcctccctggtctccccaaactttgggttctctctctcttcaactcagcaaggtactgcttgaggttccctccctgtcccccatgtagtgtgctgttgagaccacaaggcttggctcatcttgtttccttccactcagggaccatagtcctgtgcagccctttgtgcaaacccttttactgcatccattttctccagttctctgcatgttcaaggtgagaggggaaatctggctcctgttactccatcttggcctttgacacgtgcagtgaatacattgtgcctggctgcgagtgcaggcctaaggaggacacgtggaatggacagaggaaggagggaagatacaactggctccagagttctgactgctggacaccatcctcacagcttctcctggttctctgatgaatgacaatggctaaatgtaatttgaatccccaagatgtcctagtggacatttatcacattttctggaggtggggcattgttaggacatatttgctttagtctaagtccagtcttcccaaggcagagaccagaacatttggatcctgagtggtcactaagtcagcgatgcaggcatgtgacctgggctccaaccatcagcttctgccctgaggcctttcagttgagtgacttgaggaatgtggctctgggcagaatccattctctcaggacaggtggtggcacagctgtctcgcaagaccctctgtcttaatccatttgtattgctataaagaaatacctgaggctgagtaattcataaagaagaggttcatttggctcacagttcttcaggctgtacaagaagcatagtgccagcatctgcttctggtgaagttttaggttgcttccactcatggtggaaggcgaaggggagccagtgtgtgcagagatcatatggcgagataggaagcgagagaggcaggcgagggaactaatagaccaagaactcactcactctcctcaccccaaggaggacattaatgtattcctgaggaatctgccctactacccacagtccttattaggtgatgccttcaacattagagatcagagttcaacatgagatttgaaagggtcaagcaaatcaaattatagtaccctccctgggcaaaagtgggttgatgtggactgaggctaccatgctgtttcctctggcacccagaagacaacagcagaggcttggctccctggccaggcagctcacggctggattttagccactgtgcccagaaccttagcttttggtctgtttcaccagccatcccaacaattctgtaaaagtacctccttgttcttcttcatcaaccggagttggctgaattccactcttatttggaagacttattgtcttggttgtattattatttgactaagtagcaaatgactggcaaagagataactgaaaaataggatgtaattttatcaaataaagaaagtctacatttaaatagctgcttccaagtagatgtaggtcctcatttataagccatctatgtacatcatagaccaatgctgaagaccagaggagagcaaaggcattaattattccaagacttatctctttctattgtcaactgtaacatttttccactggaaataaaatcttctattagtctagtaattgtttctgaatattttaatgacctgtgtcagcactatacaaaccatatattttctgaacaagtttctaggcttcacaagcatttccggagatggacattagtaatcaaggtataggatgtactaagctgacaaatggttttctctaatagaaggcttggaaatagcatctgatttcattaattttataacttctcattcatttacatttgtaagttgaacatgtacccgctatgcttcaattcattcttttgaaagaaatgcacagaccagggtcattgttatggataaatgtgcaccttttaaaaacagcatgggtagttgtggcttagagtggaaataatgatgtcaactgagccaccaggatgatgcatgccccaggagtcaactagataagatgtggtcatggaagatatgaaattctatcttaataaagcaccatcaagtccttgtcttttaaacataaaataacttattcccagtcggtgatagaaagcatatcacttggagtttctggtaggagttgctttagagtggaagcatatattcaaattttgaatggtatacttcgctcctcaccaatattacttggtgacatttgtatggacaggcaagaagctactttgttatgcaaacctttgaaaggggatgagagagaataaaaaaatcaacaaccaaataaatgaatgggctatgaacataataggtgagacattgaactagctgttgtttatcctggcaagaagttgagagtgtttttaaaatagtatctaaatccaaaaccaagccattgtaacaagaaagaaaagcctcattgggctttttgtggtgtgtgaagcaaaactgtagatatagagaataaattcactagaagaaaccttggaagtgcatttagttcaatgctctcattctgtcaatgggggaaactgaggcccagccaagaaagtgatctacccaaggtcgcttattagttagtgggaaagtgctatagacttaatgtttgtgtccctctgaaattcatatgttgaaattctaactcctgaggtgatggtattagaaggtgggaccactgggggatgactaagtcatgaaggtggaggtctcttgcatgagagtagagccctcataaaagagaccacagagagctctctcctccctttctgccatgtgaaggtagagtgagaagacggccatctatgaaccaggaagcaggttgtcgtcagactccaaaactgccatggccttgatcttggacttcccagcctctagaactgtgagaaataaatgttgtttaagccacccagtctatgtcatttttgttatagcaacccaaacaggctaagacagagcatgtaagtttagaagactgtgtcaaaggatggagcactgtgaaaactttaccatttgatccagcaatcccactactgggtatctacccagaggaaaagaagccattattcaaaaaagatacttgcacatgcatgtttatagcagcacaattcacaattgcaaaaacgtggaaccaaccgaaatgtccatcaatcaactagtggataaagaaactgtggtatatatgatggaatactactcggccataaaaaggaatgaattaatggcattcgcagcaacctggatgattggagactattattctaagtgaagtaactcaggaatgaaaaaccaagcatcctatgttctcactcataagtggaagctaaactatgaggatgcaaaggcataagaatgacacaatgaactctggggactcggtgggtaagggtcggaagggtgtcagagataaaagactacaaattgtgtgcaatgcatactgcttgggtaatgggtgcaccaaaatctcacaagtcaccactaaagaacttactcatgtaaccaacactacctcttccccaataacctatggaaataaacttttttaaataaataaataagagttagttacatgaaaaaaagatgctaatacctacataatgtgcccatcgtgatgagtaaaaatctagggaatatttgcaaagtaaggagctcccagctcctccatgctgtaggcagcaaggtgagcaatattctccagggataattgttttaataggaaaagttgcctgggtttccatagacctgaatgggcactctcctattgaacacaggacctgaataaaaccctataatgataggcttttgcactaacagccccctcaatgctggatcaagatgcaaaaaggcatggctgaaatgagatgacatccaaatgcaattaaaaagatcaaaggcatagatgcaagaagagagtgcctgataaaaataatttttatttgcaaaatcaaaaacaaacaaaaccctccccaaacaaaaaaaagacctagagttttagttgattcaagcttacggtgcaccaagggtgtgatgtgattgtcctataaactgaaagaaaacttaggctgaattaatcggactcagtgtccaaaagccctagaggaagtaacaaatagggggtatagattcaagttcaatataacagggaactttcttgctatttattgtgttattagattgggctgataatttggtgtgcatttctggaaggttgtgaacagctgggtgaacatctgtcaaagaggctgcaaacttgattctgcttttgacaaggtgacccccagctccactctaactctagggtgtaagtctaaagtctagctttactctccaagtcccaccacatactgtgtgaccttagacaagttatgaaacctctctgagtctcttttccttggctttaagatcaggaagattaaatatatctctcagaaattattttaaaaaatcagtttaagatatgtaaagcaaagcccctggtatagtgcctggtacataataatttttaaaaatatttgtgttgtcagaactgtccattcttccatttataacaactcattcagggatgagcgtgtgaatcccataacaattaatgagatagactgtgatttccaccaaggcttcgtggagttcttcttgcttaatggatttaaggctgagacggcacttcctagagatcctattacatctgaactctgagattaggaccaggacagctgcagacaaaggcaagagccagagagaaacaagcctgtgaggactttggtccaccatgcctaaagcttgatgacttctaggcttctcatttacatgtgtcaattaattccattttgcttcctgcagggtttcagaaaaacttaactaaagaattgtgacagatgcagtcctggagaaagacattctcgtatccttacagttttattattgttgctcccatgcaaagccccaacttggcaacaacttttcctttcttccatgcatggagctatgaagccaccatgggcactacttttcttaattatctacctcttcttacagcccggggcagacaacttgacacatcgaggacacattgacctgaaaagtctattgttgtttttggcagctctcagcttacagatcatacctttaaaaccacagctgtgtcttctttagttcaccctcgaggtgccaaaagcctaatcaataatgaatagccatgatgtcttcaaactgactttagcatctggcctgaggaggggcacaccaagtctgggtctcatggcaagcaaaagttggaacgaaaatagaaatgctgaggcaagctcaatcacaatgtagattcaccagaggttctcttctttgaatgttacatttctgccatcacctgcttgctagttaaattaaccgtcaaaacctgcgacaaattgtggcaaggctgaagtgaactaacatggaagctccatgaccatcactgaacaaggttgttgaagccacagctctgacactttctgatgtcagcttgtctgaatgacccctggagattcttctgacaacctccaaggaggccatgggtctattgatggacacgaatctgaattttagtggccaagctgctggaggaagagttttaagggcctagtggtttccatagatacgagtcattcaatgctgatgttcttcccagaggtgcctctttcttctgttagtgttgtatagtccccttgcaaaagcagcaaggacccttaccccaaatttagttcaggtatggaggttgatgactctccatgcacaaaagtgtttgagagaaggtttattgctcacacaagggactctctggtagaactgagcaggtgccagcaggcccggggttggctcaggcagagtggaagaatgggcttgggccttcaaataagtggctaagagcccagcacatgctcactggatttagggcccagtgaaatccagtttgacttaatctctcaccttgattacatctgcagagatctattcccaaatgagggcacattctgagcttctgggtggacatgaatacttggaagaaacagttcaacccagtccacaaagtgaaagcacttcattatcacttctgaaaaatcacctttatcacacttaccatattgctgaatttctgcttccccaaatgggactggaaagaaccttcacaggctcatgggattcccaggaaagtttgaccctggaagaggattgagacctaaagaatggatttgctcaaagcagagctgagacggggaagcggtggaacagggatgccacctcttcagccctcacctgagggcaacactggctgggggtggagaaccttagtgtcccatactggcctgttttcccagcagagacacagctgagtcagcaacagtgagtgtgacatttggaagcatcatggcctcaggatgagtgtggtcaccagtgctgttaaatatagttctcatggctggtgccccattaagacagatttgatgcttggtgacacattcaatttgaaaatttcccacagttaggctggattcagtggcatccccctttgattcctgtggggctgccataacaaagtaccacaggctgggtgcttaaacaacagatatgtattttctcacagttctggaggctggaagtccaagatcaaggcgctgtcaatgttgatttcactctgaggcctctctttctggcttgcagatagctgtcttctcactgtgtcctcacatgggctttcctatgtccctatatatgttcaagtgtttttttttttcttataaaaacaccagtcctgtgggattagggctccctctaattactttgttttaacttaattacctccttagaggtaatttaatagggtcacattctgaactactgtggcccgggacttcaacacatgaatttgcaggagacacagttaagcccatatcaatcccttccacacatttgtgttgagtgagcaaagtgcatgccttcctttgttacacatttctgtctctgaaagttatgactgtctgtcaaggaagggtctagactttagatggcagggccatgaggcacagccaggctgagagctcaaaatcgtgactcagttcagcgtgtggggtgcacgaatgctgaggggtgggagctgaggtgcagcactgacagtttcttgacttttcccttagagaatcccagtcttcagggggtcttttcaagacatttataccttgacttccatccgtgctggaaacgtttacccacctttgcaattggcaggccaggttgcaaataaacctacttctaagcatgagactcaaaaatacgagggactctgttataactgtaattccagttacagagaagaacttaatataagatagattatttgagggccttgttctaggaatgtatatacagcaagaagctattttaatcccagctctttgggaggccgaggtgggtggatcacctgcggtcaggagttcaagacaaacctggccaacatggtgaaaccctgtttctactaaaagtataaaaattagctgggtgtggtggtgggtgcctgtagtcccagctactcagaaggctgaggcaggagaatcacttgaacctgggaggcaggggttgctgtgagccgagatcgccactgctctccagcctgggcgacagcagtgaaactccgtctcaaaaaaaaaaaaaaaaaaaaaaggagagtgttttgttgttgttgttttttctatagactctgatgatgatgctattgcaaaagccaggtgtggaagacagaataatagtccttcaaagatgtccacattccaatctccagaacctgtatgttatcttacatggcaagagggactttgcagatggggttaaagaacataaggtggggaaattatcctggattatctgggtggacccagtgtaatcagaagggtccttataaaggagagagggaaaaaggagacaggggtgggggagtagaagagagaaggagttttagccatgctacatggctggatttgaagatggagccaaggaaaacaggcagcttggaaaagacaaggaaacagatccttccttaaagcccccataggggcacagccacatagccctgccatcccatcttggacctccagaactggaaaataacacatttctgttttaagccatgaaatctgtagtaattttttacagcagcaataggacactaaaacctcagggtaattaagttactgtatcttgagcagccagaagtaacttggtaacattatcactgaacaattgcctcagcatcttcaaggtgcaaacagtggcctatttttttatttttctaaaacaagaaatgcaccatctgtcaatttaatggctacctttccctcatctgagttgatccagcatctgaggcttacagagtccagcagaaacggggtcccaggttcataatctacacttgttctaaatgctgctgtccctgggctgagctgggcagggtgttacactgcccacccctttaccaatccctcttctacacatcacctttcctcaattcctcctaatatgcttcaccttggagacctccctccttcctccacatcccctgcaacacactgatgctcttttccctactccaagaacctactactggcatccctctaaagcccacctctccctctaggtatggccatctggctccatctcatgtctactcttgcatggatgacagccatcacatccctccatccagaaaacagtctccttcaggtactagaatgtatccaccttggagagctttgggtggttattaacaacactggttttctcattatatttgtttccaaaaacttttatataatgcctcttacgtggtaacttcagtgattgtgggctaactgaatgaatgttaataatatacattagatgtggctgtttgaggtatttcatggttccatatgaattttagaattattttttctatttctgtgaaaaatgtcattgagattttgataggaattttattgaaactgtaggttgttttcttgaaaagtagcaaaactggaggcatcaaacttcctgatttcagaatatattacaaagctacagtaattaaaacagtatggtactggcataaagacaagcttatggtaccaatggaacagaatagaaagctgagaaatcaacccacacatatacaatcaatttttccttcaaaaggtgataagggtgccaagaacagacaatgggaaaagaatcatctcttcaaaaaatggtgttgggaaaagtggatgttcacatgcaaaaggataaaattggacccttattttactccatacgcaaagtaaactgaaaatgactcatagacttaaacataagtcctgcaactataagattcctagaagaaaacaggggaatagcatcatgacattgatcctggcaatgatttaatgggtctgacagtagaagcaaagttcaacactgacaaaattagacaaatggagctgcatgaaactgacaagcttctgcacagcaaaggaaacaatcaacagagtgaaaaggcaatttacagaatagaagaaaatgttggcaaaccatcagataaggggttaatttctacaatataaaaagaactcctacaactcagtagcaacaaaactaataacctgatttaagacagtgtaaatacttaaatagacatttatcccaagaagccatgcaaatggccaacaggtacatgaaaacatgcctgacattactagtcatcagggaaatgcaaatcaatgtcacaatgaaatatcactcacacctgttcaaaaagatgaacaataacaagggttggccaggatgtgaagaaaagggagcccttgtacactgttggtacagcaaaatggtacagctgctatggaaaacagtatggaggttcctcaaaaaataaaaaaaataaaaataccatatcaatatggtttggctgtgtccccatccaaatctcatcttgaattcccacgtgtagtgagagagaccctgtgggaggtaattgaatcatgggggcaggtctttcccatgctattcttgtgacagtgagtaagtctaacgagatatgatgggtttataatggggagtttccctgcccaatctctctttttatgcctgctgccatccatgtaagatgtgacttgctcttccttgccttctgccatgactgtgaggcctccccagccacatagaactgtgaatccagttaaacctctttcttttgtaaattgcccagtttcaggtatgtcttcatcagcagcatgaaaactgactaatacacatatcatctagcaatcctacttctaggtacttatctaaaagtattgaaacaggatcttgaagagatattagcattctaacatagtttgtgacactactgacaatagtcaaaatgtggaagcaacttgtgttcagtgacagatgaatggataaagaaaatatggtatgtacatacaaaaatattattcagtcctaaccaggtgcggtggtacacacctgtaatcccagctgaggcaggagattgcttgagtccgggagtttgaggctgcagtgttctctgattgtgactgtgaatagctgctacactccagcctgggcaacatagcaagaccctctctctaaaaataatatacatatattttttaaaaaggaaatcctgcagtatcagataacttgaatgaaacttgaggacattatgctaagataaataagcagtcacagaaggatgtatactgcatgattccacttaaatgaagtatctaaaatagtcaaattcaaaaaatcagggagtagaatagttgttgtcaggggctgggggaaggggaaatggggagttgccagtcaaagggcgtaaagtttcagttaagcaagatgaacaagttctagagatccgctgtgcaatgttgtccctatagttaacaatactgtattgtacacttaaaaatttgttagagggtggatctcatgttaagtgttcttaccatcaccaccaccacaacaaaacacaaccaaaaccaaaaaaggttgcacactcgtacagtagttaaaaatgttatgggcaatggtatgctagagctggcctgtaatggctcacaagagctgattgttaaattttcaggaagatcctcgttaaatatagccattattaagtgttaaatggtataaatttacaattaaacaaattaaattgaaagtaaaggtaataaatattcagaatacatcacaaacgtaattatttcactacattctactactatctatgttctagaggttacctaagttattatctattttatctgcatcctggaaagtacatacaggtttacaaccaaccaccactttcaactctgcattcagagacatcatattggcaggttgaaattggttatggtgtgtgaagttacaccacagaaactggcaaatgccataaatcacatatttttttttttgagtcagttgttaaatgttcaccagacaccactgttcctaagccagttcttcacaaaagacttcacaaagactccaaaatggaagcagaactgatattaccaccaatttactaatacagaaagagagacccagacattaattagcttgtccaaagaagcattcggagtcctactatactccatatttttaccattatataattttaaaatcatttattaataattgaaagagtctcaattatctatgatcatctatgataattgaaattaattattaaattcttacatttatttttactttttcctataaagcataatacattataaaaatcatggtagaaatatagattaaactagggttgccaggtaaaacacaggacatctagataaattttaacttcagataaattatgaaaacattatttagtatgttacaaatattgcacgggacacatttataacaaaagaaagttggaggtcgggtgtggtggcttacacctgtaatcccagcactctgggaggccaaggtgggtagatcacaagatcaggagttcgagaccagcctggccaacatggcgaaaccccatctctactaaaaatacaaattagctgggcatggtgatgcatgcctgtaatcccagctacttgggaggctgaggcaggagaattgcttgaacccgggaggtagaggttgtggtaagccaagatcgtgccattgcactccagcctgggcaacaagagcaaaactccatctcaaaaaaaaaaaaaaaaaaattgaggttatttcactcaaattcagtgaaacactagctatgctttcatattaacaagacaggaagttttcttactctatttctattaaattatttttttaatctgtaaggtacatggacgtactttggtcaagaattaggccgaggcagacatccaggcctgcatgactcagcgggactggtacgcaggtgcacacctccacttgttacataacctgtttgtgtaagctcatacttggctctatgccactattgtctttttttttgagatggagtttcactttctcattgcccgggctggagtgcaatggtgcaatttcagctcactataacctctgcctcccaggttcaagcgattctcctgcctcagcctcctgactagctggaactacaggtgtgtgccaccacgcccatctaattttttgtatttttagtagagatggggtttcaccatgttggtcaggctggtctcaaactcctgacctcaggtgatccacctgcctcagcctcccaaagtgctgggattacaggcgtgagccaccgtgcccggccgtatgccactattatctgtaaagggtataactgccctgctgatgctgatacatgctgcttggctctcatacccagagagagagagagtaatgctactgacacctgtaagggagagctggccttgtaggtaaaggagtgcagctgtaggtgtgggggcggcaggggctgtggagccagctgctgagaggagccacagagctggagcagacggccaagataagggtggacagtgcaagagagagctagagtgagtaagctgctgatgaaagagctactgaataaaactacatttcacccacctacggccctccaagtgttctttcagctatctgccacctacccactcctctcagacctcagcatgggctagaacctgaccctgggcctgacatttgctgtaagagtggacctgacaaaatgactttctttaccacgtcctctggtcagttctacctttaaacctttgctagggtcaaagttaattgcataaataaattgcttacgattacctagtgcaggtacgataacctagcgactttgaatttctacctaaaagggactgccaatctcctttctgactttttagacatctctggaacagtctaaaacaaaatagaagcatttaaaaacaccatttccttttccattcatggccgtttcatcacacagtttgcacagtcatctcctcctgggggggatagaacagtctccttgtcattagcacactctggggtcaggtgtatcttggccagtggctttagttttttacggattagaaattcttaggaaagtaagtaaagctgcccttcagaatcttgggtcttgagtgaacagaaaatctggttgggatacctctctaatggagctcaggagtgtgcctggaccagtgaagcagttgttggcaggttgattattgcacctgtaatgccgagtgtctggctattgaaagctggcggcattcatctgggccatgtttcatttgctgcgaatgctctttatttttaacagggcccaaggattagtggcaaagagctccccttagaaggtatgggactgggagttgtggaaacagagcaggcagttacattgcattggtaatttaggtggcgtgtgttagcagaaaaggaagcgataaagggccttgcattttggaggcattcccatttggaaacagtattctcaaagcccgactcagaagaaagacgtatcattgctcagtttcctagcctgtgtgttattccttagttgtttcaacaatttgatcatctttcaatgattgttctcattggttatacattgtgaacacatgaagaacataattacttaagaacctgaaattgctcttaatagtgtattgaggcaataatacaatttcaaatgctttcagttgtaaatctgcagcatattttactggtggttgaatgaataagatatatcaggatggtaactacagaaagtgtctatggaacacttttctgcttaccaaaattggcattgagttttaaaaaagtaattatattttcctaacttttcagaaaagtatgttctttttataataaaatgacaatatgagtacttaactgggttttgtgttgagattgcttccatcggtccaggcttctgttacttcctaggagtgggcaggaagggtctctataatgtgatcgtgagtacttgaccattgcctgttgtggaatattcttgtgattggtgctttttagtgctcttagaagagagccaggttatttctatctcctgttctgctctcctccactttggctttagcctaattgggctcctcatggtcataagatggctgccaggaacaacagtggctgaatgcttccttctcattcagctggaggaaaataaaaactcaggatccaaaaccttttctccgctcacatttacgttagttacattatttgtttttcacttcttctagcaaaactcatcatttttgccattattaagaaatattggctaaatgtttgaaagaggaagctgaacccattgctgcaaaatgttacaagctttgtggtagattgtaccaaaaaggccactgtagtatttctatcccacaggctcttccagaatcttgccactcttccatcaagaaacacagtctgtttcccaccccatcccctgaaactgagcattattttgccgctgcattgactgatggaatgcatcccgacttttgcgcctggctttttgccttgggatatgggttttgggagctttgagataatatgtaagaagtttggctgccctgaagcatccctgctggagagacctggtggagcgagctcagaggacgcctgaggagccacagctgtccctgtaccagctacttgagtcttcccagcccaagtgccagacagctaagtgattgagcctttaagtgagtccagctttcagccccgtgcctccgcagctgactctgagtgcagcacagctgagttgtcccagtggagtacaatccaggttacaaagtcttgaacaaagtaagtgtttctctctctctttttctttctttaaagcacaacttttgaagcagtttgttacagagcaatagaaaatcagaattagtctagtttaaattctgtacgtgtgtgattttcaactctgtctttgataattaagagttggctgtatattcaggtagtagaaatgggatagtgtttccattgatgacaggttagctcaggtgtgcacatgcagtcttaatgtggccgatggtttgggtgtaattcccacaaaggccagtttactttcccctgctccatgacttaactgtgtggttatctcacagatgtctgcttgcaattatgaggcatgaagaatccttgcagccattaggaaataggcacctggcttctctgctgagcgagcgagtaatggaagctgtgatgagaactctgaacaaaaacatagtgtcggttccatcaagggccaggcttctggtagactgatcatatgagaagtgaggataagtagcctggagcagatggggttgtaatggggtagtaaggatgaaagtctagaagagagatcagtaattgatgtggcaggtactggtggtgtcggctgcatggtgaacagcaatagacacccaaactcacagagctaaggatcagacttattccatgttgccctgtgtggatgtcatggtgctgagtaaagggtggaccctgaaaaattagactgaattagactttttcctctttatgtcccctttgcttggcacactcgtaatcatctcttgagcagaaaagccccagttgaatatccagctgcaaaattttatattcagctgcatgatatcacagcatcttccccttccccccatttttttttgagacaaaattttgctcttgttgccaggctggagtgcaatggcacaatcttggctcaccgcaaactccgcctcctgggttcaagtgattctcctgcctcagcctcccgagtagctgggattacaggcatgcgccaccacgccccactaattttgtatttttagtagagatggggtttctccatgttggtcaggctggtctcaaactcccgacctcaggtgatctgcctgcctcggcctcccaaagtgctggggttacaggtgtgagccaccgtgcctggcccttattcccctttgctaaaagaaagcaaggctgaggatactagtagtgagcaggacaaggagaacaaatgttaaaatacaatgaaggcaatacaataccatacaaatagaaggggttgtttctaaaccatttgcacaagcatgaattacctttgccttggtttaaaagtttattttgctgtcctaaaatagttcttcattccttatgtgattgtcccagcccagggtctcagctcaattgctagcccattcccaaacttttcactgcctcagcctcctacctcccgttcactcaccctcacctgcttccggagctactcccgaaagtcctgcgcagtctgcacattgcaatgtgcaaaggtttgttttcggccatttttcttcttgtcatcctctgtgcccaccagtggcatttgctgctctctgcacgtgaaatgctgtccttccctggtttggataaagtacactggtctcattcttcccgcctccaccccacctggctttctcctcagtcttcttctgcctcacgctgcttccccaggggttctcatcatgctgggactctcttttctccaaatcttctttttcatggatgctctgtccacacccactttccagcttttaacctcaaagagacacccaattccacatctctagttcaaagtaccatttgcacatcccaccgccctctgtaattgccatcagcatgggcaacttcacatgtccaaaaccaagtggattttcctcgctggaaaagtttttcctccttgtcatggatgagtagaaactcaactagcaaagcaggcacttgaccttccgtctcttcatcagttccatcataagtaacttgtctacacctaaagcctcatcagccacgaaggataaggaagaaataagacccacccccaactccctaagcacactaggtaataaagaaagtggagttttaagtcaagtttgggccttagtaagacaatggaattcttgacataaacttcaacaataactacataaaaatcacacatttttatgtggttataatatgtgctggacttctggttacctaggctcacacctcagagggatctttgggtacctccatccttcactgagcagtagccaaggtctactaattttatttctacagtatttcacattagttttatttctcttgactgtcattcttttagctcagacgcttatgtgttttttggatcatggctgtcaaactttaatgttccaaaaaatcaccttttgataatgcagattctggtgtgggacccaatagtctgcatttctagtgagctaccagccgatgctgatgctgctaatccccggactacactttgagtaacgaggttctaggttaattattacaacagcctcagaagtgattctccctaaaccagtggttctcaacatatggcccccagacaagcaacattaacatcgcttggaaacatcttggaaatgcaaattcttagccagttccagtcctacccaatcagaaactctctgaataagccatccaggtgatgtactccaggtgattctaatggatgctgaagtctgagactcacttatctagatcttacctttacaaccatcacacacacccacaccccagaatctttgcaacaatgttgtaaaatttttttgtagtgtttctgcaatatggctttcttctttttgtctgtttgtttatttatttatttatttatttagagacaggatctcactatgttgcttaggctaatctccacctccaggactcaagtgattctctcacctcagcctccccagtagctgggactacaggcacacgctaccacacctgtcacaatagagctttcaagggcctcaaactttgtccctagtgggtttctctctcgctccatcctcctcctactcctaattttggagtgaaatgtattgcaaattgttctctgttcattccctatccttcctccatcttctccttcacttgtttctttttcctgaagcaccctcatcattgctcattggaagcctctccactccttacgttcttgccaaacaccatctctgctgtctcgtattcctcagatcactcagctaggagtgcatcttttcccttcctttaactcagtagtggttagcgtatcgtgcatcacactagagtagtggttctcaactggggccgattttgccccctggggacatttgcttatacctggagatggttttgattgtcacagctgcagatggtggtgctgtaagcatcaagtgggtagaggccaaggatgttgataaatatcctagaatgcataggaaagcatttcacaccacccccagacaattattcagcccaaaaatcagtaatgcactggccgagaagccctgcagtagagcagtatgtttatcttgtattttctctgagattgttgtcctcaccaccctggggttatgtctttgtcatgcatgcaagttccagtacagagaaccaggtgcttcataatgtcttcattttattgagaaactgagcaatcaaatattgtaaagtttaaaaatgtgtgatttttatgtggttattgttgaagtttatgtggagaattccattgtcttacaggcccaaacttgagttaaaactccactttcgttattaattacctagtgtgcttagggagttgggggtgggtcttatttcttctctatccttcgtggctgatgagctttaggggcagacaagttacttatgatggaactgatgaagagacggagggtcaagtgcctgatttgctagtttggaactgggtattgcgacaggggctgtattagaaaccttctgtctggaaaaaacattaatgggtcccctgcttgggtgtattctagttgttgtttgcaagcaactggagatcttggtctctttgctttgtacagccaagcattgtcgaggacacccagaagtctcattcctatgtacctacaggttacaaagcggtatgttgccttgcgatgaggtggtgtgcacgaggctctcttgcccacagggacctctccgcaggatggagaccagcacactttaatgtagattctgatctgaaatgcaccacaggaagggaactggttctgagagccgaaccaggctttggtaactcataagtccagttctcttattaagcacttgggtacaagctcatctgtgtgaatcccttggggcaaactgaactaagaaattttctgattttagaaggtaatttgggtgtgcaccacaaagtccataacaagctcagcagagtctgggcaggacctggtagtcaaatgcaccatgtgtgagaaacatcggaggagtctcatgaggtcggagaaacaaagaccattcatagcttggagtttgttcaggtgagcttttgctaccaagtgcattacagagtgtttttttggttttggagatttggggattttagagagacccagggatacaaggctgctgataggaaggtcagtttggtcttgatgagatggttacccggcatgagtttctattataatctcatttcgaccacagtgtagaaatgaaatgtcagatggggagtggagccatggggccttacaggaaacgttgccatggaaaatcctgcaacatgtcagcagtctccggcatgtcagcagcctccagcctgtgatgtgcagatctctaaagcactccatgggctcccctgattgctggcttatttttttctctttgtcacacagaggttcctttggtcttgagataaaggtcaggtttctgtgaaccgactggccgcagcctttcttctcctgccgtctgaggtggaggtgagctgaggcgcctggagtgttctatttggtaggtaagagaccccaacagcctggatgaatacttttgtaaacagcattttgtcagacaagagccatgttcatttccctgttgccgtgtgagtgagaatactgtatcttcagacagtcagacctcacttctcgggggcacggttctcagagacgaaggggacagtatcagacattaaaaaggagctgaagagaaacaagacataccaaatacactgaggttttttgtttgtttttcctactgagtttaaacactgcttttttaaacagcagctttccataatgcacgagtctcattaatatgaaatgggtcatcattggttaaccttcacttaggttagctccaaatacaatgtgacatcttatgtcaccctgattcttctaaacctgatattttattgtctaatgcacaactcttaatgaggatcataacattaatgtgtgataataaaaagatcttattgttaaatgctactattatccataatggtataatggtatagggactgtttcttaatcagtccctggtgaccaataccctcaagaacaaaaaaaaaagggggtctgtgttgtacatcttattaagtgcattgggtttttatggtctaccatagggactgaacagaaaaagaaatttcctcgcttcccctctttcctctgaaaaacaccattcccatttctgtaggaaaattcagggtctggaggctcttgtagatgcaagacacagccacttgtgggagggggccttacttactttcaggacaatcaaagccaaaacaaaggtttcttgtcacttggggcttttatccaatacatcccatgttacaaacaataaatcactggctgaccaaccttctttgccaagggaacctgtgggggctttaggctatttcatagttcaagtaagaccccatctattgacttacctacctccatctacctatccatccaccatctatcatctatctatagctatgtattatctgtcatctctctctctctctctctgtctatatctatcctcaatctatttgtatatgtgcctaaaaaggaaaaatggattggcttgaataattacaaacacttttaaatttttcccactatctctccttctgatgctggaggctcctagctgagtcagctaatcacagcctggcacaatgtgctctcaaagaattatgggatgcaaagacatccttggtcttcatgagtcgcaaatgtagggcatgcattaagactcaaaaatcataaagaaaatatacggtttctactaggaggaggaattccatagcacattaattctgtggcacaactccaaccagagaatgagtcctattgctttcttctggaaaggttaagccagcccttatgttatagggaagtcatgtccatatcacattctctttactgttgcattgtatgatacagatgaagtggaaaccctgtcttcaatgtgccatgtttctctctctctagagggtctgaagcattcctgtgagggaatccagaaatgtggagtcctgtatgtccaactagtacataattcacacatacatttctgtctactgctctattctgaaagttaacttttcatttccaaaactatgcgtgaattgactatcatcatttgattgttgttaaatttggagaaagaaccatttacttgagacttggagctgaattaaactatgtagcgtgaagggaagccagttttaaaggacgatggcagccaatttcttttgttactgatgtttttattttttccaagaacagttaacatttactaggcacctattggcctcagccacttgcatctaaagagcaaagctagtttacccgcggcccatgttcttttcgatggttagccttatttcttagctctgttaaccactattctaacgttagcttcaagttcagttttaataatctattccatagttgtgtactgctccctgccacatgaacaaaaagtttgggggaataaggcgagcagtttacattttctgtggatacttcaagtaattggccccaaagtgaaactgaattggccatggtttatcgtgttctgaggggataaaatgtgtaaggaaacggacctgtagagagggttgatatccaagtatgcgtgaatgtgtgaaaatcctataactccacttcaactggcctaatatcctgagtcactagatggtcagaagaatagatacagtacaaaaggaacaaactgatgtacatttatactaaaaaaccaaaaacaaagtttgtacaagatgaacagcaaatgaaatagcttctgtcaaaataaaatctcacacaggtaatttttctagtacgtggacatacatacacccacacacacagacacacaagcaagaatgtgtattttgtaagatataggttcttggaaatagacattcttagcaaatatggatgacagatcaattgtaatttattttcttttaacactgtatcatcataaagaaaactggtataaatgaaaaaatctatttcaaatatctacatctaaaattttaggcagtgaaaaagcactttgttgacaaggagtgtggaatgatgtatgttaattgtcagaaactgctgaatgccttgtttagttgtcacaaacaaattcacatatcagaacgaacaatactgctaaatattccttttttcctgcttttttttttttttgttaaaacatactgggagaaagtaaagaaaaactggaaatccatacatctttcaaaagtttgaaattgaagcaatatttagaaccatagatgaggaaacacggcggcattggtgtaatatacacaacgcgcttttcttctttaatctgtaatgtacatcaaatactttacaacaatgcattaacaaaaggcaagaaacatcttgctgtacagaggaaccccaatgcaacctgaagcctagagtcacaacggatgaagagagtaaacaaagcgtgagaagccgtcccccacacagtgtgtaaactattctgtgtcttgtgcttaacgataacccttacgccccaccggcccgaatgcctcgtctctcctcccatcaaccacgttcagtataaagcacttctcgttactctacagctcacgctagaaaggtgctgcccactgtcatatttaggatcactttagctttctactgatttccaagttaacttgcgattcatttagctttctaaaatagctcttaatatttccttactggttatcacagccttcctatggaacaggctttaacaaactaaatttgcaggagaaaaaaacaaaacagaaagaaatgtcttgtggtatgcatgcacatgcactgttcccggagcgcctgtgccctgctcctcacacccaggagtcgggggaggccgggtagtggctcgtttcatagttcagttcactgtagggacgggcagctgagtagaagtcaacgtagttgccggtggacttgagacccaggtgcatggtgtactcgctggcgggagggcgatggtggacctggtcctcgaagaaggactcatcgtaatttcttgtggaattctgaaatggctggtaggtctcgtaatcttttctgctgggctcctgtgggactggctgtgctgaaacctaaacgggaaagaagagccacactgggttacttggtttcccttgactcagcctgcctcttgccccggcacccaactctccttcaaagaataggctgtgtatatccaggcattcaccactgtggccctgcttctccaaaactgccaactgtcattggctttccttttgaaaattggatcctaggtccacgtgctatcattctacataatctttatcatggcaaaatatacataacataaaacagcttgctttaagaaatgttgaagtgtaagattaattaggtggcattaagaacattcacagtgttgtgcaaccatcaccaccatccgtttccaccactttttaaatcatcccaaacagaaactctgtgcccattaaatgtaattcctcatcccctctctctcagcccatggcaagcaccattctactttctgtctctagaaatctgcctaatataggcactgcagagagtgtttgtccttgtgtgactggcttctttcacttagcataaagtttgcatggtccatccatggtgttgcacatggcagaccttgatccgtttttgtggctgaataatattccactgtatgatgtgcattgctccactgatgaatgcactgaaggccatgactttacctcaatgtagcaaaactgcacttgcacccccatgattgtatatatataagaataaaatagtccatggtatgcatagaccacattttatttatccattcatccattgatggacgcttgggttatttttaccttttagctgctgtaaataatgttgcaataaacattggtgcatttgtatctgttctagtccctggggtcccttttcaagcacctgcccctgaaatgagcagaacctcccaaggtatagggtgaggttaaccctacagcaagtgcataccgggatgcacaaagctctgctaatgtgcagtaattggggaggagatctggtgtgaattattaaacactcttaaagaaatactgtttgatcacttttgggtggactcagtgactccctattaatttaactaaagttcagcacggaaacgttctctagaaattggtcttagttaatagataatgatttgtaattagcacgttgtgtgtaaatgaatgcttttaaaggcttacacataattcttctctcaagtaagtgaaactccctcttatatatgtcattgatttatactagtaatcaacctgatcttcaaagaagtggtgaacttcatcacagcagctgtctaggatgtcccacgtgtctagttagtggtagctgaatgaatgaggtttctgtctacctacagaagtccaaaagtccatagaggataaacctttgttagcctgagagctaacaaaggatgagaggaacatttggaatgaatgtgcaacatctgcaattaaatactgctaagtccaggtctactggactgcgttgctaggttggggtgccctttgctattctttgaagagctctgcttgtgtgctgctgaactccactccaacacagggctgttttccaagtgcaagacatgcaaaggctcagaatctagaagtttggaaaaattatacagggagggaactagatttgctgtgtttcttgttcagcagggcaccctattcaacatttagcaaattctttaatactccagtagtcataaatatttatgtgtgtttgtgtctgtctacatcaatatctataatctatcatctgtctgtcttcctatccacccaccaatccatccatccatccatccctcaagcaaactcccaccttatagatgagaaaactgaagcacagagaagttaagaaacttctccaaaacgtcatagctagtggtgttgtgaactggaactggaacatacggctggctgactctaaaacccaggtgttctaccaacgtagtccagtcccatcagagccaaggtggccaaaccttggaggacaggcctcaaggagctgactctaggctctaagataagaaagtcggtggacaaaagagaccaagaagcggtgtgttttcttatggatttttgggggccagggaaggcagtgcaggggacagggacatcttcaggaggagtcactcacaagggttatagctctcctccaaagtggcttctgctttcatttttttggttcttttgcacaacctcgttcaaattgctttgactgttgtcatgttctctctggttggtgaacatttgggagctgggtatcagctttttcagcctcttaccccagagaattaacttcttcattcatctgtactgttcataaaatcccacaccaatcacttctgaggtttggtgccccagtcccaaaagtgtgtacaaatgaactgtcacaggtgacacgtgtcactgctgcacccggagagacagaatttgctcactgtggtatttgctcttgtggtatggacatttctgtggtatttgctcttgtggtatcttgtggtatttgctcttgtggtatggacgtcttgtggtatttgctcttgtggtatggacgtttgctggtgaaacacatccacagtggaggaatattggctgcattttaaactttaagggaatatctgacagttgaaaatctggctgatgaaatgacccctcccaaagccctcctcacataagagctaaaaataaatgcattaaaaattgcacagtttgcatcagccagatttggatgagggatgtagaatgatgccccaatagagcagaggggatttctgaatctgggtgtctgttacggtctagagaagcccaggaatacgcaagcccgaagcttttgccttctttgccttaacgctgcatcttgttttggaaaggggtggtgaccagcagctcactccagggtcaatatgctcacgctctctgcgctctgttccatggcttctgtttctaccaagtcatctttgctgaactttttcctcaacagtagaatattcactctaaattatgaaggatagtgtcatgacaccttccaactctgttagcataatgacaaaagacttctttgggtttattccttaatgaatttgccaggaaactggatttattttgaacacaagggaaatagtagcccagtatagctcttccaacttttccatgtctcagagtgttcatagaaagactcagagtgttcacagaaaatgaaggaggccagatatgaagtatcagtggtcttcaaagcataatcccaagaccagcagcatcagcatcacctgggaacttgttagaaatgcagattactgggtcccactccagacctactgaatcagggcctctggcgatgggccccagcaatctgtgctttaacagccctttggggaattctggctcatgctccaatttgagaaccattggcacagaggtaaaaaaaatgggacaggaagacagaagaaccaagatgagtatttgcctcttcctggctgggggactgaaggaaacacgtatcctcctgggatctcatcttcctcatttctgcagacaattacaactggcctgctcacgtgacagtggaactaaggacaccaggaaggaactcaagattccggttttgttatcatttaaatattggtcatcaaaacagcaaagctctttgtttctagttcctgaacaaaaatcctgttgtcagctagatagataccgttcaacatgatatttctctttgtaattatggggtggactggtagaagctcaaaaggatgtttggaaagtatgcatagttaagtctttttttttttttgagacagggtctcgctttgtcactcaggctggagtgcagtagtgcaattatggctcactgtagcctccaccttccaggttcaagccttcctcctgcctcagcatcccagctagctgggactacaggcacacaccaccatgcccagctaatttttgtattttttgtagacacacagttttgctatgttgcccaagctggtcttgaactcctgagctcaagcgatctgcctgcctcggcctcccaaaatgctaggattacaggcattagccactgcacctagtcagttaagtcttaaagtgatgtctgtaacccgttgacctcagacattcaaaccaaagatcacgaactgtgttttatactactgattgtttcttctaggaggctttaagctcagagttcactgaaaatgtgcctgagtcccaggtcacaggagcagcacccacgtgtggccatgtgtctggtgcaggcgtctctttctcagctctcactgtcttttgccttatcttggagatccacttgaaactgatttccctccatgaattgcttccccataagctcagtcactacccagtgtgaagcctgtgagacctggctggtgactgagccacccgggagacaggagcgctcagcagaggacaagcttcgatgctgaaactgaccaaaccctggaggatccctcctggtgaaactgttccaggcgcaaagttctggggtaacttttggcccagggaagctcccaacatgaaagcattccacctagaatggttggttacacctctatggccagagaatccaagtcagggatactgtttatgagtcctctctaggactcccaaccggaagagagtgaaaacatgtcttttgaagggttaggatggttgcactttattgagtccccaaagagaaaactgcaagtgaagacaaggtttattcctataacatagtctaaaagaagtaaaatgctttctttccttcctctccaagttcaatggagtgtcattatgatctccttggaaatactttttggggaggggggggaaccctctctttggtggacgtttaaaaatggatgttaggctaagatagaatgatccaattatccacttcccttggctggtcccttacagggaatgatggtggtcctgagctatgaagataggactcagctctgccgggggcttgcctgcaatgcctcggtcctgacgagagatgcggagcttgctctccatccagggtggattttagcaacatttgcctgaggcccagtggccttggtgtttcactctgagactgagtcaagcacattctggagacctctgggagaaaggctatggctaggtggtgttcacactcatggcaaggatgccatcttagcacattaattctcatttgcttaaatgctcgggatctgcttacgtaaaaagaaggtgccccttagagccattatagactgtcctctaaatctagatggcaagcagtcttttggaacctactgcagccactctgtgagatgccagagacccctggccatgtcagggcgtttcttcaatgccaactcccggggaaggaaggctggtgcagagggagctggttccaatgaggagcttctctctacctgaggggactcaagatgaatctcacactcttggcggcaaaatcatggtcctattacaacctgacaagaatctgtaataattggcaataatctgcttactgtacatccagaatttcataatatttgctgcaagaagcatgattgatttccataaatgaagttggcatttctaatacattttgtttctgtttgcctttatggaggcaggttggcaagtgaatagttggggcctccctggtgacctggtgtctacagctcatgaccctatttatttagtcattggcttctttgcttttagcaaatactagaactgaggggaggctgattagatgttagcaacacatcaaataggccatgggggccaagccattcaccagggggtcacagacaacaccatatgttttccagagtgctgcacatggagtgggctgatgcccaccatgggaaggagagatgtatgaagtttctgatcaacgagggggaacaactgtgtcttttggcttttatagttcctgcagagccagagaaaatgagccttcaataaatgtttgcagagtaacacacacatatactctctctctctctctcagattggttccttaagaatctactgttcagatatatagactaaaggaatagaacagaggccttagaaataacaccacacatctacaaccatctgatctttgacaaacctgacacaaacaagcaatggggaaaagattccctatttaataaatgttgttgggaaaactagctagccatatgcagaaaactgaaactggaccccttccttacaccttatacaaaaatcaactcaagatgtatcaaagacttaaacatacgacccaggaccataggaatcatagaagaaaacctgggcaataccattcaggatgtaggcatgggcaaagacttcatgtccaaaactccaaaagcaatggcaacaaaagtcaaaatcgacaaatgggatctaattaaattaagagctcctgcacggcaaaagaaactatcatcagagtgaacaggcaactatagaatgggagaaattttttgcaatctatccatctgacgaagggctaatatccagaatctataaagaacttaaacaaatttacaagaaaaaaaaaacccatcaaaaagtgagcaaaggatatgaacagacacttctcaaaagaagacttttatgcagccaacagacatatgaaaaaatgctcttcatcactggccatcagagaaatgcaaatcaaaaccacaatgagataccatctcacaccagtcagaatggcgatcattaaaaagtcaggaaacgagatgctggagaggatgtggagaaataggaacgcttttacactgttggtgggagtgtaaattagttcaaccattgtggaagacagtgtggcgattcctcaaggatttagaaccagaaataccatttgacccagtgatcccattactgggtatatacccaaagggttataaatcattctactataaagacacatgtacacgtacatttattgtggcactctattcacaatagcaagcacttggaaccaacccaaatgtccatcaatgatagactggataaagaaaatgtggcacatatataccatggaatactatgcagccataaaaaaaggatgagttcatgtcctttgcagggacatggatgaagctggaaacatcattctcaggaaactatcacaagaacagaaaaccaaacactgcatgttctcactcataagtgggagttgaacaatgagaacacatggacataggggaacatcacacactggggcctgctgggggtcaggggctaggggagggataacattaggagaaatacctaatttggatgtcgggttgatgggtgcagaaaaccaccgtggcacgtgtatacctatgtaccaaaactgcacattctgcacatgtaccccagaacttaaagtataataataaaaataaaataataataataataaaaagaatctactgttcagttctcctcaaacctgaatgtgcacacaagcgcatctaattagaatgcaactgtgctgcagaaaatcttggacgggttagggttaggagccagagaagaatctctcctgtgtttctaacaagattctgggtaacattgatgctgctggttccccaactagactttgagtagcaagacactacaatgcatttcatgtattgcagaataatagaacttatttatgtgttcttttacaagttctctattgaacttgctgtgtctcctttattggtagtgatcatgtataatgaatgcttccttcctaatgcatttgcagggttacaggagctactccatctctgtccagtaattagacaattcctgtttagtgacatcttacagttgtctatttgggggtttcttttagttttgcaccatagcagaatacttgctttctgcaccagatcaagcatgaggttcaaaggccgtttgcacatttgaggctgttctgccgagtccaacacacacacacacacacacagagacacacacacgctgcaacaggcgtgaggagagggcctcaggggacgttgccttctttttcagttctttatgtatgttggatgaaagtttatgtttaaaattccaggttatttcacatgagtcacactgaaaaggaaatacaaacgtgttgcatttactttacctggttgtgtttgatgtcttcagcgggcgcaccataagaattcctatacaaagttgaaattccagtgttttgagctaaaagcaaaaggaaaacaaaagtttagcaaagaaaacaacattacaaataaggaatagttgttattgaagcaagttcttgccctaacaaagcttgttttcttggggaccattccaagtagaagacattctttggccctgaacacttcattttacatacagatattaaaaaaggagaacagttattctagaaaatccccacagcatgtcagccgcttgcaataatgttcacatcacagacagggtcagggcagatgctgcaaacagatggtcattttgtaagttttatggccttcttttctggtgaaaactggcaggtaataaaggcttgtcacctgcactgaagcatgcaggagtctgtatcagcagcttagcttttagccggagagtgacaagaataaaatttctaatttgagctcacagaagtgcttgatcatctttcagacagttcatttcttacagacccaaaggacgggcagggggcatcgcctgcatgtcccccatgtatctggaagcctgcggctttggaatcaaactagatgcagagggaggatcccactctgttgtctggcttgcctgtcgtctagacgaaagagatgaaggtctcctctagttgccagcagcttctgaaggcccagagagggggcctattagcccacttccttatgggaaacccttgaagctcaagccacccactcagaggaagggcacaggccaccactcccttcacagctgctgaagggtcatggttcaagaaatctttggtagaatgaccatatcacctagcaatcccactgctgggtgtatattagaaagaaaggaaatcagtgtatcaaaagatatctgcattcccatgtttattgcagtgctgttgacaatagcctagatgtggaatcaacccaagtgtccaccaacagatgaatggttaaagaaaatgtggtatatgtacacaatagagtactgtttggccataaaaagaatgaaatcctgtcacttgcagcaacgtggtggaactggaggtgatttatgttaagtgaaacaagccaggcacagaaagacaaatatggtatgttctcacgcacatgtggaatatgcggaagctaaaaaaaattgatctatgaagatggacagtagaatgatggttatcagagactgagaagtggagttgggagagaggaataagaggggatggttaatgggtagaaaaatacagttagaagagaaaagatctagtgtttcatagcaccatagggcaaccataattcacagtaatttattgtatatttcagaacaactagaataatggaattgggatgttcctaacataaataataaatgtttaaggtgatggtatctcattacccttatttgattgttatacactgtatacttgtatcaaaaaatcacatggaccccataagtaagtacaactattatgtattcataaatttttttttaaaaaagctttggaaaatgctgtcttgtgtcagtggggtataaaacactctaaaactaggaagggctcattgtttgcttccagtatttaggggataatgaagtaggatcactctacctataggccacaagagaaaggtcagtataacctctcaaggtctaagttcactccacccatgattttttacctaagagttcactacagctgtgcaataaaattcctcctggagaattcagcttagaaagtgagagccgaaagtccatttttccattttaaagaccattctgttatcctctctggttgaatgcatgtcactcctgtctctgtattatggtgcaaaccaccatctctctctggaccattgctaccaaatcctcctcgaaggcccaacttccactctgcccagcctgattcctccatccaccctgttaccaacagttagaatgctgtctttgtaacacaagttgggttctgtctctttctctgcttgtaatgctccaatgcccttcaccctgagacggctctccactatggccatgaggccctgcaaggtttgtttcctgcctaaaatcctaacacatttctccctcctctcctcctgttaaaggagtcccagctttgccgaccctccttcctcagagcgggccaaacttgtttagcttcggtgaggttgtctttgctgatctttctccctggaactcgcttccctcagacttcaaatgtctcctcctcccacgtcaagtgaagtaaccccttccgcctgcacccccatctcattaccctgatcagtttcttcttcctactaaacacagtgcagtatcatcttgctgggaacttgttatactgtttaccttatgtactgtctgccttcctcttccagagcagaaggcccttgagagagaaacagtctgtcctgctgctacctccgtatgtatcctcagaacctggcacagcacctggcctcagtggacacccatagagtaagtgccccatttgctgaatgaataaatgggtaaaccttagatagatctgccttcagagctataatttgctgatagaaaatgtcacttgaggaataaggtgaaattttgttttttctgttgctcagaattaaatgcatatattttttagaacgtttgcactattgcagtcttggcctccctccctgttgtgaaatcataaacagacactgagacgctctcaccagaggaatcttaaaagcacgaggcacagtttgtggcttctgagcctaggatgttaatactggaagttctttcccctcactcgtttaaacgagaccatagctgagactgaattacctttacagacacgtgaggcagaggaattcacagaggctctgccctcatatgaccgagctaatagtggactcacagaagaatgcctttctatttttctaacagcccccaaatacccaattcccaactgaatcaacacattgaagactagaacgactttcaaaggcataagaggccgggtgtggtggctcatgcctgtaatcccagcagtttgagaggatgaggcgggaagatcacttgatgtcaggagttcaagaccagcctggccaacatggttaaaccctgtctctactaaaaatataaaaattagccgggcatggtggcaggtgcctgtaatcccagctactcgaaacgctgaggcaggagaattgcttgaacccgggaggtggaggttacagtgagctgagattgcgccactgcactccagcctgggcgacacagtgaaactccgtctcaaaaataaataaataaataaataaataaataaataaatacataaataaatggcataagaaagacactgacaaaaaacaaacagaccattggatgaaagggtatgtgggaagttcagatgggaagggaaaacctccaggtgaatttaaaactcaggcagtggagctgctgggatgctgcagccctttcttgaggtgaactgaacacgtgaggttcccaggcatgcagggctgcaagaactcgctatggaagccggcatgcctgaatgaatagccaactggatttctcagggctctccagtggcagagaaacacttaggagagaagaattttatgaggcttcatccaagctagaaaatgaatccagaaaaggagggtgggggaagcctggaataaacacctagatggatctgaacttctaagagctcagcagaagagatgacagctccatcaaagagatgtttgcacttccagccctcataggctgcattttggggatgaagcttcccttgtggttttcatatcagagggaatgttttcttggcagggaatgaaacaaggaagatggcagtttttcaggttatctttcaatgcactgaactttaaatgttccgtagatttgttcttgaacaagaaaaagcattgcttttgatgttggggccacaagaaatctgattttgcaagtaaaccctggaatgatgggcatttgctaacatcctgcaaggtgggggttgtaaactcaatatccccatcaatatgtgaaagactggcttccacctggcttggctggggacttattcataccactactgaaagtggcaaaccaccactatcctcacttctgctatcccaccatcacctccatcaccctcactaccaccaccaccaccatcattgttgtgataataacaatcggcgtttacatagcacccattggctttagaggaacttccctatatacacataatattcaataaagatctcaatgttctttctggcttgctacatgattgagagtgtactcctgaattgcatttttaagtaagttagagcaaagctgtttaagcctctaaataagtttgaagaattacatacactgaaattgtcaagatccctgccattttctaagaagattaaatatcagaaacatagtaaattttatgttttattttattttgagtccagggcacaattatgtgccattggaactgttttgacataaacacgcacacccacacctgaaggccttttgaatgattctcttgggcaagagagttaaagagaaacatgaaactgaataataatgcagtcgatctcacaactgttccttaatctcagtgtatcatcccagacagctggtgatgtggctacccagggcaatgataactgcacattgaaagggtcagttgaatttggtgtcatgactagctcagcataatcagtacaaatgggatcctctgccgaatgtctagactccagggactcagaattcagattcacagctttctttgttcctgttcatctacgcggcaacatgtaaggggaaacagtgaatgtgaatagtaacctagagtccatgtaatgagttaggttctcccgttcaggaaacgtctcaggagcagcgctgaggtgttcccttgtagggtctgcacatggaggcagaatgtgctcctgggggcagggataagaaacatccgtttattatagttttctttacgcagctgagcagagttaacacggaaaacactgccgctggggtaaatgcatttgctattagaaaaatttatcttcgctgtcctggtttggaaggcattttaataaatcatccaatttgtctgctctgcttccctgccagtctacacctaaatactactggagaactgcctcctgctcttcagattcctctcctaagagggtctcagtgtctgcacggcgccctttgcgccccagctttatgaatgctctaacatggccttgttctattaaaggctcttcctcatagcctattttcagcagggacccatctccatgcccatgtggtaaagaggatgtggggtccccgttgaaaggtcctcagggctccggcagctttgcttttaaggtataactccctctacagccagagcccacatcctgcttcttggaggagggccatccagggagagggtgaggtatggagagcttggagggggctgtgagtgcctcaacagaagcatatacagagtgtacaagacgtacagactatacagtgacttaagggtaagccctgttatcagatgggctgggcatggcacagtggagggggcagagacagatacccactgtaccaattctggcctccatagagtcttggctgatgagaaaggaaggcaatggctgtgactgagatcgtgagggatgacgagcgtgaaagatgaatgcctccccagggaatctgcagtcatcagctctaaggaagcttctttgggatatgtcacgtaagaggttgtatcatggcaagaggggaaaatatctcaacagcagtttcatgcagttccccttaaatcctcctcctgccctcctctttccattccccgtccctcccctccccactcccctctcctcccctccccactctattcccctccccacctcccctcccctcccctccccttccaccttcttttcagttccctccattcctaatgcacagggcctaactacactgcctccatcgagtcccctccccagtgggtgatgtcaatgaggaagaaatatgtgggaatattctctctaatttgaaagaatattatgagctgggcaaacaagaggaaaggaccgataaaacatgggtagaaaacattttatcttagttatgcctctattcttagtcccaattcttggaaatcatcattatcaagctctcaagtgactggacagctgctaagtcctgctcagcagccaagcgcagccagccccgtgaagcctgatgtcccatatctctgccttgtcgcgggtcaagccaccaagttccaggagggggcgcgcgaggggcgctcacctgtcatggcatctttcctggaagtgtgttcgcctttagctccgtggtaggtggcgttgctgccggtgcactcgtagtctgttttcctttctttgaggctgatcatttcccgaggtgaagctggggcacttgctacataaagaaatcaaaagggggattttctgcatctcatcccacagcgtgtgtgccttccacacagtcagggtcctcactatgcatggtcccgcatctcaatgcctacgtgaggacctgatgggttttctttttaatttttattttttggcagttttggctcttgtccctgccccattccctcacctgtgacaactgatgctttatagttagagggcatgtgatttggaggctggcaactggggaccacatcctggggccatcttcctcagagagagatcatggaggggacgtgacctgcccaaggtgtgtggggcagtttaggaatgagactgcttttggtttcttcctttctcttctcttttccttccctttccttcccgtgctcccttccttaattagatgtgtttcagaagatctattactgatattgactaatccttgattaaaataaatgcagttttacttaaacactgagtcacctagaaactgcctttaaaaaagtcagaggaaacagctctctacacaggatgatttgtggggcaaaaataaccaagcccacaaagaccttctttgtctgtggctggggtgggctggggaggggcatggaggcagctctagttcctgctagggcattcttgctccagctttttgcataaacaccccaataatctctgaggccctccttacacctcagccactcactgcctgtctggctgggaggctgagccctgccgttcctcttacacccatttctaaagtgctgggttgtaattggaggatcctcctgggaaattccaggagtccttaaaaaactggtactagaagagaggaaaagctgaactcagaggcaaggaagtcagtaaaaggaggttgaattttcatgagtgactgaatggattggcagcaactcaaccttcctgccagtgcagaggggcactgggagaggttggcaggagccatgcgtctgggtgagggggcagctggtcgcgcaccccaccctgtgggcacctgcagctgtgtccagctccgcaggagctcaggtgccgtgtccttctgtcaggaagctctccccagctcccatagcccagggcagtgcttcagagccttgtttaccctcaacactcacttgagaatttatggatgcccagagcccatcctggaccttttgagtctgaattttcagtgacgggcttcagaatccatatttactgagcatacttggtgactattaaggctaggaatccctagagcactctgatttttaggataaatctctctttcctttgctagtgtcaaagctcctccccagccaaacttcagtttaccttcgagcttatcattcacaccctctgtagggtctctttgctccttgggtctgtggtcccccaaggcacctctcatgtcactgagtcatgtgattcagtttgtcacccttatatcttctatgtacaaattcctgtgctagccactgtgcaaggcagacatgcagatcacgtggctcttcctgaacttgtgcagctctcaatcgagtaaggaaatggatgtccaaataaagtagaatgagaggcagaagtgcccaacagacgttacagccaagtgctgggaagataaacatgggttgttgccaccctctcaaacctatcaaaataaaatcacgcctcaatgctcagctcttgaagccatcacgggttttggatcctggatgcctattagaattcattacctggaatcctttaaaaaaaatactgaggcttgaaccccacccaatgccagctggccagaagtcctgggtacaaatgcaatggcagacagggaagaaaaccatgcagctcagacagctgcagcaccttcatcacttgtaggacaagcctggagctgcaatgacttgatcaaggactgaacctccctgatccacagtgaccctgtgtaggtggagagaatgcccaggctctgctgtgagggaagagaggttccaggggagaggacaaaggctgggacttgggccatctctgtcccgaatgtgaatctggggagatgtgaggggcagccactgtgtcgtatgaagattggggttctgttgcttggagagggaacctctgcaagaacaactgagtccttagcaagctctgtgccctgtcactcaactgggctctgcatccagttcctgtctgctcgctggttcctcgctaacctcttccacctgctgcccccttctctttggttcaccatctttctcttccaggaaagtctctcttcctgcctttgcccttttgcctctgggtcttccctaataaaggttagccttttatgagttactgccacataatcatgaagggacaatattttaaaacctgttgaccacagcttttaaaattagaatccaatattgcccagatggtggtgtttattaaaccacatcaagtgtgtaattatctcctgagacctcacacacagcggtgctccaagtctctggtaaatcaggattaagttctgggaaaaatcaaatcacgcaaacaagtgtttattaggtgtctggatgtgcctcgcctaggaagtcctgaggcagcgcactgtctgcatggctggttgaacacagccctgcctgctcgcgagaaaaggctgcttctctcttccagcccttgccgatccatcatgtcgtttcattctcataacactgattggctcactgtaattcttaataatcactgctttccaaaagacaccatccatatgctttccacactccatgcgctttatctttttaagcctgctggaattacagaaataagaggcctaagaggccacctccatgcttctgagatgggtggacgtttccacaggtacagggggttcctgatcgtcacccagggttggactaaatgtgataagcaatgacagtacactagaaggatcagctttcacagagctgggagcgggccatttatttcagtcagatattggccattcatttctcatcatgttgacagtaaagtctggcgtggagttctgcaaccatcattctcgcgggtagggagaccactttgctgggcaatgctctctaccaggtcctcccaggtgtcatttcagagaataggatttcctcagcagggagagggcagagaagagtaggaagaaagctttcataaataagagcctacatagctgtcatctgtgtgggtgcatataacttgttatccatctttcactctcagaacaaaatcaaaatgcagaaatcaaaataaaagttttaaaaactaaactgtgaggaaaacagcaaatttatgccatttatattactaaatggtgtgttcacatttgcctttcatctttcctctgatttttggcatttcttaatgtgaattaaaaagggtataaaaatcaagtatttttacgaatacaagaagttcaaaatttaagcaataggaatgtgacaaaattagaaaaaaattaaatggaatgacatggaagttatagttggctacgataataatttatcagtggcatctgccggtttatcattaataatgaaaagccaattagatgtggaacagttatgaaagcatcagtgctatgtgtcaaatgtatatcacactgaaggaagaaagcacatttggtctcctcaactttttatcccaattatgacaaaatgcaactcaaactatttttattttatttatttatttatttattgagacggagtctcactctgtcacccaggctggggtgcagtggcgcgatctctgctcactgaaatctcggcctcccgggttcaagtgattctcctgcctcagcctcccgagtagctgggattacaggcgtgtgccaacaagcccggctaatttttgtatttttactagagacggggtttcaccatgttgcccaggatggtttcgaactcccgagctcaggcaatccgcctgcctcagcctcttaacatgctgggattacaggcatgagccacctcgccaggccaactcaaactattttaagttggaaaaattgtccacggaaaccccggatttgcagacacatgacagttttctttatactcgttcctcctgaattcaggttcattacgtgcatgtcatgcataagaacctgttagagaaggagatttgctctgagtctgtgtatacaaaacacagagtggccaccacagtacaaagaacagattcatttcctacttctagcgaaggtctgaatggaaggctctcctctgagtacgggttggctcacggactgggaaggaccgtctttgctcaacgagaaataaagcctggctggctagccacggcagcctcttacctgagcggttgttgggagacacgcgcacaggggagatggagggcgtgcgggaggaggagtagggcctttgccggtccctctcgatggttgaagacgaggctacaaagtggtattgtgaccatccatcctgcaaaacacagcacgctcctgttagatgggcaagacagagtgatttttcacctccggacatttttaagttccaagtatctggatttgcataatatttctatggtgtgtcagaagaggttcttgaagttctgcgctctcatggaggtgaacagagccaaatgtgaatgaagacacacctccttccctccagagagcctggcgggtagggcctgctttccttcatgaatgttgaataaatggtccctttacaaacccgctctggtcagaagcttcgacttcgatgaaaatacgatgctcagaatgttaggggacccggaaactgtctattttttgccgacctggttccagctctgcctggctccctcttccgctgcctcaagattttccacaagggtttacccctttgctcccaggacctatctgttggcaaccagaatccagggcagcgtcctcccttcccgtttacctgcctgtgtcctttccagccccaaatgcccaccctcgcctgtctccaagctggtctgctccaggaatgatatttttcaatatagagcatattcaaaatgcatcctaccaagcctccgttaggcttctgacatctagttaatatacagaaagcatctatactatttttccttataaaaaccgcataaatatatcacagattattttgtgaatttacaaagcataaagaagaaaataaaaataggtggtaattccaccctctccacctgagagaactcctgttaacctgtcatggtatttccttccagtctttttttcttttttaaatagattttatttttatcaaagtaacatgttaaatagtactaacattatagcaaagaaaagcagtcacctgctccacccccaaatcctcctttacagaggccattgctttcaattcttttagattttttatttttttcccctgacaacatttagacttttaaggggctcaatgctttgttctcttgggattgttcagagaatcttgccacacagttagcacctagtaagtaagctgggtaatatcttttaaaatcatgcacctctcattctggctttatcctatcagtcaagtagaacaggaataacgagaattagatacacaaagattagtcttggtgtatctaataagaattaggaacatggaaatgagtatgcattttgttctttattaattcatctatttatgttttcaatgatttttgatagagttttgagccccttaaaagtctaaatattatcagaaaaaaaagctaaagaattgaaaacaagtgccaatgtaaagtgggaacaggggctgggacagtgcctgctttcctttgctataatgtcagtaatattggacatattactctaatggaaataaaaccaaactaatggataccattatctgcattctacaggaagaatttgagccttcgaaagtaaataggccacccaaagtcaaacaatacacaagttacaaaaaacatattaatactaacgtggcattctaacaagtgcttggaaggaaaaaccaagccggattaggggatagacgagcaggggcggggatagaggagcggggtggggggagatggaggagctgggacggggatggaggagcgggggcggggacggaggaagggggcggggatggaggagcgggggccggggaaggaggaggggggcggggaaggaggaaggggccggggaaagaggaggggggcggggaacgaggaacggggcggggaaggaggaaaggggtggggaaagaggagcgggggccgggaaggaggaaggggggcggggaaggaggggcggggtgggtatagaaaagtaggggtgaggatgctggcatctctattttgtggagtggggtcagggaggtgctgtcgggagccttaacgttgcagaaggacctgcagatgacaattgaaccagaccctggtgacacagatcttggcttcccagcccacagaagaacagatgtgaaggccctgggtgggaacggcttcgctggtgtgagaacaggctcctgggactgaataggcgtgagcagggggccaggaagacaggaaagctctgggtgtccaggacagtttggggaggagtagccacagcaaagctgcttgggaggtcactcccctggacagaggagagatggcccaggcttgaagggtgctggtggtgggaagcgtgcagatctggtatccacactggagggtttgctggtggcatggctattggtgtgggaaagaggaatcaagccttaccgcagtgcttctggtgtgaaccacaggggcctgaggtccccttcactgagccaggaacaatgggagggagggaagcagctttagggagtggaactaggactgcctcatggggacgtatatggttaccgaagagggacagagaaggaagcaggatctgcaaactgggatctcagggctggaggcagaattttggacgtcagcatatagatattatttaaagcaaagagaatggatgcaaacctgtaagcgaatgcaaataaagaaaagcagaaggcagaggctgagtcagcctgaggacattccaatattgagaggggtgcaaagagtaggggaagcttcaaaggagaccaagaaggaacccagtgaactacaggaagcatcaggagggtgtgactgtggcatcaggcaagaccaaaggagcaatgcgtgaggaggagaaggagaccaaccgaataccgaggaggaccaagagctgcctggtggtctgggaggaaggaagtcctcgtgacggggacaaaagtgctttctttggtcaggttggtaaatgtctaactccagcggtcccaaaagataatgagaattggtgaaggggagacagtgagtacagacaagcctttggcaaagttttattttaaacggaaatggagaaatgggcttgaagagagtgagggctggagagatgttttcatagatcacctagaagatattgcagtatttcgtgtgctgatgggaatgactgaatgcagagaaggaaaaacctggggacataggagagaaagggaaaaatggcaggaagaacattctcaagacaggaaaggtggataagattaagtgagcaatggggtcactgcccacagaaacagactgtggccatggacatggggaagagactggtagatggggtgacaggaagataaggatattcactcttgatttttttgttttttgcattttcttatggaaaatgagaagaagtgaggtcatctgctgagaataaggaagggttggagcttagagaacagagagaagagagaaagggaagggaggaaggaaggggacggggatgtggagtggtccttgagttgggtggggagcgagctgactggccagggcaagtggccggggtgccggacagggctggaggctgtggcaatgaaccaaaaaggagctgactggtcagcatccgtgtgtgcctctctccagccacagtcagctgccctagggcaggtgtggagtgggtagagttgatgggtcatcaggcaacttggagagagacaagggaacgtcacggaagctaagcccagtagggaggaaaatgtaggtgctagagacgatatggagagtgtatattgatcagggtactggtgggcttatgagggccacaggctgttgggaggatacttcacaggtgctgggggttttcttgagggaggggagcggagatccttctcaaaagagcaatgaggagggggcaagaaagacgactgctccaagaaggacgtctgttccacctccagggtgggacacaagggagggagggtgggtgggaaattaaacagccctcgaggagggggctcggggggctgtgtcctcagggccgacaggagatgagcagaagaggtttgcgaaacggacacaggggattttgctgatttatttatttatttttcttttgagacagagtctcgctctgtcaccaggctggagtgcaatggcgtgatcttggctcgctgcaaactccacctcctgggttcaagcaattctcgtgcctcagcctcccaaatatctgggattacaggcatgcaccaccacacccagctaatttttatatttttagtagagacggagtttcaccatgttggccaggatggtcttgatctcctgacctcttgatccgcctgcctcagcctcccaaagtgttgggattacaggtgtgagccactgtgcccggccaattttgctgatttttaaccacaggttaaagagggaaaagaaatgggaggtggacagaagacaggtggaatatatgggggataactggctgctcagagcctttgatcgaggggtccaagtaatgatggtcgtcccaggaggcttgggtgattgtgacagctgaggtgatgagagatgaagggtgtaagttacaaataaatgcctccttagggaagggtgggggtggtaggtaggtatcacggcaggagaaaatgtctccactggagttctgtggggttctctgaaatcctccggagggtggaggcaaacacagaggaggagcagtcttaccaaaaacacgttcaggatggaagatatttcaacaatgtatgtgtccattacttatgtatgggaacgattaaaaacattttttttaggccaggagcggtggctcacgcctgtaatcccagcactttgggaggccgaggcgggcagatcacgaggtcaagagatcaagaccattctggccaacatggtgaaaccccgtctttaccaaaaatacaaaaattagctgggcgtggcagtgcgtgcctgtaatcctagctactcgggaggctgaggcaggagaatcacttgaagctgggaggcggagattgcagtgagctgagatcacaccactgcactccagcctggcaacagagctagactccatcttaaaaaaaaaaaaaaaaaatttaaatccctgtcttttgaaggaaatgctttgtagagggcagaagtcctaaatatgactgaatggggacagatcattttatgtttgtctcattgcaatgtagaaggtgtgctttgggattccaagtagtggctcgggacagtcgtttagtcaaaaccttggcttctttggctatgaatgtgatgatattctgtgtggtattaaaggtgaacaaggtactttacaatgtgaatattggctaaatatttattatgttctaagacctaaggacacactagacctaaatgtggcacagctgtaggactggtttcacttggtgagacatcagtaggtttgttagcattgctctcttatgcaggtgattggagatatgtgttgctcagcaactcagatttcatgatgtttagactatactgcaaccatttaagtatttacatttctggaaatgtcagaaaactgagtgtaataacaaaattgcttacaaaggaactcctatatggatgcactcaaaaaattttcaaatccttcataaaatcaaatatggaaaatgcaaatgcctggcagaagtgtggtcctgcaggtaacttgtctgtatgtgattgggttagtatacaactgagggtgatgacagcggagtgtggtgggagaaacggagaagcaatccctgactcagaccctctgaggatggccagggactgcatgcctgtgggtataggcactttgaatggaggggagaagggagcttaaggaatggggcagagtaaacacccaataaatatcttcgttagagctgtttcctgacccacagctcagaagccccaggaggaacagaataccttctacactgcaatgagacaaacataaaatttgtgtgctgtgagaagaggtgatcttctccatctcccctctctcattcatcgatgcagagtgaaggctacagtgactaaactgcacaacttcaacactgctatgctcaacaatgcccagaaaggactttaaaactttagttccgatgccacatacagttggccctctgtatctgtgggttccacatccatggatttcaccaacctagggtggaaaatattccaaaacatattgtctgtactgaacatgtacatgttgttttttcttgtcatccttccctaaacaatgcaattattttcatagcacattgtattaacattacatattataattaatctagaaatgatttaaagtttacaggaaaatgtgcgtaggttatatgcaaatactgcaccattttattaatacagccgggacttgagcatctacaaattctggtatccttgggaagtcctgtaaccaatttcccacagatatagaggagcagctgccaaatgtcatggaaactcatggaacactagatgctagaggctagggtgcagctggcccatggcatagatcaatcaccactcattacaaacaccttgagcacaaatctcatggccttcctcatcttttattgtataaaatctttagtcattcaattaaaataatgtttcactttttaaataagaagggaaagttattgctaagctgacattccttctattccactagccatgtatatttttgttatctagccagctagcaatcaatctattattcatttgcttcccactgtcactcagaatggcttggaggtggttcacataaatatatacaactcgggcacatatcatttcaatcattatttgcctctttaatcactgtattttcttgttaaaatatcaacttattgtaggccagagacttcttttgtgaattctgttatattgggcattttaccttagctcttctttgcaccacctgtacagctcataggggttagataagaaagcccagggaagaagcagggagagtgaagaatcaccacggtaaccggggaagggccatgaatccttcctattgatgataaagaactcttttactatctgtcgttcaccttcaacagactgacccacaagttgtgcccttcagctgaagacgcagctaagctgtcaaaaatgtgatatgatatctgtgcctcaaattggtttttatttttaacacattacacttaaaactggaggttgttaaattgttccaagtatatagagatagaaatccaaaaaagaagatgagttcaaagtcactgaactttaaattgccaccaggaacaatctgatgttctttatcttacaccctttagctgtccctccaccactttcagcctctgtgctcaagttttcaatgtgtttcttatgaaactttattattccccaaagctacaatcgtccatacgggcatttccaatgtgcacgacaatcgggcgatgttcatccccacagccccactaccatcggtcttcacggtatttctaggacgtggtcagtctgtttagttgatacaggtcttctttttatggatttcgacggccctgaatctataacactctccattttatatttctgaacatcctgtaaacatcgccaagaagaatgtattagtagagagacttctactaacagtttgaatgaggggactaagtagctttcattcggactggtctacaggaggttaggacaacacacacttgagccacagcttcttattctagaaattgtgtggctgagcgcagtggctcacgcctgtaatcccagcactttgggaggccgaggcgggcagatcatgaggtcaggagtttgagaccagcctgaccaacagggtgaaaccccgtctctactaaaaacacaaaaattagctgggcgtcgtggtgggtgcctgtaatcccagctactcgggaggctgaggcaggagaatcgcttgaaaccgtaaggcagaggttgcagtgagccgagattgtgccactgcactccagcctgggtgaaagaatgaaactctgtctcaagaaagaaaaaaatgtgcacgacattcagttcagatgagcacaggagtttgttagctttgtatgcaggggatgagctagaactgtctggcaaggctcaaaactattctcatgaatatcttttcactacttggcttgctaaccctgggtgtctcagcagatagagaggtggaattagagagctgtcaggagttggcccttctctcacaattactggtaagctccatctcagcttcttttccacacattaagggcaatgtgactcatcaggctggggagttttaaaaatagtaatgcctgggccccagccctgaggttctctttaggttattccgggtagggcctgggtatccttattttcaaaagctccactcctcccccaaatggatgctaatgaacagccagggctgtgaaccattggcttggggtttctttgcataggtgtcagtgacaagttggggcacattttttaaagtgctaaatcccaggaggcccttcagtctccattcccaaggttgacttctatagtaacaaaacaggtcaaaatctcaggccagagaggtgccacacacactgagccccaatcacacctgatcacccagcatgcactgcttatgagactcaatttcaaacatccccacctttgatcaggcagctctatgacatagcagggcaccttgtctttttctacctgttaaatcttatcctgcttggttctgtattaggcaaacaggaggcaggtaatgcatgttcattcaattactattgccaaataaattatgccaccctggtttggggggagttttcagtaatgcaaccagttttctttccatgatagtaataaaatgcttttacatcacaatacagactttagcaatgcaggctgtctccctagctgtgaggcagcaagggtgcctcatttatttctgaagccgtggtatctagcatagtacctggaacacagaggtgcctaatcaatgctagctggagtcaatgatttaagatgacagtattaattattgtaaaatgaaatgataatcaatttcacaggttttatagctagcatccacggttcttacactctattctataagaaataaatacattcagagccttagaacctttttcttttaattgtagctcagagtaacctcatcagaatcatcttctgctgttggtagatctgtcttttatgacatactcgcaactgtgctaaaggtagtgttagcttaggtaaaatagtacctaacaacaatcacaagaaaagtggcctttggcttgcctgctctattttaaatggtaattcctctccactgaccatgtttcagtgtgagtacatacaattgcctcctctttaaccggtctggaaaataattttgaagcatcattatctctgccacctctggcccctgggtgggtgctgactcagttggagcacacagcttgtccctccacctccagtgcttcttgccccatggagctcagaagaagatacaggtacctgcccatggcaaatgcattcagttccccacaaacacagatccataggggaatcaggaaacaggataaaaggggagagtatattacctttctcattagctatgccccaattccttttagggctgggtacagcagtccacacctgcttccagaatgtgcctactaaactgaaggggttggtttctggatgggtcaccttgtgggaatattactgggtagggaacagtgatgaccagtggtgctccagaaaacatgcagagcatgtcaataagagagtggagagaatttagatgtggtggaatgagaatgacccatgtgttctgaggctcccgcctccctctatgaagggacatcctgccattttgagttgagcaggtgagagcaccctacttctgctgaatcacagaaaggatggagaaggatactccttgatggaggaggaggaaaggggattagggagagaagttggctcattccatgtaatagagtttagagagaaggtgggaggggagagtgaatatttcaagggctgctcaaatgaaggttgagtggatttggtgattatggggagagaaaacaggctaaataccaaatcctcattaaggtgtttcaacagatgagatttagcagaaaatggaattttgagttacgtgcatggtggcttctgaccctgctcctggaagacaacttttagaaacttgaccctgatggggtggagggtgacccagtgaatagccacagctgtgatgatatggtcaatgttgatgtttctattgataattttgtttccaaagagagttttggaaactttgtcttctatccttagaagttagattcatcaactattttcttataagagacttctctgacccaggagcttcaagaaataattaactttgaaaatgaacaatgcttgtttatttctactggggatattaattggaacccaaaataatgactaggacactgttggcctatgtatggcctttttctacctgttttttaaaaagttctggaagttttttaatgtagcaagatttggcctctaagcgaggattcctcagtggccatacacagactatttggtactgaagtcacaaacacaagcttttcaccttagctgtccttgaaggctctacagcccacaaagcttgtcaagtctaattttttttttaagtgacttgagatataaagaaaagtgtggcaaaaatctgttgggcttttagtaacccaagctcacccatgcaccagcctgtaacactcagggcttagtacttacattcacaagcaagactacttcgctggggacctatttttcagatgaaagtcaaaacagaaatcattgccttaggtaaccagctaagacattaatgctcacgtatcagaagcctgattgttcaaaattgtaccagttttccagtcatttttgagtggaagaaacctattaatgtaatcacattaagcagagaatgaaaatatttcaaattagtggcatttacacatacacttccttcttatttcaagaaaaggtattaaatacaataaactgaaggtagaatattctgatgcacagtctgtgtgactaaagaccaagccagattttgcttaactacaaaaccttctgctcctctctgctgtaataaaacaagctcccatctatttttaaggtaaactgtttgttaaagattcattaaaactaattccatcaacaattccaagagctattagagttaaatatttaaactaaattttaagggccaaaagggagtatttgcagtttaatgtacaaataaataccacctgacataccagttgctgtcattagtttgtttcagctctgttgcttctaatgaaatttaattaaattgatttggatacttaaaggtacagtacgtataagcataaggatcttgtgcaacaccatcttttaaaagcaaatactgtgtaaatctgttttaggaattcaatttactgctactgggctaattctaaagaaccagtgtaaccaagaagatttgaaaagttggaaaaaatgtatatgatttagtagaagaaagtataccattgttaaccgctaggagttaataggtaccaatggaatgcaaaaaaccaaaacaaacaaagaaacgaaaacacctgggaaattgaaataagaccatatcagtcctcttacctccctggctttgcttttgaggccttaaaacaaagatctgacttggatgagctttaacaatgtcctctgtgtttcaattagtactgcaaagttaagttcaggataaaactgaacagtccagtcttcagatttaggaatacaaatgtctagcttctaatatgtcatttgagcatttgaacagtcagctattttacatatacactcatcactggggaacaaattcgatgtttacgctgggtctcaacttcaagttctctatattccagtctccttcaaaatgcttctgacaggccgggcgcagtggctaatgcctggaatcccagcactttgagaggccgaggtgggtggatcacctgagatcgggagtttgagatcagcctcagcaacatggagaaaccctgtctctactaaaagtacaaaattagctgggcatggtggcacgtgcctataatctcagctacttgggaggctgaggcaggagaattgcttgaactgtttcgtttttgcagaggttgcagtaagctgagatcatgccattacactccagcctgggcaacaagagtgaaactccttctcacaaaaaaaaaaaaaaaaaaaagaaaaatgctaatgacaatgtgaatggaagcagagtcactgaacatgccctctgctaggcttacactctggggtagctacactggtgcttttattcaataaaaattagtaagtagctagcaccatgctgagcacagggcaagaaaagagagactggcatggttgttgaggggaagatgaaggagaaacaggtgttcagacatgatcacatcaatagccaggctgtaagagccatgaaggaaaagtacaggttattgggaaggactgctattagccttagagagctggggaaagtcaggaagtttttctggagggtgttatagttacactggggcagcaataaccaggattggaggcagagaaggggaggcattcctgggggaggaattgacctgtgcccaggcaatgccaaggctctgaggtggaaactgctttgtacctgcagaggaagagcaaggggaagcaagaacagcgtggctgaggcaaagcgatcgcaggcagggtggacggaagtcagcgcagggaggtgagcaggactttgtgagaaaatggaaggtactgaagagttttaatcaggagaatggccaggtcagatcgggatttttaaaagtatattctgaatgcttaatggaaaatagactgaagatggtaacgttgattccagaaaaccaattaggcagtaatattgtaccaggaccagggacagatgatgatggaagtaaggatgggagacatagttgggtatgggagatatttaggaaatatatcatcagggtttgtgaaaaatagagtggagataagaaagaaggaagtattagttggataactctcagatttctgaaaagaacaacaaggtgggttgggtgctatttactgagatgggcaaccacggaagaagaatagatttagggaatatactgagagctaagcactggatgtatggacagttacagctgatgagccatctaagtgcagatgtcatgtgggtagttgtatggatgggtttagtgttaaacagtgaagaccagatagagaaataaatgtggatacaaactagtcttcaaatgcatttaaaaaccatgggagcagggtgcagcaaaccaccatggcatctgtatacctatgtaacaaacctgcatgttctgcacatgtatcccagaactcaaagtataattaaaaaacaattgtcttaagatggtagtggtttgtgaagggatcttgcctatatgctgtgaagttctcatgagacaggttctattaaaaaaaacaacaacaaaaaaaccatgggagcagatgagatcatctacattagcaggtatagggtcccaaacaaggatgttgcagggaagaccaggaccagggtattggcaaaaaagactgagaaggggcgctttcccacatagagaaaaataagaatagtgacaaagcagccagggaggaggctgtttaacagagaaagatgtgtcagggcctccccagtccatgcccttttcttcctggatgcccatctagaccacatgtcccagcctctccttgtggcagcctttcacacccacgtgatggagatctagccaatggaggtgaggcagtgggcatgtgtgttgccaggtatagctgcggcccttacggcgtgccagagccacagatggaaggaggagtctgggtcccgagtgcccacatggagaagagctgacccatctacttgaacacctgtccaggatgactacaggagcaagaaaataaactttcgtgtagttggatcattagatgtttaggtctgcgtgttacagtggggagccctccctaagtcacacaggcaatgagactcgttggatgctccagttaggagccctttccgtggaggcatgaggactgactgctaggggttgatgagcacaacagaatgtaagaaaggcaccatgaatgaactccaaccttcctagaaacctcattgtgaaggctggaccatgggagagcagaaagtgagaaggcagaagatggagaaggatggggagaggacatttctcaaacatcgtaagatagaagcacgaagagcatatgtatctctaggggaagaatgaccagagggagaggatgaagaaacaggaggaggaaaatggacaatgtcaggagaaaacgacttaacaagaggcctggaccataaatagggaataaatatatatttctattttaaaatagaacccaataaaagtaagcacaaagtgaaacaatcaagaaaaaattgctaaaacgcatgccactgtgtaactggggaaaggtaacccaatgtggatgtatccacttcagaatttccagaacctagaagggagcagatgatccagcaggtactcagtaaatatgcattgaaggtacgaatgaatgtaagctactaggagtggccatttgctagtaggattgacaggactgctctaagaggaatcacatggtattaaggagaataagaaaatgggggtactatcgcatagactggcatagagaaaaacccaattgctgtatacttttattttatgctacataccttaccagcggccaatctgtcatctggttaaatggagcactggcggtgaggacggcatgaacagctctctcagagcagttcatgggaactgtgagttcactcagctttaacctcgggaactgctggcagcctgtcacgggcacgtggttatgacaggacacgtggcaacaacaagaaacatctgagacagttccacattctgtgacctcacttcttcccttggttgttgctaatgttcttatattgttccagctacaaaacggagtctgaaaacgtacagttctctttccatcgaactggctggcctccctgcatagggcaaaggagtcatggacttggggccgttttcaaggttgaagccaattggtaattactgtggaagtatttccaacgaaatgacagcactgtgggatctcccaagaatgtggcttttataaaaactgggcacagatactcaaaaggagcattggtgctgttgcacacatagcgtggatgtccacggaatgaacatctccgtagcctttcttcactttcgcaccgtgtaatgaaactcggcttttcagttaagcccctagacagggagatgtgggtggccacttgattaagaactggaagtatttacattcttgtctctaaaagaaaaaggcatgccctccctggctcttttccattccagttgtttggaatgtgggcaaactgatagccaatgtggataatacagatgagggcaacactccagaggtggtgagcatggagttaggaggagccaaacccctggctctggcaggcgttatatcagactttgatcattacactcaggcttttatgtgagagggagtgggagactgaataatactgcctcccccatagaagatgtcaccatcctaattcccagaaccggtgaatatgctaccttaaatggccaaaggaactttgcagatgtgatgaagttaaagaccttgaaagggagagatcattctgaatatcccagtaggcccaatgtcatctcaagggttgttccttataagagagatttggggggtcacagagcaggcagtacgacaacataagcaaagaaatttcaaagatgcggtactgctgcctctgatggtggagaaggaggccaccagccaaggaatgcaggcagcctttagaagctggaaaaggcaaggaaacagattctctagaaaacttgtagataattaaatactgatgataaggtagtatgccaggatgttaatgtaattttcttatcgtctctgttctggctaaggtcccaagcaaggcaaagaataatagatgcccccttgccccactttctcgaagtcttagaccttccactcggagttgcaaaaatggtggacaaaatagggttctgcagtattagcatatgactcaactccagattatataagattaggctgagggtggaagcggctggtggtgagaacttccttggaagtaatcaattggttggggattcctcagcctccctctccagaagcccagggagtggactatgtaaagaccttcaccatgagctccctgaagtttgggggtggcaggcctggtgtcttcagtggcattagcggggcaatacagagattcagtgccagaggtgaactgaccatggagccatgaactttcatgcccgcccatcgcatgggccccttccagggtctgtacctaattttatattcataaagtgtactcttcttcttaaataggacttccaaaatgacaaaagctacaggggcacaaaatttgtatcttccctggtctgtgtgtagtctgaggctgattgagaattctgaggcggatggctgtggaggtcaggcatccccagttgggaggtccttggttgcagggtggtacttctgagcaacccaccccactgccctcatgagagatggagctagccagcagacatctcccatgggcagagtgtaccagagccaggatataaccaagatggtcaggttctgctctcctctccttgagtctcctttcccacttagctcaacctcattgggaggcattgagacaggggaagccacagcttatgagaaggggagggagaagagatggagctgggaagagagaagaaactgatcacgctgtctctcaagcacaccgagttctcaaagatgtgatatcacccaatctactggatccaccagaaaacgagggagtaagtttgagttaattgccccaaagtaagtgagaagaatggatgtagacttacattaaacttactgagtttactagctcctgatctggtcctttgattctgccttttgtctctggggtatttttgtagggtttgattcaaaaatgttacgagcgaagccttgtgaaatggtggaattatagaggaagtgtttagtttgggtactgctatatgggatttcccctgacttggggatctatcccagcaacagctgtaacttagtgacttcttgtttagcaactgccatgtgcattgatttccacttttgcacaattgatttttgcttcttttcccatttgtgcctttgcttttggacagatatcatatgagtgtctgagagttgtctcagagaggtcaggagaccttgtgaagaaagaccttctttgtcaataccaaacatcaacaagtaaacgtccagatttatgaaggagacagtatggtagctgagtttaaccttagcctttttgttttctacccttacttgacatcaagtgatttagaaaagaaagaacttgaggagctacaattgcaaaccttgtggacactagccttgggttgttttaaaatctggctgaaagtccttatgttcttccaataatctgttgttgaagaattttccagcacagtaggaagattaataaattcccattaagcaatttccttgataaaatgacagctctacatttggtagtttatttctatagaggatttactgctttttcatccctatcttagatacccagaaagtagaatctattaattctcaaaatggcaacatattggaagacatattaaagcccttcagtattcctcacccttcatactgcaaagcttaaataaaattatgaattttgactatattgtgtttttcctcgacaatatttcaaagtatctttctaattctcactggaatctggtattgtttttcaaatgtccagcagatgagggtgatggagtaatgttaaacatgagaacatgacttcagtttgcagggccatggctactggctcatctatgtagagtggtcagtctcccacaagcaagctgcgaaagatgacaaaaggctgtattcactccttcatccactctgatttggacatgtgaggaaatctacaggcattcccttacccatctataattacttattgatttcttgttttgtgagtgcaatggccgcaagagccaatgaaatgaatccaagagcagtaaggaaagagagcctggtgtgagacaggccatgaagggcatgactccactcccatcaaagctcattcttcacttgctgtgcaacccaagagtctatcttctctgacaataaaaggaaggacattgaaagattagttttacgttttctttctctcatcacgaaggcaagagtgaatacagtgtctctattcagagaaatatgatcttactctgtttcaagcacaggcagtctggcattcttcaagacatgagctcactgtgcaagataacaacattgtgtgtggggtggagtggaggggggcacaaccataaaaacaccagaccactaatattaggagggataatgcatctggtttctaaccccattgcttgtcaacaagaggttgggtctgacgtctgatctacctgtgatttgatccatacgcttaggaactatggattttatttattttttatttttattttttgagacagggcctcactctgtcacccaggctggagtgcagtggtgtgatctctgctcaatgcagcctccacctcttgggttcaagcgattctcccacctctgcctcccgagtagctgggattacaggcggattgcactgccacacccggctaatttttgtatttttagtagagatggggttttaccatgttggccaggctggtgttgaactcctgacctcaagtgatccgcctatctcggcctcccaaagtgctgggattacaggcatgagccaccatgccccgcctgaactatggattttaattcattcggagagatactgagtggacgctgttctctctgaagcactttgagattcttagagcaaaatgagcttcaggaccataagctgaacattggaaaaatcatctaccactttaacaacagggactgccctgaccctttccatagtaactttacagggtctgtttgaatggcctggcttgtcttccaggcaagcagtccacggagaggcaagggcacggaagcatgcaggtagcatcccctccattctgatcaccagctttcagcacctagcactctctgttgtaaacatgggactctgtttcctataggaatatcgctagcaggcagagctgcatgggagaaaggagaaagaccgtgggaaagcagaaagacagtgggactagaggagacagagtagagagaccagggggagaggagctgtaaaaatgtaggcagaggtgactagtgatgatgatgatgatgatgataaaatgaaatcctcagatccaaaccttcagctgcctgtggacaggatggcagagacggcacttgccaatcaaacagcttggaaaagggttgttgaattaatggcagcaactcccatggatatattactttccattttacaaagcactgtgatgactgctgttccatttgagacatcagcaatccactgaggcaagtgttatggctttcccatcatggatgggaaaaccaagggagggggtgggattgagggagagatgcccacagacttcatgaaaggccatgaaggttctttaacacaaaggtcaaggaaagatacagacttggatacataaagtggaaggaaggcatcatggtgacccaggcttccaaacctccaaagatctgagggcttgtcccgctgcttccagagaacatgctgccaggtctaagaatagccagagaccattttaagaggtcgtttactttcctggtggctcttcatcaggaatggctgcttatcaggtacagataaccggctgccaagcaaccctagcgcatctgaaacctggtgaatcggagggctactcatggtgttccgcccctcagcagaggtggccagagggctgccggaagtcagttcttacactgatggacaaggggtctcaagtcacctgcccaaggtcatgctgctggtaagtggcagggctgtgctgtggacccctggccatgcactctttgtatttcaccaaattgtaggatgagcctttcagacaccaatgtgatctccagttttatgagtagaagttgagtgtccctcatcaggaaagcatagtctctgtctattctcctctgcttcaaacaagcttggaggaatacgttcattttggggtgctatattaccaaagggataccaacaaacttacatgcatttggcaaaaaaggatagcatggtgaaggctgtggaaaggctgacatattagaattcagcatgtgatgggattcatgctaaccccaaatatggcaccttggcatttgggaaaacaacagaggcagaaagatctctctcaccttcccctcacgcttcttcccttaagcaggtcataaaaccctcattcgagaggtgcctccttatactggagcaaaggaacagccttatctctgaactcacaggggcccacagaggaatccgtaagatctccttgtttatcaacattagatcatacccttttgtcctccaatcagacttctccatgggtgtccactctccatcaaacttaagcataaaaatacacaagtttacctgtttctttgggcctttatttccttacagaggttctcatataattaattggcatgcaattatctcatgtaattttctaattatatagataattttgtatgcttttctcttgttactataatttgtctttcattataggggcttcagccatgaacctagtgatgggtgagggaggatatttcttttcctcccctacacattttagacctagaaaagaaatgaccttgtagataaagatggctagcttcaaatccaggaaggctattgcagagaagacagattagacttttccagtacagcttttagaggacagaagttgcaaataatgagatttttgcttaatataagtaagaagttttggatgattacagttaccccaaaatgggataacatgcctcattaggttgtgattacagctgacattaaagccatttgggaagaaaatgactgctggaacggtactgcctttcttctcctgccacaaaccttttgcaggggttatgcagccccctgtccccatcctccctggcagggggctgtggcgatgggactgagctctcaccccggggtgtgagcccgagactggcaacttctgtgccacttgccctcccctctcccctctctcaccctatgggctggaatgagaagtgggcagagccagggtgctttgcttacacaggcaggaatgatgtttcttttgcaaggcagagcaatgtgacaggcatcaaggtcacctgctggccttgggccacctgcctgagcacgtacagctccatgagagggaaagggatccctgtgtagtctcagctcctatagttttgggtcccaaccaatgcaactacttcttggagatgttgtgcagattattaaggtatcatctaagaatttatacatgatgatttctataatcttttaattctatgacctccccctcacccatcttctttccttcaaaaccagccatcctgacagttccccaaccatagtcaaacataagcaccctattatttcagtcactccatttctttttaagtcccaaggttctaaaaagtcaagaactttccatctcctacttctcttgtaccccgacatccagtctcttcccatggcacatcgtcttttcctttagaaaatatcctctgcaatgacacaaaacatctaagttctatttgcggttatctaaacttaaagactggctttaaaagggtgatgcattctttagcctgcaagtgatcacattctcctacatctgttgatgttccattagggcaaaataacccagaaggccaagcttcacaaaagtcaaaggttccgatgatacaaatatgctttggttccaaatgcagcatgaatcaaacatagttttatattaatcaatacacccagctggaagaatattctgatttgaatcagaatgtgtctccctagataacataaagtaggtgagctaatgaaatgacattctggcctctgtacctgggttcgacaagaaaatgagcatgacagatggcgccgaattctgttccacggacatgtaactctcaatccaattcccatctctcccctcacactttcccttttatccataatgtccttatctcttacctcctaattatgcaaactccataaatgcctctccagatttggtctataagtttctttcccttaattcatgctttaaaatttgtagtatgtaattcagaactgaatgaagttgcccattatagtttcatatttcatctttacccctagtacctccttcccatatcttatgttttcctttggaacgcttcctttgctaagcctagaatagatgtttaataaatagattcgaagcatggataattaaaagatatggatcagacattttttcaatgatatgcaaattgtcagtgaagaacaaaatagaaatctatttccccactgattaaaaacaattcataaagatgaatgaatttggttttctcacaaaggagcttttcaaaaggaaagcttttttgaattttgagctttgctattagcagcacttatgacactgggcacaaagatcttcctttcatttcacaactgcataatttggtaattattaagaacagctctttctcgatatttttaaatcatgggtccactgaaaacatcaccattcatttgtccagtccatccttcttgaatctcttcaaatgaaacatattttaagcatcttcaactcttgagttttagctccattaaattcctgtcaacacattctttttttcatggaaatagacagacaattatgctttttgaactctactaacaacaatgaaaaacattaagatggaagactcatatgactattcaagaaagagcctggagagtgtctaaaagctgcttcccttcaatgcacagaagtatcagaaggtttatttcagcaaacaggaaacgttcaggatctaaaggaaagagggttttatttcaggcagtaatatttcattgagcttctggagccactgattcagaatggccagttcctttctaatttataccatgttcctcatttctggctgcctatttagctgaaggactctttcctgggcgagacttcatttgcctcctggaggaattcaagaaggaattaactaaggaggctgggataggaatttcaaacaaaatagaatggaagccaaaacattgtagataaaaggcttatgctaacccattatatgaaatgctttgggaaggacttaacagttgtcccttgagccatatgggtttaacactgtgggtccactaatatgcagatttttttcaaccaaatgcagataaaaaatacagtatttgcgagatgcaaaacccatgtataaggagggctgactaatttccatagggccttgaatattcacggattttgctatctgccgcagtcctggaaccaatcccctgtgtatactgagggatgactctcattgatctagaacttccacttaattttgcattctgtttcaacttaaacacacttcctcttagggaacaggaaaattttgaaagagaaatatataggctacactttataaaacttcaagtgcaaagtaatgaatagttaagggaagttagaaaggccttgggggaaatctagaaatagactctaacttagttgagacagctattaaatatttttttcccccattgcttagaaaaatacaaattttccctctggcaagatgggtctcattccctatgatgtgagccccttactgtggtcccacgtccctggccagtgagtggccggtgacctgggggatgggggctatagatggggatggaggcagcaatgatcttggctttcccactccctgcaagtggccagggggctgcaggtgggtgctgtgggcagttgctgatggaagcccaggcacccttctgtagtcctgtttgtgcttcctgaatccctgcatggaaaccaatgcctatgccattctccccgcttattggtgatgtcctctatcccctatatatttttttttttgagatggagtctcgctctgttgcccaggctacagtccagtagtgcgatctcagctcacctcaacctctgcctcccaggttcaagtgattctcctgcctcagcctcctgagtagctgggattacaggcgctgctaccacgccgagctttttatttttttttgaattattagtagagactgggtttcaccatgttggccaggctggtctcaaactcctgacctcaggtgatctgcctacctcagcctcccaacatgctgggattacaggtgtgagccactgcacatggccttctacccctatttgttaactcgaatttaaactcccatgcttgctggccttgtcacaataaaacaacaacttctgggaaatgttaaaaaaaaaaaattctcccctcctaaccaaaaaggaaaagttaggcaccccttattgagcagattttggaaatgaggccttgaataaaactttctagatgtgacttttttctcttaagggatttttgagccatgttgggggtgaagactctttggaggtatgcgatatgaattcctgcctgccttgtgagaggaacaaatgccgagcatcttggtgatccacgtttgtcactgggagcactgtctttttccttctggccagtaacactgtgaggttctcaggggcttagtgacgtgggccagacagttgagtctcctattcagtgttcctagtttgcagtggttcttgatttcctgaattacgtgctctgtttctctctttccatatataaagatatatatacatatatatatatatctttccatatatatatatatctttccatatatatatatatatatttccaaaattacttgttaacatttgttgatttttttttccccaaaatccctctgtcattacttgttagtctactgtagaatactgaagctcaggaaaatgagcttattttcttttctgtaagatgacttagggtaagaccctgtgagcacaggtctgtccagtccagaaagttcatggatcttaggagctactcaggggacacattgcctcttttctggcttcttcactgattctcgtttcagttgtgtttcaatgactgaggctgtgggaaagtgccctccacgtctgtgacgcctctcagggtcccgtgttgagtgtttggactcagggcccaggtgaagccagccttacctttttgtagagactcctcagatctcggtactgccacatgctgttgaggacctgagatgcagccttgaccacttttggagagtgtctgatgaagaaaagacaggaaaggcaagatgtgagtgggacagctgtgtcacatttctgtaattcttgtagtatttcaaacctcttcattattattatatctattatggtgatctatgatcagtgctccctgatattactactgtaattgttttggagcaccacgaactgcacccacctaagacagcaaccgtaatcaagaaatattgtgtgttccgactgctccacagactggcccttcctcctctctctcctcaggcctccctcttccataagacaaaacaatgtagaaattaggccaattaataaccctacaatggctcccaagtgttcaagtgaaagaaagggttgcacgcctcttactttaaatcaaaagcaagagatgattaagcttagcgaggaaggcacgccacaacccaagacgggccaaaagctgggcctcttgtgccaaacagtgagccaagttgtgaatgcaaaggaaaagttcttgaagaaaattaaaagtgctaccccagtgaacacacgaataataagaaagtaaaacaggcttattgctgatatggagaaagtttgagtggtttggataaaagatcatatcaaccacaacattcccttcagctaaaacccaatccacagcaaggccctgactctttttttttttttttttttttgagactgagtcttgctctgttgcctaggctggagtgcagtggcgagatcttggctcactgcaacctctgcctcgcgggttcaagcgattctccttcctcagcctcctgagtagctgggattacaggcgtgtgccaccatgcccagctattttgtatttttagtagagatggggtttcaccatgttggtcaggctggtctcgaactcctgacctcgtgatccacccgcctcagcctaccaaagtgctgggattacagacgtgatccaccgtgcccagccaactctcttaattatatgatggcttggtgaggtaaaaaagctacaggagaaaagtttaaagctagcagaagttgattaatgacttttaaggaaagaagatatttctacaacataaacaaaaatatttgtgtgatttgctttattgagatatttgctttattgcagtagtgtggaaccaaaactacaatatctctaaggtatgcctgtaattcctttgacttaaagacagagaattttagatcctttcatgaatccagatgaagctgcatttcattctcatataatcgatgctgaacaaagattaaatgtgatgttttgttgtattttatcatttagctaaatatttgttcatgacaatagccaagcaactctagaaaaacatatattaatattcaggtcgtgatagtgtagttgaaatacaattagtgtgcaaaaatgcttctgagtagaaacaaaagtgtagtttttgtttctatcttttgcatagttacaaaaccaaaagagactgtgaatgtgtaacgaacagcaggttttaacctctcaattaaaatgccaatacatcacagtgttatactaacatgtgaaggttaaagaaactttgctttctttttagactttaattttgatgcattcactagatggatgccatggaaatttctacctgaaaaactcttctaaatattgattgaagggcttggacaattgtgtgtttctaatgtgacaagtgattataacccaagccacaatacacagttctttactgacagtaacagttaagactgttaatagcttttccgtcttatgacaaaatatagtgacacattcaacactacttcccatataactgttaaaattggggaaaaaaaaccaaatgtattcttgagacagatgaacatgatagaatgtccataatgtatgtttaaaatgatgtgaaaagaataaataattaagatttcaaaatggcgagtataagactactataagagttaataacaattacacaattggagtttgatcttcactagagctgtcacatcaggggtggtgaggacttcagttggtgcagttcattgtggctgtcaacacagctgtgccagcggtgggatcacagaacactagcccccttggttgtgtccgccagacgctgtgagttgtgcagttctgatagactgtgattggcaactcgccaatctgactcattaacatcactgcacatttaagcttgtatatatatatatgtatatataaagaacatgtataaatacataaactagagcatcatagcaaggcacgtttcttccatctgtgttttcccatactatcacaaataaaaatcaggtttgaactgaacttatttctagaaataagtttttaaggaataatttagggtgggcaaattagcaatcattttataaataagctatggtgtatttgtatacctaccgttcccaattattaaattatcctcagttccaaaaatttgattttcaataaataaattctatttccttaaaatttgtctagaagtccatgggaatctccatacctactattataatagaattgagtcagaaatggtgagtttcatgctcaaatttggagcaattctcctgaattcattttgttttaagagcagtgaaaagcaataataaaactgaagtgtaggtaggagacgaggataaatgtagttataaaaaccttgttttgatctccaaattagtcagtatatatataaaaaaagagataagctacatgaaacagtgaatgagactgactaagcaggagaactgtaaccaggaagatgcttgattcaatccaatttaacacttcttattaaactcgtaaatccaggctgttggcattggaaaaagagataaaggaacaacaagacagaatgagcgcctattctataagtaaattttcagccaaattaaagggcatttatgagatcatctttagtgaaaaaaatcttcccattaacaataatcaagattggacctggcttatcaggaccttagcaacatggatctgtattattttatagatggtttcttcaagtgatttgtaatatcatttcatagatggtttcttcgagtgatttgtaaattagtttcaccaaataattttatttgaccataggactcaataaaacttttttttctctttaggcccatttagtgatgcttattgcagtaggaatgctcataaagttggagagaattaatatatgccaaaccactcctcaaagctctctaactgtataattcagagaaaatactttaatctttgaatgtctcatgaatatagacaagaatatatcagattgttttgcagactacggttttattgtgtgtgtgggtgtgtatgctcaagaaagcattaccatattaagatcttaatgctcaaaacaggtaagcacttcaattagagattccaaaggtctattgaagctaaataaagaagaaaaccatatggtttcctgcctacgtaggatagcactttattgtaagtacaatatcataagatatagctcaagccaacagtctccactgcgcaattattatatgagtccagtggggcttttctacttaatatgagaaaacattcaaatccaaatgcaaaattgttgattgagcctatttggaggtctctgggtgcttaaacagaaactccgaatcttctataatacattggtactatcctgaattaagtgaaataatgagacagaatttccagaaagtttcaaagtgcgtccctcaaagtgtttaataacaacaaactatttagcatttacatgtaaaagaatggggggtgggggtggcttggcagggaatgaaaagtcaagaaatagactcttgataacaaaatgtttacccttttaatcttatttaattacatcgagggacttccaagaggcaaaatttaattaaggttagtgaaggtttctgtaaaattgacaccttgctgatataccgatgcgctggcttgtgaagctattttccagctgtatatagtaagatactgttggttcttaaaaactaggaggcattcttattcaaggaggtgcagttgctttgacaccaagtctcatctctttttgttctatctgcacgaaggccctcctttctcaccactatctgcactgcctgggaaatttctactcattctttaagatttgattatcaactcttccagctagcatattgtgacagcctctcccttaggtttagattggaaagtataggcatagtgacttgttaaattaaatatttgccccacatctcacagcttgtaagggagggtactagatgagaactgagttctctgactccatcatgccctgtctcctcccccatccttcctgcatggtgacttgctatgacttggtggctactgtgatgttggtaaggtggacctgacttggttgcagagctgaagaggcacagagcagagggatgtagagacatcatcaacacacggacttcccaccacagaggaacaacaacaaaataccttcatgtatccaggttgaactcgtgtcgctgccatgtggaaggagcacatgggtgtgctggatcgtcaagtccattttaccaacagtaagagagaagactggaaaccatttgccattttccttctcttgattctcagagacaaatgctttccagtgacagtcatagtactacccgtcatcaggagttgaaaggcacattcagaaccaattttaccaggacagagatatggcgtcaccaggtaacttacttatctcctttgcttttggagatgccgaccaacttctcgatgccaccggcatcccgtaaggccttggcgttctccatgttcttggtaatcacttcgtgcagtgtgcagcagacagctgtcactgtgtcatccgacatggccttgcttgcagtgttgttgctgttgttccctcctggaagcctgtggactaggtctcgcatggcgtatttgcctggaaaagaaaataaagagaagagttgaaaggaggtcaaggtgaaggcagagatagtggcagaggtgggtatgggggagaagagaatacgagaggccacgtttatgcaaaattgtttgtttcccatcactgaatgttccctattgggtagttttacacacatctacagagaaaaacagtcattcctcatggcagtgcatccactctgctgctagattgacctgggatcaaatcactggccaagttatttcatgcctctgaagcctcagttttttcaatctctaaaggaagacaataatggtacctgccatacaaggttgctgtaaagcataaatgagtgaatgtatggaaatgaacaaggacacaggactccataggtattagctattattatgttcttgcttgatgtttatagaagtcaagaaaaatgtatgggaattctaacataaccctcaaaaataccttaatgaaagctatgttgcggcctgtattttttaaaaacagtcaaagcaaaaatgtgtggggaacatgatcacatatgtgagtactgagctttgattcatttaaagcaaggagaaacactgaaagcaggagagaggtacttgacaatctataactatgtgtcctctgaactatagtaacctgatgctgtttgtctctctgatgggattttattgtgtagttctaccaggtaacacttactaatttggtgtgtttttgtgtgaaaaatataatacaatccaattctgcttccttaattcactttaacattattaatcttactattcccaatgacaaaggtacttataatgacatatttatggagtacttttagtttacaaagcactttaggcattaccaatagccctgcaagacaattaatttatcccacctgcagcttccatttctgctcctttaattgacttctggaagtaagtaaatgagtgcctgtagcaaagctggctgttctcacatttttcagatggaattggcaagtgcctaaagttagatccctttcttgtctcccatcccccaattaggcacatttagctagctcctaaaggctgtttgaaatatttcacctccatgtacatatctataaataatagtcttcttctgctatttaattctctggtgtatggtgcctggcagcaggaagggaaccttgtgggagtaggcgatgatatcttaattccaggcagtgatacataaaacacaggcccttgtaattttggtatctgctcttatcctatgtttaggtggcttattttagcttagagagaaaatgctgatacttaaattactgaaatagaaaagtgtgttcattcacttgatgatagctgaggaagtgtctgacaaaaatggtttgcctgcaaacccccaaatgtagcatatttattttctaatgacagcacctaaaatagtttatctatttatcattaaatcagccttaactctggttaagagtttactttcgtagggctcagcatgctggagattctaccagttcattaacccccacaaaccattagaagacaaatttgagctccacagacatgaaatgatcaatgtgttcctttttcctttttcttataaggaaagtgatgaaggaagggcaaaataactgaaaaaatactccagtcattgtatatacggggacatttacacccttgactgtgtatggaggactggtttcatgaccttggacactgtcaaggttaaaaccaaaaatgaagagagggttaagaatttggctgtagcattttttagttttgttggtattatcattttgaaaattatgtcagataaatatgaagatgtagtctcatcctccatggctttccaatccttgagtcctgattaagatgcgggtctccctgtaatgttagtttatttatagataataagtagatggcagggtacccaacccctgcagagcagcctcttccactcaccccaatgtgccattcaagtactatcattttccatgtgccccatggtatggaaaagaccaggagtcactgttatatttaacttaccccaactttactgtcgaggaaactcattggatttatcttatttctagtatttccaatataggttactgacattttactaggcaattggagatttttcattaagtctatttatcagtctactatttatcagtctatctggaggaatatattttagtccaaatttttgaccatccaagtaaagaaacaaatcaggtaatattattccacggagaagaaaacctcggggcagtttgttaattattttaaaagtttacaattcttttttagcctttgattatgtgttgaaaaatgctgtctttttacagtgaaatttaaatcctatcttcacaagaaatttgggtagcaaaaaaagatttttagctctttctagtgtttagaaactttgaagctgattagggaaataataaaatgtgggacatagaataattacagatgcaagtgaccttgtgttgtatgtttataacagtagttcagggaagagacaagttagataggactggagttattatggaaggcttgattcaggaggtgtacatttaggattttttcttgtatgtcaagggggcaacaagaacaacttgatattttacaaaaagaattctggtgcattaagaaggaaggtttcagaatagtaaaactgagggtggaagaaacatagtctttttcttgacaataatgttctcttcttctagacttctagtgaaattataagcactacaactcaaggtagtgtgcttctataactgttccatatcctgtattttctttttaacctaagtttctaaacacttgaaagagctaaaaagctattcttgctgcccagtaggaggaatcttgattcctctccttctactgtttcaggcagacttttgggtctttgaggtctgagatttcttcagagggtaaaagaagttaattccctttttttgtatcacattggcaacaggaaactgcaaagtgggtggttcaaactttttttatagtttcacaccatcaaggtggtcaaattgtttccttttctttttagagagagaaatggatggaggtagggttcttttaggactggggaagaaagaggctggatcaccaggtggaggttgtgggcagttcttcacagtcccagggacagaaagggcacctagagcccagctgtggtcctgtggtgcactgagattctctgtggatgcagagcataagcttcctcctgtgtttgagcctggcatggggcagaagaagtgcctgtcttggaatgacctgcttaggccctcaaaaggagcaggcaccagtaaccactgcaaatagatgactgctccagctgactactccaccttcttcttctttttttttttttttttttttaagacagtctcactctgttgtccaggctggagtgcagtggtatgatctcatctcaatgcaacctccatctcctgggttcaagcgattcttctgcctcagcctcccgagtagctgggactacaggcacatgccaccacacctggctaccttttgaattttagtatagatggggtttcaccatgttagccaggctggtctcaaactcctgacctcaagtgatctgcctgcctctgcctcccaaagtgctgggattacaggtgtaagccaccatgcacagctgactctaccttctagatttaatttgattaaaagatatgacacagactgaaaataatagagtgattcattcatttggcaggaaactataatatttcaggaacaaacaagaacctgtgactacaaaaaggtggtcatgggaggatcaaggacatgagagcagccattatggaaattcttaagaagcaactgacagggcttggagcccagggaaatgttgaggtaatgcagggaaacaggattcagagatttcacgcgggaataacacagagggtagtaaaaaccaagtgaattttaaagcttaatattaatggataaattgaatgttatttttccacacaaagaaaaacatgcaaaattagttatattacttatatgagagaatcacgtaccaaaatcccgtcagagagacaagcaggtcatcaggttcaaagaatacctggatttatgaaagcaaagtggataccttgccttgcttctattttgaataaatgtgctaccaacgatccactatcatggactcacatctgaaaaagggaaatcatggtgctcgcttcggcagcacatatactaaaattggaatgatacagagaaagattagcatggcccctgtgcaaagataatacataaatttgtgaggcgttccatcttttgtttttttaaaaagaaaagcttgttctttgtcagatcaaaacaatacaaaacaagactgtaccaccaccactaccacaaacaaagtcactctttcttgctacagttcccaatagaaatgaatccttgggccatttcttttaagttacttagtctctagtaacaatgactatatgtctgatttttgcaatactggtaagagactaccattggtgataacataattgtgcagaaaaaggactgtattttcatcaatgatggactaactgaaaccttgtaactttgctaccctttccactgtgtgtatgtgtgtgtgtgtgtgtttccttcaaatacctgtattttgtatttggtgaaccagttttctaaatccagattttcttgaaaaactgcaagtaaagattattttctctttacagtgcttcattctcgaactcttctgttaagcattgttgggcacaccaaggtaccccaagggactcactcaggagacctaacaaaccatgttgcccaagaaaggcactccttgcagaccgcttgtgcagaaaggagctggtggggatttcatgatgaggtaacagccttgctctcgttgactgcttcggtttccatgttgtgtttgtgactttctgtttctatttctgaactaagcctgtatttgttactgatgtgcatactaccatttggttttcgcattggtggcaggaatgttgagtggtggtcttatggtctaaagacctgcattctctaaggcagcagacaacagggaagtcacttgagttccttcctacacttactatagatctcttctgatcactgatggagtcctatgtgtagatggtctttgttgtgcaccattataaacttaaatgtctcaaactgattagagaaaatatatttttccagaaggtcagctggactggagagcaaccccggatgagaaacatcacaactcctttgtcttcgaggtttaagtagttctatggccctcctgtttctgcagctgctaaaactgatctgtgggtttttgctgaggtgctctgagtttattttttctaaaaaacttctttattgcagtaaaatacttataaaatttaccattttatccattttaagtatatagttcattgatattatgtagactcatatcattctacaatcatatatctccaaaactcttttcatcttgcaaaattgaaactttaaaagcatttaaacaactccccaacccttcccttcagtccctggaaacccccattctactttctgtctctttgaatttgacaaccaggtacctcatataaatggcatcataaaggatttgtctttttgtgattggattatttcacttagcataatgttcttaaggttcatccatgttgtagcatatgtcagaatgtacactctttttttctttttttccaagcagggtctcattctgtcatccagggtgtagtgcactggtgcaatttcagctgactgcaacctctgcctcctgggttcaagcaattctcattcctcagcctcctgagtagctgagattacaggtatgtgacaccccacccagctaattttttgtatgtttagtagatacagggtgtcactatgttggccaggctggtttgaactcctggcctcaagtgatctgcccaccttggccttccaaagtgctggcagtacaggcgtgagccactgcacccagacagaactttcttttcaagactgaataatattccattgcatgtatatatcatattttgctattcttctgttgacgaaaaattgggttgatacttcattttcactcttgagaataatggtgtgaacacggatgtacaaatatccttttactttcaatctatttctgtctttgaatctaaagtaagttttttgtaggcaacatataattgcatcatatttttttaatgcactctgtcaatctctgtctttgattggagagtttatccatgtatatttaaagtaattactcataaaaagggtcttatttctagcgtttttctgttttctatatgccttgtagcttttttgtttgtccctaatttcctgcaccactatctcctttgtgttgattgttttctgtagtgaaatgttttaatttccttattttctttcgtctatatagtttaatgattttctttgtggttaccacagggattacatttaacattataccattataatttgaatttataccaggttaacttcaataacatacaaacactttgttcatttacagttccatctcacacttttcagttattgatgtcacacaattacatctttaaacattgtgtgtccaaaaacataaataattggtttttaaaaacgaattatgtagaaaatttctctttaattatgtagaaaaaaatgtggagttaggaaacaaagtcacaataatgctagcctttaaactagtaattgctttttcttaaatgtactgaattatgtagaaaacaaaagtagcattataaaccattgttaaaacaatatgagctttataattgcccatgtatttatctctactaagatctttatttcttcttatacctttgaattactgtttagtgttcttgcatttcaacatgcaggactccctttaggatttcttacagagcaggtctagtggtagtgaactctcttagtttctgtttatcagggaatgtcttaagttttccctcacttctgctggacataggattcttggctgacagttttttttttctttcggcaccatgactatatcaacctactacctctggtcttcaaaattttgattaaaaaatcagctgataaccttattttggatttcttgtgtgtgatgagtcacttctctctgctttcaagattctttatctatgtctttcaacaatttgattgtaatgtgtttcagtctaggtatctttgagcttatcctatttgaatctcattgagtcttgaatgtttatatttatgccttttgttaaatttggtaagttttcagccattatttcctctaataatctctctatccctttcccactttttttctcctgagtcttttgtagtgtgtatttgatcttcttgatgatgtccacagaacccttaagctctgctccttttcttcgatcttttttctttctgttctccaaagtcagtaatttaaattttcctgtctttcaactttgctgattctttcttctgcctgctcaaatctgccttttcatttctttagtgaatttttcatttcaattattgtacttttcagctctaaattttttggtttgtttttaggttttctatgcctttatttatgtttccattttgttcacacatcatgttcttgactctcttcatatcttcctttaattctttgaacatctttaaaacagttgttttaaagtctttgtctagtagatctacctttgtgccatttttcagctatggtttctgtttttttttttttttttttttagtttgtttgttgtttttccttgaactggtcatacttccctgtttcattgtatgccttgtggttttttattgttgttgaaactgaaaatttgaatgtaataatgggttatctggaaatcagattcttcctcttttccagggtttgtaattttttgtttttgttttgtttttgactgttttaggctgtctctgtgttgagaattagccttaagatcttcacagatgttttctgagcatgagagtttccctgggcatgcatactggctctcttatttctcttgtatatgcagttgcttttgaatatgctagtctttaatgactggctcccaaaaagggaaaagaaaaacataaagtggatgaggagggtgacggtgtcagctctttaaatcctctgaaaataacttcagccaaagatagaggggcttgcaatcatggtatgggtatgtgcaacaatggctgcttgcctctgtgtttgtgtcactgtagtgagaagcagcaatcagcagaaagaacagatccacgatatttagaggacggggtcttttgtgtcaaccctggtttctgccagctgcaagtaagctgctctaggaacatgtgcacagctgcctgctacagggctgaggggtgggggatgggtagctactgtgagctaagctgagattgaccaaatatactgtactttactgtccaagccttctgaaatttttaagtcttcaatagactccagagtttcaaaatagttatatcagtgtgatggttaatattaggtgtcagcttaattggattgaaggatgcctcggtgggctggtaaagtagtgtttctggtgtgtctgtgagggtgttgccaggggagattaacatttgagtcagtggattgggagagacagacccaccctcaaggtgggtgggcaccatccagtcggctgccagcatggctagaacaaaagcaggtggaaaaaggtgtgataagatggcttgctgaaccttctggctttcacctttctcccatgctggatgcttcttgcccttgaacgtcagactccagttctttggcatctggactcttggacttacaccactggtttgacaggggcttttgggccttcggccacagactgaaggctgcactgttgtccttccctacttttgagacttttggtgtcagactgagccactgatggcttctttcttcatcatcttgcagatggcctatcatggggcttcaccttgtgatcatgtaagccaattctccttaataaacttcctttcatatatacatatatcctattagttctgtccctctggagaatcctgactaatagacagattctgccaatgtgattgtgtccaggtggtgagacaaattcctggtgcttcctacttctccatcagcctagaatcctctcccgtctctgaatttacttttcatcaataattgatgatataaaagtgaggagctgatttccatgtgattggatgtctgtaagttagtgtgaaaaggattaaagggtttttttccttttgtatataaaaggttgtttgatgtttacaatgctggaatgttttgtctctcatttctcttttgggaagtatttggagcttaatttatagaaatctgtcatttgcacactataaatatatctaatttaaacacagtctatcatcaaaggggaaaaatatatgcaaaaaatatatattttaaaactggttagtgtggcttacagaccaaattggtgaagcattcaaaatggtattgcttagttactgaaaatgtctgaatgcttgttaatgtgggaaaagtctcttctggattgtccggagatctctgacctctggaaacatctggaaggttctgagtgcttatttttttttcccctaaaacaaaatacatggaatactacttagcaatcaaaaggaacactatgtgctacaacgtgaaaagatttgaatggtattatgctaagtgaaaaaagccagtctcaaaaggttctatattgtaagataccacttatataacattcttgaaataacaaaattatagagatggagaacaaattaatgattgctaggagtttaggatacttaggaagactgtgactatgacaagatggtacaacaaatatcattgggttgagggaataattctgtattttgatagccttgatggttacacaaatccacacatgtgatgacactgtacacatatactgcaatgttaatttcctgatttattgtgttatagttacataagatatagccattgctggaaactggctgagggatgcataggacccctccttactatctttgcaatttcctgtgaatccataatttttttaaagttaaaaattagaaaagtcacacagaaatatagaaatatgccaataaacatgtgctgacaaaaaggtgttaataaatcttaaaatgtatcccctggttcaatccacaatggacttgacaaggattacaaaaaaatagcacatatgagataagaagacatccagtcagaagttcctgaatcctccagcttacccaagagtttgctggggattcttctgttgtatgtgtataaacattttctgtgtctagaaattggtataacttttctattctctggatgagactgataaatggagctcccaatttgattggcttatgtaaacaagtaagtccttgtatatgtaattacaacaagaaaactaaaaaattgccaatgaaaatactctcagaatgctttaagttgctggtcctttaagaaaaaaaataaaaatctggccaggcttggtggctcatgcctataatcccagcactttgggaggccaaggtgggcgaatcatgaggtcaggagttcgagaccagcttggccaacatggtgaaaccctgtctctactaaaaataaaaaaaattagctgggtgcagtggcgggagcctgtaatcccagttactcgggaggttgaggcaggagaatcgcttgaacctgggaggcagaggttgcagtgagctgagatcatgccactgtactccagcccaggcaacagagtacgactgtctcaacaacaacagcaacaacaacaacaacatctttcacaaaagcttatttcaaggaaaaacacaaagaaatttcacaatgaattaaattaacagccttggtagctaggttaaaaaatttaaagcaaagaaataaaagttgataccaggttagcaaagacaaggtaaaaaatagtactaagacacttcaggacctttaaggatatttgaagaggtttcaatatttagtatctaaggtaaaaagagttgatgcagtattttcaggtaaaggaaatccttgcaaaatcagactgatttgataatattaggggaaaaacagagatgtctttcccctggttttatcatttcataaatcttttgttagcatgatctgttttataaaagattaggtttgtttcctcaatttttaataatacgaatttttaagatttccaattctaggtttattaaacagataagctaatattattatttaaacatttaaaaaggttaacgagtgttcagctagattgaattgtaataactgctgtttcatgaaggagtcgctcttcttcaccttagggaattccacaacaatctgttactgagttactccaccaaattcctctgagtaaaattcttagtgtcctctttttgaaaaaacactgtccactaaacacataggcacacacatatatgcgcttcaaatatctgcaaatgtacaaatgtcctggacttgttcatgttgctaattcatgaaatacaaaaacaatatatcagactgttggaggaaggacattgtgaggagtcacaggcagctttctggaatctcagctgatctcaagtgcacacaggcaactgtctcctagccttctctatgtctgtgaggaaacaactcagttacatggtttcaaagttataactcatgaaaagtagatgctgcatgtgttagttttcttcttttttttttaatgtgatctttgtcattttttattgtgtttattgggatcttgttttttttgttaagctaactactagtggtctgttgatcttttttttgcctcttttttaaatttattattattatactttaagttttagggtacatgtgcacagtgtgcaggttagttacatatgtatacatgtgccatgctggtgcgctgcacccactaactcgtcatctagcattaggtatatctcccaatgctatccctcccccctccccccaccccacagcagtccccagagtgtgatgttccccttcctgtgtccatgtgttctcattgttcaattcccacctatgagtgagaatatgcggtgtttggttttctaatgctgctgtaacaaatcaccacaggttcagtgctttaaaactagatacatttattatttcacagttctgcaggttagaagtacaacactggtcttactaggcttcaattagggtgtgggtagattacggtgtgggaaggactgcattctgggagctctaggagagaatcattttcttgccttttccagttcctagaggccacctgatttccttggcatgtaaccctctgtttctacctttaaaactagcaacaatgggcctttcttgtgtcacatcgctctgaccctttcatttgcctccagctgctcccttttccacttttaaggacctttgtgattacattgggcccactgggataatccagggtcttcttcctatctcaaggttagctgattataaaccttaattccccttggccacgtaaggtggcacagccacaggtctgggggaataggctctggacatctttgggaggacattattctgcctactacactgtactaggtacaatagttgtaaaataatatgaatgtgtctgtaagataatggaatgcatttttgtttatcgaggaagaaagtgtgtctaaggttaaaaaatctggctgtgtgttaatatgtaaaattaagacatatttgaggatgtgcaataagttatggaaaggttgagaagaagtgaaccttatttgtcttggtttataatgcctggaaataatgaacttgaaaaaaaaaaacaatgaaaggtgtcacagtcttttataaagtttgtgtaattttgatgagtttacttacaagatagagaaaaggcctgtgaactttctactgcaaatgttacatgagtagggtacaaaaataatgaagttagtgttgggttttctctctgattatatttgagtatatactctgttttcagtaagaaattgtgaagaatagtctgtgcccaaagaacaagagcttcttttgtcactaaaatcctcctacttgatatcgtgttaattttttttttgcgcttttgttactctcgagtcacttttagcaaaatttcctcacttgtggaaatgctagagttcaatcttttaaattaatatttagcaaaagatccttgcttatgaaaatgctagagttcctaataacttctttaaccgttttattataaatattatcattctgagccaagctgaagttacgtcttgtcttcagccactccagatttacactcatatcttgcatcccagataactctttttgaaattgccttccacaaatctgcacccccacagtcaaactaatacaactttttttttttggacagagtttcactcttgttacccaggctggagtgcaatggcacgatcttggctcgctgcaacctctgcctcctgcgttcaaacaattctcctgcctcatcctcccaagtagctgggattacaggtgcccaccaccaagcctggctaattttttgtattttttggtagaaatgggatttcaccacgttggccacacacctcggcctcccaaagtgctgggactacaggcatgagccactgcgcctggcctcaaactaatacaacttttagaagtatcttctacatctaaaccatctttgcggtttctcagaaaacttccggtgacactaaagatttttcttcttcactttatgagaaaagggatcctagaaataattggctatgttcagcatttcgtagatttttatttggtttaatactatgttgagagctgtcctgttcatcaagaatccaatacaaaaagacctgccaagacatgaaaaaatgaaaagctcaaccaccacttaattatgatgagtaaaatatgagcattatgattatgcttcagcagtgatgaccttttcattgtggagagaggcacactctccttcatgttaaagaatggcacaataatggtcaacaattttttaaaagaagatcccatttccacatttaaaatagccttttcagttggtggtaatccaaacacacattggatggaataaattaaaaggccatggagattgttctgtgccctcaccactctcatggccgtcactgactaattatttatgaaactaaactggcctcaatttggatattagtggttataatgagtaaacaaccagacctattcagccttagcaccaacaggtggtttctgattttttgtcacacgatcctaaatacccctgccaaaaccatgcgtcagtattgatggctgctggaagaaacatcacaacagctcgattaaaggactctaacaagttctttcgacacttcatagaatagaaaattggatcttagttacacgcatccctatatcagctgatatcaccaccacatatgaagactaccaagggactgagtcaggagttccagaacttgtttgcactggaggcagaaaactttgagaaagtggagtgcctactaatccaagatcaacaaaacaaggattaattacctcaacaaaatgatacaaatttcgctgtgattactgttctgatttgaatcgggcatgttatagaagccttctgtctatttcctctgtctccagtgcttgatctaacaggttatgcttataaagactagaataaaacattccttaaatggtatcttctaattaatccttcaaaactcatttttaaaatcctttaaaaattttaaaacagatgatgataataaattatcaggaaaagctaataactataatagtcctgcaaatatcatgacatatattgattggtctgaaactatacaacaactgaaagcaatagttacattattatttaactattattattactaatctgggtgtttttctttagccataggccttcatatttacctagaatctgtcctccttcctaccagaatgtaattgagtaaatcaaatctgtgataatgaccatgccagagatgttacatttaaagggaaatataatgtaattagacatgacaagctcatttaaaatgagtgcatttcatatgtggggttaatgcctacaccatcctcccaggacactggcttggttcatgttgtgtagcttagggcaggggtccccaagccctgggccatggaacaatactggtccatggcctgttaggaaccaggccacacagcaggaggtgagcagcaggtgagcgagaattacagcctgagcttcgccttctgtcagatcagtggtgtcattagattcttacaggagtgtgagccctattgtgaacaatgcatgtgaaggagctaggttgcacacgccttatgagaatctaattaatgccagatgatctgaggtggacactttcatcctgaaaccatcttccccaccgacctcagtccatggaaaaatggtcttccatgaaactggtccctgctgccacaaaggttggggaacgttggcttagggaatcccaactctacaggcagtatggccaggagcactgaaaacttggagctcagagagatggaataatctttgagacctaggtagtggatgtgaaacctggaagaggtgaactttgaatctgaaagttctggattactgatttcagcaatccagaatcaaatatttctgccacagatataaaagtgaccacaaaacaaaagttaaccctcaagatttaacatcatatagctctcatttttataaccatgctaaggggtctttgtgaatgaatcaacactgcttgctatacctatgtctatacagctggttcaataagacaacatatcaaattaatgatcacaaataggaaaactgctaaccaaacacctgtggttaaatctattttaggggcagaacgtcagcattataactgtaaaggcaaaccagtacccagctctgcacctgtcatggcagcgtgcacatcatgtgcttgtcacagtcctcattcagggaaacaggacaaagccaagctcagggaaacaatcccaaagcaagcaagcaagcaagcaagcaaacaaacaaacaaaacacacaatcgcctttctactgtagtcccaaataatgaatctttgacccatttcctaacagttgcagactccccaatcaacatcatctctgacattggcaataccaatctgtgacaatgtgattaccttgtgagaaaactgctgtttgcccagcatgacctgactaaatgtaaccttacaaaccaaggtaattttgtacttagttttaaatgtagacggctggtcttaattctggctcccctgcaacaatccataagaaaacccctttctcatcttgatgctttttctttctgtcttcctttcacacagtggacgatggctgtggcaacaccaaccctctggattgatcataccagtccccttttcccagaaagggacctgttcatctccacatctgcccctttgctcttgctagattcaaataaatatttcaagagatgccttgatttttttaaaaaatgaatcttcttttataatctgcctgttgttttaattgattagagatttattcaaatagaaaaagagagagagaaggaatattaagaagagaccagctggagccaggggatcaaatagttgcaatgggcagaggataagacaaattctagaaggtacactaaagttccttatgtttttttctaataaccattattttaaaaaacaagtacaggccaggcacagtagctcacacctgtaatcccagcactttgggaggccgaggctggtagattgcatgaggtcaggagttcgagaccagcttggccaacatgacgaaaccccatctctactaaaaatgcaaaaattagccaggcatggtgacacgtgcctgtagtcccagctacttgggaggctgaggcagaagaatcagttggacctgggaggcagaggttgcaatgagctgagatcacaccactgcactccagcctgggttaacagagtgaactctgtctcaaaaaagcaaacaaacaaaaaaaactccgaaaaaattagctgggcatggtggcgggtgcctgtaatcccagctactcaggaggctgaggcaggagaattgtttgaacccgggaggtggaggttgcagtgagctgagatcacgccattgcactctagcctgggtgacagggtaagactcagtctcaaaaaaacaaaaacaaaaacaaaaagcacagacctgtagcacatataagatcctatttcacatgcccgaattggtaagcagttagtctgagaaaatgattcaaagagtaactcaatcctctgaaaagaaataacattgaatgaggcagaatcttacaggtttatggcatacggtatgcatttctttcaagagttgttatactcaaataaataacctattccatctgtttggaagacaaaaggaattgtatgtttcagcaccttgtctcatccaggggaattcactgaattagattctgagaaattctcacactgttgaagtgtgaagaactaagaaaatgagtagaactgtgggcaagaaggtggctgagatatgcatatttaactagtataagaatggttctaaaaataaaaatggcagttaattaacaagagatttgctgaagttcctttttgaactagaaataaattgatttttgagaaatactgaaaatgaggcaagcaactaatatgatacattttaacaggatttaaataatttgattaactattaagcatgataaccataaaaataattatctcaattcattgactaattttagcagaaaggaatgatgaaaatttaaacttactgattctagcttcaggagagaaacctatgaagggtgttttatttttaggtcaagattgctatctagcaaagacccaagaactctcctaagatgaaaatttcagaagacaattgtctgtctgagacagatgagatcagtgtttctctgaagaaaagtttgttttcaggaatagagtctgaaattagtcctccaacctgagcgacattggaatagcagtaattcattgattactgcaatggcttaatgattaattatataatcacattccctcattcttgcttttccaaattgatttacacctctgccaaaataaaaatcagacccaattaaggatatggagagagggaatcatctgttggttttcttcatatgctgttactcatagatgacattatgtagtgttctaacttttttaagaacattcatattcattatttccatttgtgtcttacattaccctagggatataaaaatggcaggtataatttccaatttatctagaagacaaatagaagttaaatggtatgggaaaggtcacagagctgtctcctgagctttggtgaccataagtctcttaggcagaagctcttttctccagcctaaccctcctgactccttcctctgagctcttttcacagggatagactgcctttaccacctgtgtgacaccttccctgtcatgcatttattcagccagtcattccaaaaacattcattgaagttgcatctagtttgctgatgtatataatttatccttctatcatataaactgaggataggatgatagctaacaaacctatgtctactgataataaacaaattgcatgaggcttttgaccacacaaggtaagaaggtacaacagcactttgatcactgaaaattgcattcatatttatcctgttgcagttgttatttacttctatgcaggtctggggaatactagttttaaaaggtgctatgttataaatagggtttcactgcaacataaatgcaggaaatactgtacttgatactcatctcagagatttataatgtattagcaaatttactttgaattagcaaagtaaaggctctgagcagaccaacagacacaatgaagccaactgttcaactttgtttaagcacaggttttgccaaacttatcagaatagagaaacttatgagaatagagaaacttatcagaatagagaaagcagtcttgggcatggcatccattccatttccagagaagtgggggtctgaggactcagtctggggccctgctgctactgttcttgttcctttgattaagttttcatgtcaccaagtgcacacagatctttacaccacagaagctgtaatttcacaacttaaattaatgttgatgaaaactagaactaaaagaaaaactcttactatgaaaaagggatggtcagagaagacgtatgttagtctgtttttagtgttggctgataggagcagctcaccccaatacactttattcctaaatgcatctgtcttgttcttatgttatacacgcacaccttgttcacagaggacttcgtaaactagagagatatgtggcattaaagaaggatatgtaattatttgcttaaaatttcatcttccttattaaccaatgagatgtttatggatgaattccaagatggttctcaaacagaggaagttcactgtacgaaactcatgtaattttgttgcccaagtcaatttttgtcctgggacttaccagccaagccaagtgctggtttccacatggcaattctacttctaatgtaaattatagaattgagctttggataccgggaagtctttggtggctttaggtcactggttcaccagggtctgatttggcttataaaaaacctgtacatctaggatttcctccagagctgaaatagacccaagaaggcagcaagcctggtgtggcttggggtggttggaccatcacttcatctcttttcctaacacatataatggggccctaatttcatgccaggtgcctgaacttttccagatcttacaaaagccttgtcccccttatgtttaggaggtaatcttctttcttagatgcaagatagtttagatggttcttaccaacaaaagagatagtatcctttctcaaaaaatacttccaatcacttgtcttcacttcgagattggtctttaatagtgttagcttataaaattttttatatctaggtcagagcttatttttttttttttaggataaaggaattgggcctcttttgtatttttatagtacacagaatttctatttcaagagaaataacatgagaacccaaagatacttaaatgtattttagtaaaattggtttgtgctttagatatttctccaagtgtcctagctagtgaaaacactattcctatgaactgtaagaatgtctcaggctatataatattgactgtatgtttgttagttaaccacagtagacatttttaatgaaactgttagcattattattactctacccaggattccagcattcatattgtaggcttatgtcgtatgcataaaacatacaggatttacatgtgatgagtttaaaactttggtagttgtatttgcgctatactaaaaaaaatcagtaactgtatgttgtaattgtatgaactgttcacaagtagataggtagaaaaaacataaggtatgatgaaatgaataaaaagagaccaagtagatataaaaacagaagcaaaaaatgagcttagaagaccaaaaatggaccaaagtttattttaactaatttcactcaattaaaatgacttattgttatatctgagccaagtgatgacccactttttacaagcaatattaatatggtaaaatttcaggaaaagaaaagaagctgcagtgctgtggcaatttctttattgagatgggatttcacttgtagcaaaggagaaagatttgatgagtaaaagagattgcatggaagattaaaaaagcaggaaaatactagacacagagcttctgtaaatcacttggctcaaacctcaggaaagtgttcagtgtttgagttttctcttctgaaattgcaatttttggaaaagtttaagtatctatttgtctccctcactagggagcccaggcaggggatagaggctgtcattcacacttggctgagagtaactggcccacaggcacaggccctgcatcttccagcaggttgtacagcggggtagcagcctctgcccggcaggactctgatggtcctgcctgtctgctctcattctgcaatgaggtaccgtgacaggaggtcctttcccttggtaagaatgacttcctagcagtgtcaccttctgaaatgcagacaccaaacatgccctgcacactgccctgccactctgtcaagcccgtttggcatgatctgacagacgacagggaggtgagtgatcatctgctaggattgcaggagcctacacattggtagacaagtagcttaactattattacacagtgactatggtcagcctcatcaaaccaaaccaaaccatgcaaatccatacatccatccagcaaaaatagaggtcttcatattatagaacgatattttctatgtacatttcataatccgatataagcagtccctcctaccctattttcaaagtgagtagaaacaacacatgcttgcaaaaaaaaaaaatacatatatatatatatatataaatgggttgttggcttctttttaagtctgaagattcagtgatgtttgtttggttttacaaaattccattagttaaacagagcttatgcagcatctgttttccttccagtgtcacattgctaaggtcaagttcaggtgagcatgtgcctgaatacagatccaggagcagagtggtggacagggacagggaaagatggtggtgctcaaaggaaactgtcactggagactacagcacaggatcagctggtggttctgctattcctcatgtgagtcaggccagagcagagctggagaaaaatgtaggacttcaggggtttcagggtagtgcccccttgggccaccactggggaccctgagggcccctgaaaatggtacttctttcttttcctttccattagtttcctgtgactgcttcagtggattattacaaacagggtgacataaaaaatcagaaatgtatccctcacagttctggaagtcacaagtctgaaatcaaggtatcagcagacagggccatgctcccgcctaaggctctaggggaggcctggcatttattctggtggctcctgacatttactggattggggctgtgtcttagtccatttgtactgctataaaagaatacctgagactgggtaattcgtaaagaaaataagtttatttggatcatggttctgcaggctgtacataaagcatggtgccagcatctgcttttggtaagggcttcagaaagcttccacccacagcagaaggtgaagggaagccagtgtgtgcagagatcgtacggggagagaaggatgcaagagggagggggggaaggtgccaggctctgtttataacaatcagatcttgcaatatcgaacagagtgatactcactcattaaggcaccaagccattactgagggatctgtccctgtgacccacatacctcccacaaggccccatctccaacactggggactgcattctagcatgagattttgaggggacaaacatccaaaccaaatcaggctgcatcgctcccatctctgcctccaccctcacatggccttctcctctgcgtctgtgtcatctcctcttgtgtctcttacaaggacacttagctttggatttatagcccacttggataatctaggatgatctcatctcaagacccttaacttaattgtatctgcaaatactctttttccaaataaggtcacactcacagattctggggacttagacttggacagatttttggggggccaccatctcacccactacactttccttatctcctctcccatccctcctttatcttaaagaatgttcccttcccttctctgtcctctcttcctgtcttccactgataagttggagactcaggaccttcctccttggtggttttaaccagaaatattaagtggctggtcccctgtctgtgctgcagggcagggtggctgctggctcagcagctgttggggctacttggtgtgggatggggtggaaacgggtatgctgccggttctgggttgaattgttaccccctcaccaaaattcttatgttgatatcctaacccccagtccctcagaatgcggccttatgtagcaacagggtcattgctgatgtaattagttaagaggtcatactggagtggggtgggctcctaatccaatatgacagagatccttacagaaaggggaaatttggatccagagatagatgcacacaaggaaagcaccatgtgaagatgaagcagagattgaggcgatgcttctacaagccaaggaacgccatctattgacagcaaatcagcagaagcgagggcggcagcctaggacagattgtccctcacagccttccaaggcaatcgaccctgtgacacgctaatctgaaacttcctgcctccagcacatttaacccatgcagttaggggcactttgttataggaaccctattaaaccaacacactgcttgacttttgggtttaggtacgtttcagagctgctactttgaagaagagaccacaaagaacagttctattttgctttatttgacaaataatcatgtctcatcagtcatatggaatcccacggaatttgccatttcacttttaacgctgtctgaaatctcattgaatgatatctcaacttggtatttaagaccaaataagcaaaagcaaataaataaaataaataaaaatgatgcttcagttaatcacattggctgccatcatcactgtcactaccactggattctgttttgtccaaatctgttaaaacaaaacaaaacaaaacaaaacaaacaacaacaaaaaaacaggcttcaagctccctggagttaacaaagcacagagccagcactgacgaaatggcaagctcaagaccaatttctctagaaagtccttgacagccacagaaagcccatgcgttttcatgggcataatcaccaacattattggggacagaaaataaagtttaaaattctgtcatcagtgactcttctcagcagagcctcctcatgaatttccggagggttaatgagctgagtttcatgaccgtgagtgcctctgtgaaagccatgcttctctcagagagatgagtgtgcacacaggctcttcatcttggaaatgaaagattacttgcacatggcactccggctgcttcagaaagcagggaaagctgccagtacacacctctgcctgtccaggaggatgatgtcacaggaagcgggactgggcaactggttctacaggaacgcagggacccaatcacatcacatacagttccccaccaacagcgatggcaaaaatgccttttgtattgttttcccacgtaaaaggcattgttttggggtctgagtttaaaccaaagagacacaattatccaccaaggggtgtgctggctagggaagggacggagagagggacaggatatgtgtatatttaggggtataaagagtatggctccatgtctacatacacacagatgcacagatacatgcatacatatgtgccgtgactttcgtttatcagcaggtcaataaaaacatagaaagatcagtgtattccattgcttgctgctctggtataggtccagcgtcaccctaataaatacaaatcacatacttcaatcctagcagaagtaggctgggggcacaagactgtgagtgccattttttctgttgaccatgtcatgtcgctagctccctcttgcttaccaggtaaaataccagctcttgggactggccaacaggacccctgcagggctggggagctgctgtgttcctagcaggtgaccctgcttgtaattttgtaaatatgctccaggagatgggactctcaggtttaagtcctgttgttttcgcttcctgcattgtttgctcctttgtctggttaacttcaacttctccgggctcaattcaggggttccaccatttagggaggctttcctaaatcgctcctcccaaagctgcttctgctggccgcttcaccatccccaaatcctggcattcctctagcacagcacaagggtccattcacttcagtaccctccttgaggcaaggaaatacaggctctttatcacctgagctcccagaacctggaactggcctggatcaaggtccatgttctacaaacactgccctgaatgaagtgtcatccaatctctgcatctacttagccatgaacaaataaaacaggaccccacccaaaccaaaccatggcaaacagtcaggtatcccaaggtagtttctaagactgaagcataagctattccctgagtgagggtagctgccttcagagatttacatgatctcaaatattagtcctaaatttaatgtgatattgttttatttccccataaaaatcttgcatgcatatatttttaggtactgcatttagttgcctgggaaacagcagggtctgtgcagagagaaggaaatgtttcagagagcgttagccacagaagagtttctggaatattctctaatggtgcaaccatccaccccatggatgcataacttaaacagttgagccatgtaacatccctgccccacactgcccctgtgttgagctgacaggtagagtcatctatggcaactcaagcacagatttgtagagggtcacagcagtgctatatccagctagtgtcatttggctggattgcatactagacttgtgattttcacatatgtgtagacataatctatgcctactgaaaaagattggaaggaatagttcttttggagaaagacagaatttgccaggtttccaggtctccttgagagacgtctgtacaagatctggagccgggttcctccagcttggcactgttgatattttgggctggaccatgctgtgttgtgaggctgtcccatagcctgcaggacagacagcagcagctctggcctccacccactaggtgccagtagcaccctcccatccacaccagttgtgacaacaaaaaatgttttctgatattgctaaatatctcctgggggacaaaattgccccatgttgaaagctattgctctagagattccgaggtaagacgaggtcactgctggaaatgggggaaggtaagtcaccttctgaaagtcaagggatgggcatttcaaggagctaaagggaggatcctttttgctaaagcctcctgatatctattccatacttctcacctgcctcaataacctcctaagctcctggaacgtcatgcctcatgggcttttggaggcttttgtgtgattagaggggaggacaagggtgtgatttggtaaaactgacataatacaaattgcttgtcaaatttcctctcacttgtctgtggagtgcaatagtaggaacatttgcacagagaaaaataaatgtctaaacatgcattggcacagacagtacactaactttcaacctaatgaaagaaacctaatgaatgaaaatgtaaggcttgccaaatgtgttatgataactctccagtgccaaggaaatatcaccctccccacggataccctggcaagcctgcgagtttaccccagtcagcaggtgcaccaaccatctcccctgcattgtaggtgagtgtatctatccctcattacaaggcttcttgaaattccttctgaactttctttctggaaatgctatccattatccaggcacccaaacccacccctttgtgcatggaatgtgtccaataaataactgggtttcataccacttgtgcaaaagcaacataaaaagtgctttttccttaaggggaaatatctcaccatttatacctcctgggagttagtagtttcatttaaatactaactttgtaagccacaagcaattcgctgtcttagtggagggaaatactcttctgtccatgttgctacatacagactactgttaacaaataagaatggagatatttccagtgccaggctcatagtagtgcccaaccaatttcagtgaaggagtctagcaagttgaacaaagtgctacttcaataatctattcctgaaaacttgtttttaatgtggtttagaggatacaattgtgcatgtatattttagcctatggaattttaactggatgctctttcttcttccctttctaccaatttctggtagatttctttctactttcaagccatgttctttttccacccaggtctattggtccctaggccttgagacccagagtcaataacaccttccctacaagaaacacacccagaagtgtccaccacctcaggtcccagtgaaaagaggtccaaggagatactaagctacgttcaatgtttccctttggttaactgcctgcttcttacatttccacaatgatttcctttacaatttgtatctactgctacaaatggcttatagatgtagtaccagaaggagaaaaactaataatagataattttctcaaaattacctggctatatttagtttcatgacaattaactaaaaactaatttaaaataaagtataatttggaaccagagctctattacgttataactctcacatatgtccccatggagagactgaatatgcaaatggacaatggtcagacaatgcataaaaacagaactttgacccacaacctgagcatcctgcccaggaaaccaactccttacctgtaataagcaactcaggaagcaagcctgctattagtttcacagaaagacagattgccatctctattcagaacttgtgcaacatttggccccagatggccaggacgtgattcataaatgaaagcttccctagtttttgtctctgcttccaactgaggaccaaccagagaaggccaggcatacaccccaaccaatcaccaggggtgctccacttctggttggctcataacatctccgtgctatcagcttccaattagggcacaactgaagcttcccttttctccactataatatttaccactcttctgcctttaagtctctgccaaaacacaagtgataatggccagcccccttgctataggaagctcagaatagacagcctttgcttttctcctttggttgtttatttccacaaagcctgccctaccagaacaaaagcgcattcattcttagtaaattgctagtgaatttccttctcaagggtctcaaaaaggctctttattaacatatactgccatctctaggatgcagtacatttgcccaatggccagagctctagtgggtatgggtacctatgaagcttagatcatgcagagagatatgagttaaccaaaatagaagagaattttgggtgggggacaagcaattagctatatcagaatttggctggggcaataagaatataaaaatggagacacagctccctggttaattttagtagccttgtagaaatttgagataaactgacaagaaccctggccttcattgacaagagctttagctgcattgtaagccactggttcaagctcatgcatttggaacttctcttgattgtatctacatctcttaggaaagaagtgaggaatagaaaaatacaaatgtttgagactaataaagaagtatgtaagatatgaaaattcatctaataactgagaaatcagaattgcaaaagatttttcatgagagttgagtcatttcctctaatttttagaattaggtttctttttttaaagctatagatcttgtaatacctgttctctatgaaattagagcatgaatatccaccaactattcattaaacaaatatgtattgatagtctgatattttgttggccttggacttaatcaaaaggcaagtaagagtggcatgatcagatcttgtgtcccaaagcaactgagaataaacttcaaaataaaatttgattttaaaaatactaaatttttgtttattgcttcttcactacgtaacgttgtgcgtttaataagcactgtctgcctgccatgtttatcttctatgagttcccacagcacttaaagcatgcacggtaatcccagtgtttgtgactatgtaaatgtggtttcaagcgggccggggcttggtccttgagagcagagagtccatcatgctttccatatcaagctggggtggaggaattgaagagggtgtacaggtgtggactcaggagccaaagggctgttagatggaaatacattttagatcattgatggttttgtactacctgtgcttctatttcttctcaatatcatctggcttttttttccatgatgaaacagagcaatttttgagatgtgtatatactttcagttcatggagaactaaaactatgtaccctcctaaaacttctgcccaatactcccctgacacacatacagctagacaacaaatctacatgcagatagaaatggttttattaccatcacttaattacccctgtcctcattaacgtcacttactattccaggagattcttgccaatgcaaataacttgattgttcaatccagaaacttgtagaaaaacctactgactcttccatggaaagtatcaaaagacagtttgtgccctaagacatactgaattcctgtttctaccaatcctgaatggtggcaagtcttagcattgggagattcaccttaaaccagaattcaaattctccacaaaatctcatctccctcctcccaggcactgccaaagctcccttgagtgctgtcccccttaccacagtaagaaataaattcagctttgtttcagcaacaggttgtgttgatgatctttagggcggcggccctgggcaccatggaggaccactttttcactagaaactcaagcagataagggcatctgaggcagctgctagttggcaacacttaagtaacactagaaaaattaccgaataacacttcgggtttgtatattttcattagtgaggcttatttttggtctgtgttcataatgcttttttttccccatgagtcaatttatttctttgtattagaacaaataagacttatatagggcagtggctagttcagctttagatttaatcagtctcttaaagatatgacttaatgtaggcaatttactgaaagtttcaaagagatatattacaataagaaaaggatgacagatgtgatttgctgtaagctcactgctaggctgagttaatctcagatgactaatcaatttggtctcatttgaagcttaaactaaaggtgcttttctcttttcttttctaataatttttcaccacaggctttgatgtttttgtatgcagaggcaagcttatcagagaagtttgagacaaaaataaaaagtttacgtggtgctatgaatgaaacagatgaatttcaatgtctataggaagaggttgagctctttggaataaagcaaagcatattcaatactgaagagggaattcaactacattgcataatgcactaaaatccttcctgagaatcctcatctcaaaggatttgctgaaaaatatattaatacattttccctgagatttttcatggttcattgagacacctagagacggctcttttctggcgtgcaccatttagacagtgcagcgctaatgggtattaaagacgcagcactgttaccttgaagatacaagctcatggaagatatatgtgcatggggccacaaaatgcatttgatcttctactttgtgttcatgtgtttgaatttgtttaaggcaagcttattttggtaattaaagcttaggagttcttggcagttttttcctcttaaaggaataataaaactggctctctctttttatcaaactctgcacatgtgtaggagaatataatgacaggtacttgggattccagcttctgtgtggttgcagattactctttagtggcgacactgcttcattgttccattatttaccagtgggcttcttggaagaatgcagatgtgatgaccaaatagaaaaccttgttgaaaggagtaagttgctttttgggaaaaattaagcatctgcattagaaagatttgtgcctacaataaaacgaaaataaaaaagggttttggagaaaaggcatcatcacaataggctggagataactttaaatatactgaaaatgcttaatctctttttcacagaacagaggtgctgaaaaacctttgcttgggagcctccaaggaaccgaaagaagcccatgaaagaactgaggctaagagcagcaacacggctactgctatgaagcacgaggacaatgatggcagtgaattaactcagggcctgccaagttccaactattattctaagtattctctgtgtcttcaatggcttctaacaacagccctaggaggtcaacactgcagttctttccatcttaaacatgaagacacaaaggcacagagacagaaagtaacttgcccaagggagtcaagctagaaaatgtacaacaatgcccaacacttagccagaaataaaaggtatgcaagaggaaaagaactaagaggagtattagagaagacaagggagcagtaagaagcacatttcctactaccttcagcagaggctccctgcaagccccaacttgtagtttgggtccactgggatcccctcagctgctcccgccttcccgccagtccccacgcttgcctcccatcgttcatcatctcccagctcctccttgaagaccgcacttgccctttgctgggcactgctgaaactgaagtttttgagcattttctctgcgaaagttgaaggcttgctatagagtcagggtgatttaacattttctgaatgactccaggactctttggggagcatcatttatttttctatattataataatattctcacaaagagcttctgccctacactaagtggtcctagatagttccacgcttgtgtttatataaagagcctttacatttccatcctctcctattgcctatttatttctcattactttttaaatattctctactgttcaatgtttgactgagagccttaatgtgttttctgagagcaatgcatgggctctctggcagctctgtccctggctgaagctgagcaatgccaagggtcccattttccacctggcataggaatgctggcttgaagtgtggcaggactgatttcttttcttgacaccacaggcttgattgaggaatgaataacggttggagaaggtagagttaaggacgtaggtactgaatgaaccagggttaaggacgtaggtactgaatgaaccaggctacctaaacaagttgtgtggaagtcttaaagaacccatcagaatggcataaaggttactttaaacttaaaagaagccttttctgagcttccttcattgactaaaggctgagctttctgagaatgcagctgccataagtcccctctgaggaggctccagccaagaaggagagactgactcttagccctggggtgagacatggcataaaccaaactttatcagaactgccatacccccatttatttcccctcgaagcccatttgtttcaacagaagccctatctatccacccttcccctattaagctggaatataaactactacccatacccgttcagtgagttactcattactgagtacttccacacacaggtgaataaaccttgtcttttctcctgttaatgtgtctattgtcaaattatttgcagtctcccacctccatctccccagttaggacctaagttagtagagggatggcctggagtctggagctgggtgtgctggggcatgtgctatctaaagtagccagtgctgtggaggttggctgtgattgggggtactgggctaggtgatctttggctcatgtagggaggagcaagagacagagagaatgagctgctactggcctacaccctaggtccttgtggatggcaggtactgccacaagccacaggcagggttggctcacggtgggatgtctctgtgtgctgaggacacagaaagccaacctgcaataaagttgggcttgagctgatttcctggctgcagaacaaaatcccatggtcacggcacacatggtagtgcaggttctcagatacactgacccatgagtactgaattccaacatgagtagttgcaacatgcagtgacctggatcacggagatggggcggagtgtctcccaccatcaggcttttgctaagtacatgcttgaataaaaattagaagtttaaacaatgacttttgtttctgagaataaatgtttcacatttcaatactattagtgaatctttctgaaatggagaatctaaataaatgcctagccttgagtcacaatacgtagtgatgccttgaacatagaatcactttgttaatgttcattgactgattatcttggatttctgctaaggaaatattgaaaaatgagatgtagaaaacaaatggaaatgaatctgggaaaaagttttagtgtttagtatatattaaaacctgatgtgatacatatagctcatttcaaaataatgacatatttgcccctccaatttgctaaggtattttaaaaattattattttgttattataatttctagaaacaggggtctcactgtctttcccaggctggtctccaactcttgggctcaagcgatccttctgccttagcctcccgagcagctgggactacaggcatgtgttattgtgcccagcttgcttaagtattttaaattcatgggctcattgcacaatcttaatagcacttgacttgagttttgaaggtcctaagaacttttgtaagtaataatttagagctcagtgagaagcagcttcatatgaatggaaagggcagtgccattcataagaggaaatggctgaactagctagggctaacactgcaatgcagatatgtgatgctcagcctgggctgtgtatcagaatcccctggagggcttctatagatagagagaagctcaggccgcatgccagagactcagattcaggagccttcaggtctggtcagggccagtgtcactcttcatgtctgaaggtgatttcacactgagtacctttcatttaatcatttgtgtgtggaatccagtcttgtgctgcattggtgtgacatccatctatctaccactatcattgtcccttgatctgcactatagaaaatcacatgcttttgccaaaatctctcctccagctcaggtctccaagtataggacagctatctcaagaccaacattctggattgtcaaaaccagaaaatggtttcattgataaagtaagcaggaaacaagagaaaacaggaagtttaatgaggagtatattcatctaatggggtgggttgttgatatggtttggctgtgtccccacccaaatctcatcttgaattgtaactcccacaattcccacgtgttgttggagggacccagtgggaagtaattgaatcatggggacaggtctttctcgtgctgttctcacgacagtgaataagtcttatgagatctcatcattttaaaaatgggagttcccctgcacaaactctctctttttgcctgctgccatccacgtaagatgtgacttgctcctccttgccttccaccatgattgtcaggcctccccagccatgtggagctgtaaatccaataaacctctttcttttgtaaattgcccagtcttgggtatgtctttatcagcagtgagaaaatggattaatacaatacattggtaccagtagagtggggtgctactgaaaagttacctgaaaatgtggaagtggctttggaacttggtaacaagtagaggttggaacaatttgaagggctcagaataagatagaaaaatatgggaaagtttggaacttcctagagacttgttgaatgtttttgcccacaataatgacagtgatatggacaataaagtccaggctgaggtggtctcagatggaaatgaggaacttcttgggaactagagcaaaggtaactcttgttatattttaaaaaagagactggcaggaatttgcccctgccctagagatttgtggaactttgaacataagagagatgatttaaggtatctggtggaagaaatttctaagcagcaaagcattcaaaaggtgacttgggtactgttaaaagcatttggttttataagggaagcagagcataaaagtttggaaaacttgcagtctgacaacgtgatagaaaataaaattctattttctggggagaaattcaagccagctgcagaaatttgcatacgtaatgaggagctgaatgttaatccccaagacaatggggaaaatgtctccagggcatgtcagaggtcttcacagcagcacctcccaccacaggcctggaggcctaggaggaaaaagtgatttcctgggctgggtccagggtcctcatgctttgtgcagcctagggacttggtgtcctgcatcccagctgctccagccatggcttaaaggggccaatggagacctcaggccatggcttcagagggtgcaagccccaagccttggcagctctcatgtggtgttgagactgcaggtgcacagaagtcaagaactgaggtttgggaacctctgcctagatttcagaagatgcatggaaacgcctggatgtccaggcagaagggacagggtcctcatggagaacctctgctcgggcagtgcgaagggaaatgtgggatgggagcccacacacagagtccctactggggcaccacctagcggagctgtgagaagagggctaccatcctccagacaccagaatggtagatccaatgacctcttgcatcgtgaagctggaaaagtcacagacactcaatactagcccatgaaggcagctgggagggaggctatcccctgcaaagccacaggggtgaagctgcccaagactatggaaacctacctctcacatcaggatgacctggatgttagacatggaatcaaagcaggtcattttggagcttcaagatttgacttccacactggatttcagacttgcatgggtcctgtagcccctttgttttggccaatttctcacatttggaatggctgtatttacccaatatctctaccccattgtatctaggaagtaactagcttgcttttgattttacaggctcataggcagaagggacttgccttgtctcagatgagactttggactgtggacttttgagttaatgctgaaatgagttaagactttgggggactcttgggaaggcatgattggttttgaaatgtgaggatatgagatttaggaggggccagtcacagaatgatatggtttggctgtgtccacacccaaatctcatctagaattgtaactcccacaattcccacatgtcatgggaagaacctagtgggaggtaactgaatcatgggggcaggtctttcttgttctgttctcacaacagtgaataagtctcatgagatctgatggttttaaaaggaggagctcccctgcacaaactctctctctttgcctgctgccatccacataagatatgacttgctcctccttgccttccaccatgattgttaggcctccccagtcatgtggaactgtaagtccaataaacctctttcttttctaaattgcccagtctcaggtatgtctttatcagcagcgtgaaaacgaactaatacagtcttgtacatcatccgtactacagagctgggttttagctatgagcacagaagcatcatgaatctgttggaaatttgaaggcagaatcaccatgatttcccatttcatgtcagtcacagacatttctgaaaatagcttgggacaaaaatcatgttgtttataaaaactcctgtggcatacagagctacatataagattaaaaaatcattcacctaccaccaagattcaattgaatgaaaaaaagtattcaatttataagaaaaagtatcacagaaactctttttgaaatatatgtgtatatatatagatatacccatacacatgaatatatacattcataccatatttatataaaaaatggtaattttgttgaggcttatctaggatttgaagaaaaaggaagaagtaaaatattttttcctgcaaaataaggagagcttgactacaaggtgtctaatggtcctctatcaattagatttataacttctgggagcatttgcctccctgcaggctattctcacttctaaatgtttgacagagtctcctgccaagccatgcacacagctgaaaaatggaagataagttcacaaccacagcatttgcagggacggctcaaggggtgggagctacccccactgcatttataaaggtactagcaaagaagcatttccattcattttcattataatatattccatggataaataacttggcactgcacctatgggcccctaaaacaatttcctccacatggaaaactgatcaagacagaatgactaggtacgtggtcctgtgcacagggattcatcaagtcccagaagccatatagtaaaggatgactacacacacacacacaaattacctgacagataaaaatttcaggagtaagatgtgaccattcggaataataagcctaaagaaataaaagtaagacagataatacccaacacgagagtctagactcgtggatggaaattcagacttctgatcagtctcaactgattggccttttcctcatgtcccatattttttcctggggtggataaacagccaagatgcctcaacagtagtggcatgaataaatctgtttaagttttgttcttaaacaagtaagaggaacttaaaatggcttcacgtgatgacctacagtcaacctaaaataatctgaacatgtgtggtcttataattttcagtatcatccacacaaggaaacattacctcttgtcttctttattccaaagtaaaaatgaagacaattatgtaagaaacctgtcttgggttaatgagccaagaaatgcttatctacctgtggatgggcattttattttaagatgagacttcctgtagatgtttctgtacttagagattaacataattggaccatgactttaactatctttttttttctttttcacactgatgacacacagattaatatctcagtcctgagctctaaatgaatattgtcggctttctacgtggcatgtcccctttcatgtctcacagatatttcaaactttcagtccaaaatcaaagttgtgatctaccatcccctcccctcctctgtctttttttgccacttacggcattttgtatttcatccatcagcaaaccttgctggttccaccttcaaaatactttttctacccctgtgctacaactctggtcctggacagcatgagctctttcccagactcctgaatccaagtcctcactgctcttccatcttatctactgtctagtgttcaaccagcagccggagaggacttttagtaataaacatctgatcatgctttcatgagccaaaactctcagagaaaaatccaacttccttatccaggctgaaaggtatcccgcactcaccatcagcatctctgacctttccctgcctcgttttccagctacaacaacattgaccttgttcctgtttttgccacctgcgaacctctctcctgcaccaggggttttgctcttgctgctcccttgcccagatggtgtaaggtctggctcctgtccatctcttaggatttacctcttcatagacttctttcctgaccaccccattcaacattcccttccccttgtcactctctaaacccttaccctattttactcatgtctgaagtggaaagtagatattgttttctttctcttttttttttagacaaagttttgttcttgtcacctaggctggagtacagtggtgcaatctcggctcactgcagcctcctcctcctggattcaagtgattttcctgcctcagcctctggagtagctgggactatgggcacccactaccacacccggctaatttttatatttttagtagagatggggtttcaccatgttgggcaggctgctctcgaactcctgacctcaggtgatctgtctgcctcggcctcccaaagagctgagattacaggcgtgagccactgcacagggcctgtttgcttatttttgagactattttcaccactaggctgtaagctccacaaagcagaaactttgatgtgctatgactggtacatagtaggcactcaaaaaatattggtcaaatgaatgaatgaggagataaattaattccacatcttggaagttagtacacaaggataaaattacactaaacccttgaaatatccaactatgtattagcatattttgccaactgtattaaataatcacattagactttcatggtatgaacaatgaattgtggcacttctattttgaaagctggacttgtttatatttaattagtccctgggaatttttaaatactgtactcattgtcccaataatgatactctatatgaagataagaaattatgatctagcataaaattctcactgtagtcttaattagcttcaaatgcaacccctaaatcttgcctggtgtttcataccacacagttggctgcttttctctttacgtgagctccctctggggaactgcagctcaaaaatggcatttgtggaaatgacttgggaaagcccgagctaattcatcagacaagcacattcttctaatgttaacccttgactacatgggaacaacgccaagctcatagctatagttccactgggggcaggctcccctggggcagactccaaaaggagccctgtgtgctgtcggggaccgcgtaaaggcttgccagggggatacagggtttggggttttaagggaatccattttcagattctcgacctccttatgcactctgaacaaaactgatctgcctgaaaaacgtgcttgcatgttctttcacacgttcccttctcttgttttacaaaaccaggtcaattttctccctgctgcaatggcaaacattctctgagatgaagccaagggtattgcttaatgccagtgtctgggttaaggaggaacaaccatgatgatggacaattcatcgttttcttcaacggggcagtttccagttctttaccttcaacaagattgaaggaagactgaacaaagttgacagttaacagatcattaaaaataacttgatgacggatcccaatgagatatttaaacatcaatgcataagaagttcaaagaatcaagtagcattactataaggaaagaccatctattctctttaccttatatatatgagtaatgtttctcggtatttaaatctataaaaacaacaaaaaagagaataaaatgagacaaccttgttcaatcaagcaataagttatattatttttgaatatatgaatggatagggaaaaaaggctcatccatctggtgaatgcatttccaatacaattttacattttatattgaataactttaatcaagataaatgatatattattttgatcaattttattctgctaataactacagtaataatctgtaagaaagttttaatttaaagcctaataccataagaaatatttacaatatatcttaatttgtataaattttgtttgcaaagagaatgagcaataagacactttaaagcataaaatacattaatcagggtaaaattttcgggggaggtagaaagcttatatgtttgaggagcaaaaggaatgacgtagaatttctaatattgataaataatctgctcacatattgttgaagaagatgatgttgggtactaaaccactgtggtatccagatttttaaagacatatttaaaagagggatgtgtcagttttatttttaaaatgccacccgggaaactaaactatattcctggcaacaatttaaatctaaaaatgtgaggggggtggggttggggggcatagctttccaaaagtcttttagagagttaacaaggaaaaataaattgcatacccctactcttaaacattctgttaatgatttgcaatcattaattctatcaatacgctgacacaggcatcctccagcctgtgtgtggtcaggccatgctggggaagcacagagatcctccgaaagaacagggcatcttctctcaaggagattaccagcatgggtcagccagacccaggagatgccagcaacaggataagatgactttagaacttcagggaacttgggggtggggagggctggaagaaatggagtcctcttaggcatttataggaaggtcaaggtgaaggcaaggtgtgttcccttccatttctttccatttcttttctccaagtaaagataccagcttgtttcagccaagttgtcgggctatttttatgcacatatttgagctccctcttttctgtgtttaaaataaggaatctcacacgccttggaatttagaaagaaaactaggcagagactagcatctagtcaccgcataactgagcagagactagataacaatcatatagactgtgaaaagtcctgaacctggagacttcataaccaatcagaggctgattcccaccatccgggaggaagaacagggctcagagtggaaggatgagaagagaggagtctgcagaagatgtgccttcgagatagagaacattccatgcgctccctcccctccttctccggtaactgtccccactcttcacatgcagtaagggtcacttgggattgcttatctattctgcagaagacaagaccaaagttggcctacagctgtttaaaccccctacctcatgcctgggtctaccagccctgtcagctctaccatctaaactcatccctttgtctcttgccaaagcaaaacggagatatagttatttttcctaaaagttcatcagaatgcttaaaggaaagttataaagtaaacaaatttataggaaagtctgtgtacctgtcaatcacactgttactatctagactgattccttatctaattagactaactgggattttaggcagtggtgatttgttttttctgcacccagttcaagctggtcgctcagcttccttcaagccacctaggagctggtgggttacagattaaccagttggaggggtggttgtggttgttcttgttactgctagttattgtctaagctgcagttttcctgcatttcatttttattctaaacatttctacatcttccactccatctctgctttgagttaacgaggggtggaggtggcctttggagacaactgggaagctaaaatgcaggtttgctagaagtcctgctttaagccaagctggaaggattttataacctgattcagtcacctgggcctttcccacgggtgcctaataactgtggatgcagccatgattataagtatgaggtcactcacctacttaagatagttcttttggaaactgtacttagttatgcaatgctcagtattgtttgttgctcacagaactttactgcttgatccagtagcacagtcacacatatgtgtatactttaaatatttatccccaggagccctgatactttgtcattcaaattcttttagcgagtgctagtcctttgcctatcagaaagaagctcactgaataattcctctattttcccctatggagatgctttagaaaaaaaatactcccttttcttcaacaaacatccttgccaatattcatcacccactctatctctttttatctgttacctcttccctctgaggactaaactctgatttttttaacatgcccaaattcctatctaaaggatttggggagtcatgccctacaaaccataaattctcatcagatgggtttatttaatcctatatatcgtgatttactttccaatttgactctggcataacattatgtgacaaagaagaaagtcaaaatattttaccccaaaacatgtttctttgccatattttgaaatggtcctgcagagctgtcctttgtgagggaaaatttgcatctgtaaagaatctctgctaacataactagatctttttatcgcaggccctccccatcctgaagagattaactgagagtctagcaccctttaaaggtctgaataggaaacatttgtcatctattgtctctaagggcagccattataagacttcaaaagaaccttggtctccacaatcttttatctttttttttttttttcagatggggtctcactctgtcaccaggctggagtgcagtggtgtgatctcagctcactgcaacctccgtctcctgggtttaagagattctcctgcctcagcctcccaagtagctgggactacaggtgcacgccaccatacccagataatttttgtatttttagtagagatggggttccaccatgttggccaggatggtctcaatctcttgacctcgttatccacccacttcagcctcccaaagtgctgggattacaggcatgcgccaccgcgcccagccttccacaatcttttaacttaacctgagcatttccttcctattgatcccaggcctttagacaagctcaatcaattgtcaaccagaaaatgtttaaatttacctacagcccccctcactccctcctcccccaccctgacccctgccatccccaaccaccccctgcactttgagttgttccacctttctggaccaaaccaatgtatttaattgatgtctcatgcctctctaaactgtataaaaccaagtgcaccctgaccactttgggcacatattctgaagacctcctgagggctgtgtcatgggccatggtcactcatatttggctcagaataaatctcttcaaatattctgcagagtttgactcttttcgttgacacctccaagaccaacagcgagactcagtgagagtgaaatacaattgcaatcgtgttctgatgggctaagcaagctgtcacagaagaaggcaatgctaatgccagaatgtggtctcaggtcaatttaggaatattcaaggcagaccagagaattactccttgggtctcccactgtctatgtttccttagttcagcagattagcaatctgaccaaaaagcaagaccaaaggtttgatcttcaaggggactgattagctcctcccagtgcctgatgcagccatataccaaccccagagttattctgcacacaacacatgctgtcagtcagggcctggggaagggacagggcctggggaagggacaagagggaagagcttatgaaaaatcctgttgccatgattcaaaagcaattcaaagcaaacactgcctcacatcccctctatatatcaaagagaacacattttaaaaatcgtccaggtattgatataaggtagaggagagtataagcagagaatagtgtttaagaagtgatacgtagctttaattcaagaaaagtagttcaccaaaatgcagtggtaatactctagcatttttggagaatggtcaaggcagggttatagctctaagtattaaattacatattttctgtttatttttcttctcctttgcttgctcactgaaatgctgaagaaatactttccttactcaacccacacctaaacagagacacagcttcaaagaaaccatgggccaaagcgcaagagggaataaccagatgctgcctgaaggatcaggttcttaggtcccagaggttagccaagactggagctgggaaaaggtgctgccaggaaaagcagcacctccaaccctgtggtctaaccaccttggtcacgtgtaggcatcctgaatggtgagaaacttagacaccttgagtggggcaggaaaccctgccctcattgaagaattgagagactccctggagccttcccagacccctctacaattgtcagtgttatatttgcattttaatgtttacaatgagctctttaaacccatcctcttgattaaattggtcttcaaacataaggggctttattaagtggaaaggtagagacttttgctgaactgaagaggctcatgatgtcttcatcaaagtgtgtgttgtgaaagattatattaaaatataatattcctactctctctatatatagtatttgcaacaatttaagctggttttgactctagggatcaatgacattagtggcaatgttggctgaagttggctattccattagaagcaactatccattacataaataatataaagtttggatcagcaatttctggaacaaatttttttgtcttttctaatcagagaaatgggatatctcagaggaaaaatactcttaagtttaaactttaataattataaaatatttccaaattggaagaacacagttttccaaaagattagcaggcaatttttatttatgatggatcttacagactcaactcagtagttctcaaccttggcaaacttcagcatccctcagggagccttgaaacaagtactcatatctaggtggctctgggtcaggctcaggtgattccaccgtgcatccaactttaagaatggtgttctttagaaaggactttttgtctgctttggtttgcagagtaaaaataaagcatgtagttctatttttataagtttgtggtggtgatgtgttcaagttaaggaaagagagtagagggtaagtaggtctcagttataaaagatgctctggtataggttataatggcaaactgatttaaattacttaggaaatctatgtatgacaataaaaatttggtttataaaaccacaatattatgacttcaacctattatgcattacaacacaacttaataagaatctactaggccaggcgcggtggctcacgcctgtaatcccagcactttgggaagccgaggcgggcggatcacgaggtcaggagatcgagaccatcctggctaacacggtgaaaccccgtctctactaaaaaatgtaaacaaattatccgggcgtggtggcgggcgcctgtagtcccagctatgtggggggctggggcaggagaatggcgtgaacctgggaggcgaagcttgcagtgagccgagatcgcaccactgcactccagcctgggcgacagagcgagactccgtctcaaaaataaaaacaacaacaaaaaaataagaatctgctagacgacagaacagatccgttctgggggttatagtagcaaagaaggaagacactgtccgtgtccgtgttcccacagagctcatattctagcagaacagtaactacgcaacgtgtatcttcatcacaacattaatacaatgctaggcatattggggctttcaaaagaagcacaaaaagtaaaaatagagaaaggtattgttcttattcctaaagagtgatcaggttagaggaggagatgacactactctacttgagtcatcatgaacttatggtgttgtacacagcattccttaaattccttaagtgccaaactcggggggtatacagattaacacaaagaagtgtaaatagggcaaaaataaatctagagcactcacagaagcttgtaaaaagggtagggcctgaatttgtcttggaatatgggttaggagtagatagaaaaggaggtgaaagagccatcagggtaggaaaatggctgccatgagccatctaagtgagttataatgaaaatgttatccgtagggacagaggagagagtgtccaactggaaaggaggctgtgaactcagaaatggtacatattgaggatggatagagacagtggatgtaaaattatacaaggcctgaaaaatataggtagtacaatgatccaaaaagctggcagctgagcttcacagcagacagggaaacaaaggaaagagagagagagagacagacagacagacagagagacagagagacagagagagagagaagagacagagagacagagaaagagatcttatatggctcagaaaactgataactgggcaatagtatacggagtatagagaaatctttggaatctacaggtgctcaacttctgagcctaatggtagattaaatactgatcatgctcttgaaacatttgcactcagtggtaaactgaatttaactgggctgcagctgggctgaatttaactaaagcccagatatagttaaagcatgcattagattatctcagccctctaccttagcaaccccgtagatgaaatgaggtgctttttaggaggaaagaattaccaacttcagtctattcaaatctttcaacataaaacgtccggcatacaataacaaatcacaagacttgcaaagaagtaagacaatatgaccgaaaattaagagaaaataaagttatcataggcaaatccacaataatatagatgttagaatatgtagataaggactttatctgtgatatatttgttaaattatctagtgagataatggacaacatgcatgaaaaaaattggttaaattcagcagagaaatggaaactataagacataaccaaattgaaattctagaattggaaaatacaatatcagacaggaaggatttatataatgcctttataaaggattgaaaatagcacatggaaggaccagtgagtttaaagatagattactagaaattatcaaaactaaagcacaaagtgaaaaagaacaataaaaaaatcttaaactgaagatctaagacctacctacaggacaatatcatgtagtgtaatatacatgtaattgaattcccagaaggacaggaaagtgagatggggtagaggaaatataataatcaataatgaccaagcatcttgaaagcaggtagtataaaaatacatactcagggaacaacagtaacaactgacttctcatcaaaagcaatggaagccataagacaacagaataatatctttgaagtgctgaaaaaaattattctcagaattctaaggagaggtatcctttgtggatggaggcaactaaagacattttcaaaatgacacaaagctgagagaatttatcttcatcagacttgcactataaaaagtgctaaaggagtttcttcaggcagaagggaaattatatcagatttatacaagtttattgcaggaagaaatgaagaggacgtgaaataaaatggaggagaggtcttagatatagtgtgtatatggagagggaagaggaggagtgcgtaggggaggggagggaggaggaagggaggagaggagagggggagaggacaaaaaggcccaggacacagcagtgacgtaaagtggagaagaaaaggccaaagaggggagaaaaatggagaaggaaaagagtaggaagaacactaggaaagttttatcttaggaacaaaggtacgtgaatatgccaaatgctgccggaaggttccagcaagtttggaagagagacatatctactgcactaagaagcacaaaggctcttgggggcctcaataaaaatttttactaagaaaaaaatcagggctgggcacagtggctcatgcctgtaatcccagcactctgggaggttgaggcgggcagatggcttaaggccgggagttcaagaccagtctggccagcttggcaacaccttgtctctactatgaatacaaaaattagtcaggcatggtggcgtctgcacctgtaatcccagatacccaggtgcccgaggcatgagaatcgtttgaacctcggaggctgaggttgtagtgagctgagattgtaccactgtactcctgagtgacagagcctgagtgacaaagtgagaccctgtcttcaaaaatttttttttcaaaaaacgaaaaaaaaaaatgaggcagcagagttcactttgtgtcattcacatcaggaaacactgactagtctgtaactggagtaccttgcaaaggtaagcgtggcagcagtgatgtgggaggggggagtgcagactgggtaagaaggggcagagggcaggaacccccacagagtgcgcgtgtgtcctgggcttgtcatgctatgggctgaaactgaaaagtaaaatgctgaggggtagtaaagagaactcaagaaactccctggcaaagtatcaataagatatcacacttggtttactcacttgggataaagaaaaggaagaaaagaaaacaaggaaagtttctgttcatttctatcactgggaaaagaaggccaagtaaaaactggggtttatgttcgaatctgaggaagaaaggagatggtgactggaaaattaaacctagtgagtttctaacattttaagaggaataaggtcactcccatagacactgggggtattagtctgtggaggtaatagtcaattaaaatgtaataccaccagtttccatttcatcactataactttcctttctgaccaataaattaaactgttcaagtctcaaggtgaggaccacagggatttgtatcttttgatctctcttgagcactgaataacctctaatgttaatgttgcagtcttagtgagccttaattgaaagtaacacactgcacattaacatatatgtgcatcagcccaggctatactgcctgaagttcagtagcctacatcaaatgataagaaacatacactcactttgggattgaaggctattatatgcttaggaaataagccactctatgcttcaaatccattcattttacctgacattgcttaagtacattataatacacgaaattgaataggaaaattttgttttaactttaaaaaaccaagtttcccaaatggacagtatattgttacgaactttctggttatgagagaaacaatgtccgaatttcaactaattttcttgaatgaactttcaggacattttcatgaggagctgttgggaattgcttgattctctcactcaatgtccctttgactggagtctggcaggatgaacaacacgagcttttttcttcttcaggcaattggtttaggagcagaatctgtggttgctgctcatgccaggtcacagaccagcatcccatatccggcctcaggctgcccagacactgggacactggcggggctgcatctccaggcttctgtctccttcctggtcccctggtgtatgcccgggggcttgcggtgcccttcctgctaggctggctgtcccctccctgctgtctgcctccttctcttctaactgccttatgcccccaagggcagcaccactggcccatctgattgatggcaccagcctggagccttccttttagctgaaacccaattacagctgtccttgcctgctccgtaattttttgagatccagtataataaatataatcaaacatcagccaggatggtttaaaaagaattcatctttaaacgtttaaactcatttctaatccattaatttttagtattcaagagtaaaaataataatttctttccacctgattgagacttttgtttttaacaaggagagaagatagcagtccacacatagaagggaatacaatgtaaaaacattatcctgcaaacgtctattttctgtttttatattctcaagatttggctgtggtatttgaggagagccatttcatttctcatgcatcctcttttctaaagcttttcttcggaaactgtttggccagacataaaatgaacacctaaacagtccaaataaagttaggtcggctctccgtctcttgctctctctttgaggtctctaagcctttgggcagaagtcctgaatttgaatcaactggaaatgtttcagttttgtctttttccccacatggagtatttccaagggacaaatcattaattcttatttaatagaataatgattggctcttcaatttatttataacttcccttttaaggaattcttatcttcccgacccagctgccaaaattccccaaaaggtgtcccaagttaattaacaaagaacccatggcttcaccgaaaagggaggcagcattcatgaaattaggttctggggtttaggagatgggagctgtaacataggcacctaatctgaagatacaaagttccagccaaggtacagagcttgccttctgtctaaaatgtggcttgtgaaatcaagttattaaaacaaaccagcagagagtgctccaacaaatcactttgtctaagaaataaggtttctttttaaaatactaattgaaattccaagtgttctaataaaaacgacatctgtctgggtctgaagaaacatattttgaaaagcagagaagatatgtctctaaaatttcctcagatcaacgtaataaagtgaacttacatatttccagtactaaaaacagcacgttgccttcctgggttgcactggactttccacagccttgtatctttccctggacggaggtgggattcgtcagggccaagagcacaagtaaagaaggtgcctacagtgccacgtgatcagtgaccctcaagaggtctgtttcccagaatggagcacccatatcccagaacgttctgtcacgtgccagccattagcatgagacgcaaaaataagaaaacacatgggtatctattttaactgataggactctaaatgtttcttagagccctctgtttctcagtttcgccagcagacagtgggggtgcaatatgatactctgagcatggagaggatactgactcaggtgcgtttcaatcctagactgtggaatttagacggactttgaggaatgatgtcctgagtatcatttgtaaccatttgtcattgaagtggagacacagctgcagggatctgttcattccccagttcatgctctcatcattgagggtttggttaaaaaggtatctcaaagcttccatgaagagcagtatttccaggtttagaattcctagattccattataaagctttatatgtaacattcaggacagtattgatataacgaagattttccctgttctcaccacccctcactccagttctccaaaggaaaaaacatttctcactaagtaaagacctggcatggaggaaggagtattgtaattctatgggcatcaccgttttctttattcagtctttattttcactcaaagacagaacatttttatgtcgtcctttaaatatcaccaggaatctttgtccggaaacagtctttacaatgtgcagatcaaatctattatttgaatatttaaaacattgtggtaagtaaaggaagcttgaaaggatggccctaattccccctgcccaccccccacctccttaacccccagaatgaatgaaaaggatgatctaaagatccatgtggggaaaggaatagcaatgatttttactacttaaaaaataataaactcccaggcaagaaaccacccttattttgttcctgattttgttcacgtgggaaaacatgagttgtgtaatgctcactacacaggggggcgctgtgtagcgcccttcccttccatcttggttggtggatgcctgtgtttgagaagcagcagattccccctaggaaatggccctattctgaccccagagaaagtcagatcccatcttgtgctccttttgaggttggaatggggagagaaggcattggctggacagaagctcagctagttggtaaagtgaaaagaaagcccagcgtgaaaagtggattatagaataggaacatatgggggcgtcagtcaaaggaagattcttacacagcctccccaatgtggtgaagcagccatccaaatgggagcagaatgtagggaaacagtcctgcaaagcacagaaggatgaggccaaaggatgatggcaaactgggaaagggccaggctcatgacacggaggataggtccttctcttcagcctcaggagggtgcagggagctaggaggatgcttgcagcatcccagccctggttcgcctgctggaaactgtggcaagttgccaccacccggggcagccagtggaggggctctgtgagctccgccagtacccgcagggatgcggtggccccgccaacaggaacctttggcagtgattgaatcacacacagaaagcattactatttcctttccaatctcaagcctcttccacagtggcagcagaatgagtttgattagagtctggatttgagagagcatctaagctttatttctttcctctgttctctggacaccgtagaaagagacagacacagacatccctctaccccttcctctctctatttggattccccaaacctcctccagatctgctctttgaataaatacgctgtgttatttatccaccagttaattcattcagcaactacataccgagttcttgttatgagcatagcaaagtgctagacactgtcagacataaaagtaaatacatcacctgatgcttgcttattatttcatttggggaagacatacgcatacacaaaaaacataagagacaatgtgaggataaaattacacaatggaaatctaaaacaagtgagaaggtttcttatcaaataggtgctgcccacttcagctctgggtgcagggagtagcctttatcaggaaaggccactgcaaggtgggctttgaatggtggtggcaggtagtaaatgcaagctcatgttatgctttaaatgtttggtttgagtttgttttgttggcagagaggatgggatttgcctaaaataagtgtctgccatctacaccaggaactgtccatgtgccgaaatgggtggcattttgctaaactttctgttgaagcaatacaatattgtttgctcttttcactgatgctaattattaccattccttttttaaaccttccatactcagaaggataattaacattttttgaaggttgcaaagaaatgtatggatgtgcattaacctcggctactattctatgccagtaggaagaacacaaagatctatctatagcatacttattgctgtttcccagagacatacacataactatggaaacaacccaaatggaaagccaagggagaggcaaagcgtgtttcattctgctagtgctactgtatgattctcattagacctcatgggatagggtgattattgttcaatagcctatttagagtttccccgataatggagtctaagaaagatgaatgattccttagctgcaattgtggagtctgcttcccccaacctctcattaaaagaatgatctacgaagaattctattttaaactgaaaatccagaaccaatgatggaaaagaaagggattctttctgaaatcctgagtgtctgcatgcatctagtaaatttatagagaaaagaaactggctgtttgattcttggcttttttaatagaaaaccccccttttttaagttaatgttttatttaatttccttaatgttttgctgacttggaggtcattttaagatgacgacaagcaggaaatattcggttcagtcattttttttctggcaaatatttattaagtccctactacagattgggcattgttctaggtacatgggatatgccagcaaggaaataagagaactctctgctcttaacaggcttaccttacagtggggaaagatggaaataaaacaagatgaataagtaatacattatatattagaaggtaattggggctgtggagaaaattaagcagggaaaggagctgagggtaagattttaagtacggtggcctgaaaagcttctctgggaaagacgtgagtgaggtgaggactgagctgcatgaatgccaagaggaagagactccaggaagcagcaagttcaaattccctgaggcaggatctcagagcatgtaatataggaatcacagtcaaccagtggcctcagaaaatttattaatttccagaggactaggtggggttggagaggtcatagggagcttccacatctgccctgcaaagacttgattttacactgagatgaggagggtttggtgtgaaggagtgacgtgctctgactaaggtttcaacaggataactctggttgccactgcaataggagaccatctagggtgaaggaagcacagggagactaggtaagggggtgctcaggaataagccaggagagggatgatgagagttttggaccagagagaaagcaatgaagatgaagagaagtgttaaagtctgcgaaaattcagaaggacaaccagatttgttgatagattaggtatgaggtggattgcatacgagtcaaagaagacgccaaggtgtctgtcccaggtctctgcaagaataactggtcattttctgggggaatactatggaagggtcaggtctgggagagaccttggttgtggacatgctatatttgagacactcataagacatccagtggagaggatagagcagacagttggacacaggatctgaggttcatgctggagatacctgtttggagtcaccagaatacagatgatcttcaatgccatgaaaccatatgatgtcaccctagccttctgtgagaggtgatggagaggagaggaggtccaagattaacctttcattgttcttcactcaaagtcactgcagctttcttctgtgtataaagttctgtatagcattttcctacaaaaaccacttgggtacagtatttaaagtaaaatagttagcaaaagtcgcatttcctctctcttaaatacaatccaatgttgttcttgtcaaattctgctattctcagtcaagaaaaaaatattgatttcataaagcctgtgacttagatattttcccttctactttcaaatgactggcttcatttcccatctggtgacatttgatagtaaaggtttcgttgaacacaggcagtatagtggtctaaatattcctgtctccgagagaagactagataactggcttttgagaaagaagagatgcctaggagctgtcaaaccaatcaatagttcactattttgttatattttaatccaccaaaagaaaaaaaacacacatacaaacacacaataccaagtagttagtatccaggcagtagactgattagctattgatttttttctccatttttcagagaagggataggattttattgggaatcccagtgctgtcctgtctgaaacaactgtgcaacgaaaaaaagaaaagagtatatgggaagagtaccttgacctttggagctaacgacctactttagatataccagatctacacaattcacagataacccttaaattaaatgcaaactaagtgtaaatagcaagttgcaagcttatttcccgctgtataatgaattacaagtatggtgaatctgttagacacagatttgcagcctggccttgcagtgaataaataaatggctgaagagctgcaaatattatggtttttcttggaggatatgatggctattgtgaaatggcaggagaaaaagtggctgcttcccaggtcataaaaggcttaatataccactatctgtaatttggataggggaaaaagaaccatgtaactataaaaacattttgtctgcaatttggagtcacacttggtcttccagttgccccaggaatggaatcttgagctctttgcctattgtcacctaatttctcccagttcccaagatcacctgcacccttgccacgggggttggtccagctcccttctgctgagcctctggatgctacctactgacttctgttccctgcattcaggctgccagatttcatgctgtcattggactagtgaccctacagaaatgatatccctaacaccagatgcctaccagccagaccaatggcctgtggggactgtgtcatcctctgagaggtttcagtagattcatctttctccaggagatcaatcagccttggccttggcatcttcccacctacagagggaggcatcagaaggcctctctgaccttggctcccaacactcgccctgccaggtacacaaggtcccttgaaggcctggagcccactggcctgctcccagttccctctccagggccttttccctggattcttttccccccaaatacctgcatggcttcctgtctcatctcctttgagtctctagtgttacttttccaaccacccctatcttgacctcgcattgaaaatcacaaccctaaactggatatccacatatggaagaatgaaactagacttttacatagaaaaatcaactaaaaatggactcaagacttaaatgtaagacctaaactataaaaattctaggagaaaacaggggaaaagctatacgacactggtctgggcaataatgtttttggatttgactccaaaagctcatgcaacaaaataaaagatagacaaatgggattgcatcaaactaaaaagcttctgcacagaaaaaaaataatggaatgaagagacaacctacagattgggagaaaatattattagtaaccaaaaatataattatgggttgatatcaaaaatatataaagaattcaaacaattcaacagcaagaaaacaaataacctgattaaaaaatggacaaaggatatgaatagacattacttaaaagaagaaatacaaatggctagcacatatatgaagaaaggttcaatatcactaagcaatgcaaattcaaaccacaataagttatcacctcacacctatcagaacagtaattatcaaaaagataaaaaccagtgttggtgaggatgcagagaaagagaaacccttgtactttattagcgggaatgtatattagtacagccactactgtactgattagaaaaactgtatataggttctacaaaaagctaaatatagaattactatatgatccagtaatcccacttctgggtatatatccagaggatctggtatcagtatgtcacagaaccatttataactctcatgttcattccagcattattcacaatagttaatgtatagaagcaatctaagtgtccatcaatggataaatgaataaataaaatacggtatatatacacaaaggaatactactcagccacagaaaggaagggaatcctgtcctttacaacaacatggatgaacctggaggacattatgctaagtgaaatgagccacttacatatgtacacataccacatgatctcacttaaatgtagaatctaaaacaaatgaatttatagaagcataggctgggtgccgatggctcatgcctgtaattccagcactttgggaggccgaggtgggtggattacctgaggtcaggagttcgagaccatcctggccaacatggtgaggccccacctccactaaaaaatacacaaattagttgggcatggtggcacgtgtctgtagtcccagctactcgagaggctgaggcaggagaactgtttgaacttgggaggtggaggttgcagtaagtcaagattatgccactgcactccagcctgagcaacacatgagaccctgtcacacacacacacacacacacacacacacacacactcacacacacacacaaacatgctttgtagaagcagaaggtagaatggtggttatgagagactgaaggtaagaggaatggggagatgttggtggaagggtgcaaagtttcacttgagaagaacagattttttgagatttattatgcaacaaggtgactacagttaataataatgtattttatatttcaaaattgctaagagtaaattttcaaatgttcccaccaaagataagataattatttgaagagatgaaatgttaatcagcttgatttaatcagttcacattgtatgcattcaggttgagaaccccttatccaaaaatgcttaggaccagaagtgttttcggattttagatgttttcggatttgggaatattggcagaatacataccagttaagcatctctaatttaaaaattcaaaattggaaatgctcattggagcatcatgttggcactcaaaaaattacggattcggcagcatttcaggattttggacttctggattagggaccctcaacctgtatatcataacatcactttgtgtcccatgaatgtctatgattataacttactagtttaccattaaagaaacataatccttatgctaagtgaaaaaagtcagacacaaaggtcatatgttctatgattccatttataccaaatacccagaataggaaaatccatagacagagagcagattgatggttgccaggggctggagaagggggatggagagtgattgctaatgggaacagtgtttgcctttggggtgatgaaaatgttttaaaacttgatacaggtggtgattgtacaacattatgaatatactaaatgccactaaaatggtagactttaaagtggtcaattttatgttatgtggatatctcaattaaaaagaaatttgcaatctcactaattaccctttactcagctccattttgtgattcatttgtttagtttgcttcttgaacatctccttctcttgaatgtaaactccacaagggcagggctttctgtctgttttgcttattgatttaatctctgggcctagaacaggcctggaacaaagcaggccatgagttttgttgaatagacaggtgaatgtattacctcttttgtgccttattaataaaagatcctctgtatttcttgaataccaaattaaagagagataatttcttaaaagaataggattaaagggctagtggtctcatccaaaataaatttaaaatagagaggggaagaaaagtaatcctatcagaattcctcagttcactgcatgggaaacaaacaaacagcctgtcagagattcagaggattgagacaacggtatcctgtgccgagcattgaggttctttttaatttgcaaggattagaaatgtcaacgagcatcacattttcctctaaattctaaaagatgactcagtgcagtggatttaaatcagaaggacagcagaaaaaatgaggctgctaataaatgcacggcttctgtgtaagcataggctatgcatacgggttcaaccacacctacccctagagaaaatattttcacttaacacttgagacactgtgaatcagggagaacataccgatgagctccttatttctgacgtccaaggccatgttccgcagcgcagtggccaccgcgcacaccacacggtcattgtctattcggagcagctccacgaggatgggcaggcctttctcttttcggacagcggctcggatatatactgaccactgcaaaaacagggaaggcgaagggcgttagaaacaggaagaaaccctgcatgcaaatagtacatttgcgttttcaggcggctgcttacaggagccaaaaaggttgaattaccaagacctagttgtagaatgggttgaatacgttagacatgcatttaaactttttaactgtattttttgccttcaacttggggacaaagatttcagggttaatcagtgaaccacattaggtttcttttgtgacactgttttcagtacttgaagttgaaagccatttgcgtgatgcgtatacttgatgcttcaagatacagaggtttgggacaagcggatgtggccagtggcattaaagagaaataaaacaagaaccctgaaaaagtagaaaatgagaatgggttgtgtgggagtgatttctcaagacagctttgaatttggagatggggcacacaggtgagttgctgaacgtgctgtcaataagtcgtttgctgaacaataaagagtcaactagtcagaaataggcaggggtggataaatgtaaatatgacattgaaaagcaagagtgcacatggtaaaatgttttttaaaaaacattaaggttaaactgtataatgttcagggccataattcaatgtcttctttataaagtaggacatgaaatttgttttgggttggtggtcgtcagccttaatggaacacaggtaatgcgtcatattaaaatgtccttgcaatatcaggatgataaagcattcccattcacttaacagaatgcaggcccacgttttcagacatttgtatgtatgatgtatactcttctacagtgtcctggagaagagagtacaatataaaaattcacaaatgtaagggttttacctgttgcaatttcattttgatttaagaaaattacattcacgcaatgaggctgtggattctgtggtagggtcctcctggggaccagtcctttcccacccagtccccccaccaggccacctccaccccccttcccccatgggggcaggcaccccagagctggctctcacctgtggcaggcagggagccccctctggcagtgaacgtagggcatatgccatgcctgccacatcctcagcccagccctgcatgaaatatgaaatcaaaaaaacaacttcatcctgtcctacattagaaatcacattcacacagtttcttatcaccatcaacccacactgtatgcttttgtctcacctctactttgtatctcaagctctaggaagccttgagggggtagggagcaggtaaagctcactaaagcatctcttggctgcagtgaactatttgacagctccactttcagggagcaaagaagtggaaggttaggaagtgtcagacatgacaaaacattgaggtttgcaaactgcttcttgggatgtgggaatccggaactgatatcccctcccagggaggaagccctttctcctggtacaatgccaatttccatcgatgcatttaaccgacatgctgaaacatgacttcctgtggacacatctgcctcccctactccttgtgccctgctgagtctccagtccccagcttggaaaagcctggaaatctgagcttatgcagcccacttaatcctgggatcttccctaaaactaaggagagaagctagaaaaaggaagagaatgcaaatcagggtgtggggtcaacaatgacatattgcaaaaggaacatcaacaataacttgcaacatcggggagatattcttgaccttctgggagatggcaggggtactcctggcaacttaggcaggctgatgcaagtgccctcagcctggtggggaagagatgaactggggaagatgagttcatctcttccaccataccacttctttgcaggccccatgcgactggcttatatatttgagatctcttctaattcttgaaactccagggaggtcagcatttttattttatacagggggaaatttaggcacaaagatattcaataacctgcccacaggagacacctgtgcccttgactctgggtcctgttacttcatatctgtctttttttatgctgctgacattataccccctctaccatcatctcatcccctctcctttaatcctccatgctcagtctcccagatatgacctagcctttccctccatccttccagacacagacagaggagaacctggccacatctgaaatgagccaagaataaatggacataactttgtccttagaagtccaggtactagccacaccccccaatgctggatgaaaaggtgatttggtatttggagaataatgggaatccttcagctttgctgggaattgatttgagagcaacaataacaaaaaaggctacttaggaccaaaaatgtggatgatatagaaacacatttttgatacgagaaactggtgagcagtgatgtgttttccctaagaaagaaaggataaccagacaatagatttgatatttttattattgagacatagaaaatagctttcattttgaaaggttagttatgtgtatgtttgtgtgtatatagaagatttccaatgttatcacagtaaatgagaccaatttgtccagatttagtaggtccaatacaagaagtcatgtctaattggaatttctcgcttgtgtcaggaaaggatcccttcctgcaggtgatgggacaaagcttttgcactcctcttcctggggagaggctcaggccattatttgacccaaagaagtgttgtcagcatgggacagagaagcagcaaacatgtattgtctaaggctagagggcacagatccaggtaaaagatggaatatatttgaaagagaattggaacagggagaaaataatttgccctctccctagtcaatacagagcctccatgctggggaaagaaaggatgcagtttggagaggaagcaagagatgcggcagcactgtgggggctgccagctgatccctggagtcctcctggacaagcccccctccatggataagggggactgaggatgacatcccccttgaagatgggagaatggaaactccacagtttggctgctcttctaggatgactgcagtggctgagcaagactcagtgaagtctcctgtaccatcccagaatggcagccacagggcaggaacagtgacatggcttgctgggctggggagggctgggaggattcgtgtagccccagtgtggcaaggggtagctgctgagggtgttcttgaatgggtggggtgtgtaggttagctgaggaggagaaacgaaggacccagggctgcagaggggttacttggccagaagggaggagacacatcagtggagcacatggtgggagcagacggtgcctctctggattaaggagaggaggtggttggatttcaggggagctcaaaagggatggaggcaggtgtgggccaagacaggaccctggaccggagatggtccaatcaccaatcaccacgtccatgtgtgtcctggagaagaggctgcatagaacagagttgattctacactgagaaatggacaccacacccccatcctctgtgcgggactatacctgtaagacccccaagtttagcaccaactgcaggggcaggagaggatgaaggtgaggaacgtaaaatgtggccacgcttgcagactgacgggactgggaaacagctgaatttgactgggtttgcctagaaatgttgagattcacatttctttcctttctatttgttggcatcaggcaaatgagggctcagagatgaacctgaagtaaattaacaaagatacttgcacacaagtttgtgtcccatgaaattcctagttgtatgtattgagaatttggtaacaaggagaagtcagtatcttttaaccctttaaggccagactgtctcattctaatgtggatttccagggatttgacttttacaaatcccagcccagctataaatacaactgatggtcataatttttccaaaaagttcccccttgctgaaactgaggtgattctgtgaaggcctatttgttcctgaaaggagattaatactataatttaactagcttttcctcattgaaatcctaataatttgctaaattacaatgacagtgttttcctttaagtactaaatattctcttctgaggctgaatccattatagtgctaaaattctgaatttgttgaataattctctatattctaaaagtactcttgtgttagaagtatagtctgcaattaaatgattttcagttaaataatcatttgtgcattaattttctttatcaaattagccatatcctcagtttttcttttaacaaggtaaagtcaaattttaaaaccaaactcttccaatgaaaaatacatacaatgaatttggtacaaatggcatgtgattcctaaatttgtttctgaatttatttacaataccagggtgtctcattcccatgacaagagggtaggaaacacctcctgcactgaaaagcttatttagttagtcttatttttaccagtagtttattataaaaacaatgcataaaatattaggaaacggcatggcttttgctgtatgccccagattattctgtctagaatggattattatttgaattaccagattctcccagctggaaaggaactgtgcttggttcctgctctaggatttatgaaataatggggtggtattagcacaaggtccttcaaatgatggggttactctgcaatggatatagaagtcaggtgttggctcttcacatccagagttatgttatggatttacataactttgttttcaaaatttctaaatctattttgaaaactggtatctctagtcaagatgactagtgaagaattccattctgttagtaaagaaataaatcaatttaataagcacaaattttggttaaggcaatggcaactattgcatgtttagtgttttttgttgctgttgtttctttgtctgaattttaaaaatctaagtcaagttagggcaaagactgaattttagcccatatgtttatgcaatgctcaaaatattaatgtacaggcaagataatttcctggggggaaaacatttagatgtgtttttgtagtaagaacaaacaaagaaggtcaagctcaagtaaaagtgacccagaggaagcattcactgaagagattggaagaagcatactcattccccaactctcaagctatctcaaggattagtaattttcaattaaaaaatttctttaaaaaaggaaactttctgaacatgaaaaggttttttgtttgtttttactgtggatgtaatcaaatattagagatgtcatccttgtgtgcaactggtatctagaaatgccttctggggaactaaatacaaccctgttaaatgatagacagtgcatggtatgagactcaggctgcctcagatcttattctgagacccctgtgtgttccttagtaacagtgatgcatgaatacaccattgagaaggggaaactgaccacagtggaggtccaaaatgaaactgctcacactactaccctctaaacaagagtggtggttgagaggtgcaggctctgagccactacattcacagacatggaagatttggtgatatttttatccaatttaggaaaataaaattaattcagttgtttcttgttctaagttaataggcactaagtcagaaaacttttcatctacatatttttttttctctttaaacatagtgcctcatgggtggaagtgatctggacttcatgtttttcttttggaaccagaaaacatgccatttttggaatattaagcaatttctttcttttggatatggggagggagaaatctgaaatgtatctttagggcacagtttggaggggccctattgataagccctttcagtcttgcaactataaggcaaagtttttgctgaagtcttaggtagtaagttaactacagtgcaattatattttactaagatagtgtgttttattttctaatagtctagtataaatctaatatattagcaaattcttcagaagacagaatcttatttttcttggatctggatttagatgaccttactgcaaattattattgattgctggtaggggatgagtttatgaagacatctgtgtactagaggctaggagctgagcccagcctatgagaagggacatagagctgtgatcttgactttcataagagaacatatgttgttatgaacttgtgtttttgctgctgttgtttttgcttcctgctggtggatagtgatgacaacagcagtcctctaagtcacacattgaagatggcagaacagctatcagcctgggtgaattaattcgtggaggggaacttctgccttaacctgctcttaactgtgacatcaggagaaaataacttatctcgcttgggtatttgcctatgtgggggtctctttgttatagcagttagcactctcctaaatactatgctagtgtactaaaataaactctcaatcatggaaccctagccctaaggctttaacaagcaatgctggaagtgtgcttcctcacctcctccacttcattgcaaaaacaacctcatggatggccctgtgccggcacatactgctatagcagcatctgtaatggattttgtagacactttgtttacatgtttaccatattgtaagggaagagaccgagtcatattcatctatttatctcaattgtcttgtcttttttggcccacagttggagattttaaactgtttaattgatgaaaaaagatgtcaggttgatttacagcatcaagtctgatgatttaacaacagcattctgcacagaggggaactatgcaaaaaggatcaaagccactgaaattactaacagggccaaaaaattctaaccacttccacaaaacgactgctagggtttaaaatggttacacagctgggcacagtggctcacgcctgtaatccgagcactttcggaggccaaggagggcggatcacttgaggccaggagttcgagaccagcctggccaatatagtgaaactccatctctactaaaaatacaaaaattagctgggcttggcccaggctcctgtaataccagctcctcgggagactgaggcaggagaatcccttgaaccagggaggcagaggttgcagtgagccaagatcccaccactgcacaccagcctgggtgacagaacgaaactctgtctcaaaaaaaataaatagatagatagataaataaaatggttacatgctcctttgggagtgtgttctaaagccaaacaaatcccttcattctgaggcccctggtgtggtgctggaacctttgactcagggcttatgaatacttgtttgtctccaggactgaagaacagaatactgaggtggcatgtccggagccaccatagcgctgtgatcatgctgtgtcaatttcatctaagtttttgtgttagaattcctctgtgaagttgactgctcaggtgacaggttagcccatgtcttaaactgggctgaaaatgggtttcatgtacaggtagttttacaagtgctctcagtgcaattggtggactaggacttcccattagggcagaaggccccaacccccgggccgcagaccagtattgtggcctgttaggaactgggccgtacagcaggagttgagtggtaggtgagtgagcattaccgcctgagttctgcctcctgtcagatcggcagcagcatttgattctcataggagcacaaaccctattgtgaactgtgcatgtgagggatctaggttgcatgctcctcatgagactttaattcctgatgatctgaggtggaacagtttcattccaaaactattcctcgccccattggatccacggaaaaattgtcttccacgaaactggttcctggtgccaaaaatgttggggaccactgctttagggataggctgtgtctgctagacaccaaactaaaagtcaatttaatatatgattgagcccagtaagttcagccttttttttcttttttttttagtgctttatagatgctgcctccctgtcttctcactggcgttgttgctgataagaaatctgcggtcttccttatcttgtatggaacatgtcttttcttcctctggatgctttgaagattttctttttattgctgactttgagcagtttgattttgatgcaccttggttttatttcttcatgttccttgtgcttgaggctgtttaagctgctttgatctgtgagtgtatgagtttcattaaatttgggaaattttcagtcattattttttcaaaaattttttcctattctcttcctcctttctctgtcctctcattagggtactctgtctacatatagcgggtgccacttgacacccacagatgatctgtacctttcttttttctttctgtgtttcatgctggatagcttctattgtcttcaagttcactgatcttttcctctgcaatgtctaaactgctgttaatcacaccccatgtatttttcatttcagacactgcatttcagactctagaggttttatttgagtcttttatacattttccatgtgtaacttttaaaatgttttgaacacatggaatactgttataataattgcttatttgataattttaacatctgtcagttcttagttttcatttatttatttttctccttattatggattgcattttctatttacttgcaggatagtttttagttgtatgccagacattctcaattttaatttgttgggtgctgaatatttttgtattcctacgggtatcttaaagctttgttctaggatgcagttaatttacttggaaactgttgatccttttgggtctaatttaagatttgataggaaagactagagcatggttagtccagggctaattattcctctgtactgaggcaagaccctactgactattctccccagtggcccatggattatgagattttcttctctggctcttgagaacatgcactatatgcacccccacatgagtgtccgatttcattctccctaataatttcaggtgtttctttcccagccttgggtatttgcctcagacacatgtgctgagagttctctgttgaatatttaaggggagtcctctgcacatctctagggttctatgtgtggctctctcctctttgatattttgtcctatgaactctgatcactttgatatctcccgattccccgatccatctcctgaacacagtgagtctaccgagatccccctggtccctcaatcttcataccatggcttggaaactctctctcaaggtggtgagctgagacaatcagaggactcaccttcttttgtttcctgtctttcagagatcattgtcctttgctgactaatgtctagtgtcttactaaaaaaccccaatgtttcacatatgtcttttctttgttgctgttgtttttccttgaagaaaggtaaatttgaaccttgtcattccatcttggcatcttggctggaagtggaaatccctctggttcagctgtttctacaactttaaagttctgtaatttagaactttagaaatcagatcatccaatgacagtactaaaattaatgcaaaactattaaaaatgggttttctccatttatcgatttggatgcatgtggcatttgcaacacagatgtggtctttgctatccgtgctgcttcccgggtcttgcagggaagaaatcactgagtcctgtgattaggaccaatgacctggttgtggccatgctcctcccatctcctgctccacagagtgggtctgttcttgtcctgcaacagactggtcattgcctgtgtctgagtgtaccatctccaggacactgctgactagacagggtgctctgatcacctctgtgtttatactggcctagtttctaattgatgaggcacgatgcttcgcgttgtattttcatcacagtctttcaaaactctgtttctttacatttaaatctaaagcttggcatcacaccattaactagaacaaagacaagtcactttgtcttagacaataaaccatgattcttaacttgcgtttgatagactccactaatctgccctggttcacttttacatgatacactacctactaagctatgctaaagtcagtctttctcaaggctgttatctctctctctaaggacaagtctctaatttcccagttctcttgcattttttattcatttggggcacacggccagagattctgtttccttcttcactaagtccatgttgctattacgttagctcattaaatattaatagattaacatccaagtctctctttgttctgtcttatttttaaaataaatggcaaataacagatgctttgaaaagagtcacactttaggaggaaaactgagtgtacaaagattttaaaatgtttgacttcatagcaagtacagatatatttctacagttcaaatcctgggttttcagaaagctcaagtacaatagaaataatccataaacgggagttaaaagaacattcgttcacattttggaaatcttcaaagcactatacccaattgttttaatagtctgcaacaaacaaaatcactgtactataaatgagaaaaaggtaactgaagtccatgttggcaatgaaaaacatttatcactttgcttctgccataataacattatgtttttctgatgctcataaaccaagtaatgagtgttttaaagtttaaaaagtgtttagggccattatgaatatctagtttgctagtcaatttgtcacagaaaaagagtgtgcatgatcttcctataaagagaatttattgttttagatgatgaggtctataaaaagctgtctccatgcaaaattatagtattttacctctacatttctgtttttgttgggtcataaaaagttaagaacactaaagaaataccactaaattttaacagttgctataaaaatgcattctttgaattctagatttcagatggtaacactatatgctgttgtgtatcctaactcaatcttttaataattcaatacttttttctgaaatcatctttttaaaagtaaggatttatctgtttggtttctggacaactcatcctttgtcttcttgaaattataataattcatcattgcttggcttcatgataatcttctgaaatcttccctaagaattgtccacttgctcttcccatgaaacatggcaaaatagtatattatacaaaagatgatgataatgtgactgatccctatatgtgtacttgtattttgataagaaatgtttatatatgtatgtacatatttataattactcccaaatattacttatcagcctctcgtcatgcctgagaactatcccattatctagaattattagggaagcagcgcttctcataagcaagactgacatcctaagaggcaaaatcctactttaaccattgggatggaaatcttttgcaaatgctttctgtcttctaaaattactagtaataacattttcttgatgacagagggccaactttatgactcgcagagtagatggaacagccatgacattaaatggtctctgacagtttttctttcttgcattcttatattcagttttcctaactcctctgtcttttctctttgccaccacagtatctactctccctccttatgatggtctatgtgtctgcttacaagagttcttgcttttttttttttttttttgagatggagtctcactctgtcaccaggctggagtgcagtggcgtgatcctggctcactgcaatctccgcctcccaggttcaagggattctcctgcctcagcctcctgagtagctgggactacaggcacacgccaccatgcccagctaatttttgtatttttaatagagacagggccaggatgatcttgatctcttgacctcatgatccatccacctcagcctcccaaagtgttgggattacaggcgtgagccacaacacctggccagttcttgcattttttaacatgttgatttccgataaggacagggaaatctatggtcgtcattgttaagctttgtctaaaacagaacagcttctgttatgctgactttggctattctagacctttctgccattttcctattattctctactcgcttagcagtagagaaatttaccaaagaaatgcgctctggatatgtggaataactgtgctgaactaatgcacagatttattgtgctggaaacagtaagaggctattgccagaaaatattaagaataattatcatacttcttccataattcccattatgtaaagtagaagagactcttaaaatataaaaatagtaaatgctttttaaacttgtcattttcttactctacacacctaaagatccacacatatctaagcagttcttgcagctgatctggttgcccctgagatacggaacctgcaaacttacacggaaatctcagcacagtaggaaccgcagaactggccctttgctactgagctctgcaacctgcaaaacattgttcagtctgaacactgaaaagaaaatggttctctcataacttctttctatcaattttacattgtattgacagtatattgccagctgaaccaaagaatcaaaatatcataaaatgtgaccatctgaggatggcctggaacataatatgtgctaccaaattcttattgactagtagacattaataaatagaaaacactgcaaccctcaaggaagacatatagacatggatagtaattgagaaaaataatcacatttgaattttttcgctcagccaatcacaggggtagtcagtgggacagaaagataaatggggcttggtctgcccataaggggcgtacagactaaattctcttctagaggacagtcttagcagctcagaaggaatcattgtatgaatgaatgattagtgccactgatccttaaatttggtgtttagatgtggcgcagttctttgtactttaacatgtcttttttatctgtccgcttttaggattttttttctttgttactaattttgagcaatctgattaaaatataccttggtattttttcttcctgttttctgtgcctggggctccttgagctgcttagatctgtgagtttatagttttcattaaatttggaaaattttcaaccattattttttaaaatatttttttctgttctctttcttctctcatttggggactccgtttacacatatatgaggtcacttgaagctcactgatgcactgttcattttttcttcttttttctttgtgtttcattttggatcattcctattgctgtcttcaagttcactaatcttttattctgtaatcttataatctgctgttaatcccattccacataatttttgttcaggcattatattatattatatttattatactttaagttctgggatacacgtgcagaatgtgcaggtttgttacacaggtatacacataccatggtggtttgctgcacccatcaaccgttatctacattaggtatttctcctaatgctatccctctcctagccccccacccctgccaggccccggtgtgtgatgttctcctccctgtttccatgtgttctcattgttcaattcccacttacgagtgagaacatgtggtatttggttttctgttcctgttttagtttgctgagaatgatggtttccagctccatccatgtccctgctaaggacatgaactcatccttttttatggatgcatagtattccatggtgtaaatgaggcattatattttaattctagaagcttgagtttgttcttttacatatttttcctatttctactttttgaacatatggaatatagagttgaaaggttgaagtcttacattcaaaatcttctagaggccaaagatatttctccacttttaagttgttattattacatgataatgaaataagtatttctcaaggaaaatgataattgataaaaataaaggaagagagaaagaagagagagacagagggagggaggaagagagagagagacagagagagagagagagagagaaacaacatcttaagatggcacacctgatttgccacaatctagatctttgtgtcttagtcaggctgatgcctgaagcccagagcccattttcctgtacccatctagttagtgctgcaaggcaggggagctgggtagggtcttttagctcatgagcacgtgagtggtcatgggcacatacagtgtcttggcctatcacatcttgctaccatccttgcatccagcgttgtgactgatgtgcatgatgtagagtgaggcagccctgattttctctgcagatgacacatctgagacacagtgatatgctgtagtttgcccaggctcaccatgctcagaaaaggtggagcctcggtttgaactgtgatttgagtcaaagcttcctagatcacgctaaatttagagagacataagatgtaagtcctcattccaggaagtgatttccattagtatctctttcctgctcctgtaagactatgcttgggatgtctacctggtgcaactctgcttttgaagcttttctctaccaatctctggttgcaagcaagagatgtgtacaactctagggctgtctatgggcagggtgtagaaaagggctaattatgcccattcctaagactcttaggagaagaagtgggtctggcatggggcagcggctagctctgtaggaagaattgtcagggcctggcacccatgagctgggatggcacacttgagaaagaaggaagttctgtagcttggactgtagtaatggaaacaaaggatgacagagagaatgacaagaaggcagacatccaaaggaataagcaaaggggagggtgtagttacataatgttgaggccagggtgtggtgagtgtgtgacatctatggccttgagcttctgatgtccgtgtgtatatgttaacatggtttggatgaaaataaatgtaaaggaaaggagtgattgatgaatatcccacaccccaggatttgatatgagattaatggaacatgcatggcagaagtgcaaactttctctcttggtattctccccacctgccctcattcttctaataggtcaaacttttttatgcaacaaagcaaattagcgcattggtgaccagactcaggaatgaattactatggtgaatctctttttgcccaaaatgagtgttatgaaaatcaatcaggaacagtgttagtttataaggactcagaaaaaggctgttctaatctcctctccaatcataaatttactttaacatgtttgccaaagtcaactaacaatactattcttctctgtaagcccatgctttaaaaacataaggggttcttttcttttcttttcttttcttttggggctgggacccggtacattttaagtgttcacatgggattttacacaggtatttgagcattaactctcttaccagttaatgatagtgctttgaaaaaatatcaacctgtcacaatctgcactgaaaacaaagtagctcagctacaagaatagaatgaaaaacatttcacagcattttcagtgactataaccacatctagtcctctctgtttgtagtgatcttcaaggactcctgagcctttaagatcaatttttaaaaggaatacatttccaagtaaaacagttcaatataatttttttttctctaacatcctagaaatctttattagagttgcatttctcaaaactggacttatattgttttctgaggagttgctcataactccagatttctttttattgtaatgaactggccataccttccagctccctgcagccaagttctgcagggcgcctgccgccccttccagcgtgtctggatttgagcactcagagagcagtgtgaggtagggtttgactattgatgggtgccacagcatctggatcccttttggtggttcagcacagtctggaagaggtcctactccatcccactggcggaagaaaaacaagagagcaaacatctttaacatctttatgcttcccaactttgccttcctcaaacattacaggcgaaaacaaaagcagagtgctatcacatttgctgaacatagactgcacggaggctattgcatcagcagtccagggatcactaaaagtggaagccattcctgcccagcgagagcttgggatcgagggtggagggtgggttggtgtatgcacgcaagagaatgtaactggcagaagaagtggataagctctccaagaacgactctaacatgttgctgtaggaaggaaggggaagagatgaattaattttgattgagcagtttggaagaaggataaagatcaaggtagcatattttatagtaagcatactaccagtgttgcataatagttaccaacaacaaatgccctcacttcttatgcatcattattaatgtgataaactcctatataatttgttacatgtatacaaattgggttctattgttgcatctaacaaatgacagaatcgataaaagagagaaaactgctatagtctattagacacaatgacatgagctacaggcaaatctagatcttggagcaatcatgatagttaagtttgctttgaattgaatctaatgaataataggataatgtgtaattcaaaattaattacccataatttagaaattatggcttacacgcacaaaggaataccagtcaaccattaggaatgatacttatgaagactatgtagcaacttggacaaattataacaataaaagttaaatgagcaaagcaggatgcaaagtagtatgggatttgcacattattccaactaaaatgcatcataaaatacctgtaattatcataaaaatttactaatacaatgtcttttttttctacatttcaaacttcctgttctattactcttaacaatttaaaaaacactaaaaattaaaataatgattctgatctttgattacacaaaggctttgtcttttgtgaaaataatgactataataaagttagaaatgaaagatgctatgcttttagaaaaaaatacacatattcagttctgagaaaaatcacagtaaaataaacaatttctttataattttagtgtgagaacatgaaggtatttagcttattagtgtttattaatgattacttaaaaatacagtgtaaatgacatatgctaaatgtacttacagatattttatgtacatacatatatgtgcatgtatataaatgtgtgtgtgtataaatatgaaaaacaaaaccatatttctgaatgtaagttccttaattctgaaagttttactgcaagaaaatacatgcttactttttatccttgcaacataaaaatagaaaagtagacagagatggctgctgtcacaaataatttcaaaaacttcattatttatttcttgaaataagctaaactgcatgtcttcttttcctcaataatgacacagcttagtttaagtcaagggtaaagctcagagatgaatgacatcccattaaaggtcattttcaatgaacatgtcactcaattttaactttataacaaggacactcagtgtgggaagcttcctgtccttttaaccaaagccacttcctaactattcaaagatgactttgcacctgtgaactgcctatcaataaaaccaatacatctcctttaaattaaaaaaagaaggaagtgaactagccccgtcacattgctcctagttcattatttgatcctggcttgctgcactgaatagaaagtgggcactagaaaaagacagtagtcattctgtaggtttgccagtttcaatgacaaagcagtagcaatattggcctctcaaaggagaccagcttggggtagtgaatctatctgctagagtaacaagaaatggcaaattatttcttttatttcattttatatcttgtctccttaaaaatttaaagcaattattttcatataaaaatggataaaattcagaaaaataaaaatgtgaaacttccaactcaacatggatagattttccttttatgtaagagctaacctaacagcaagaggtacagagaagtaatatttgcatgctcgttacaaaaaagaggaaaaagtagccatgttatcttttgctgggtttcatcttgttctccttttctaacttctgtgcaataaagcaggataaatggttaagtccgtagaaaattttcctcaggctctgacatgtcatctatgtagctctcaaatatcttttattacaatcctttcttaatggctacagagagaatctgaaggaataaaaggacaactgatgtgaacacagataatctttgatggcaactggagatggagttcaaaggggattcttggctattttagcacgttgatattgaagaaaaaggactatttcaaagccagtaaatgtatctgccagacctttatctgggtactttattcaaacttttattaagttaatagggagaaaagtatcataagttaatagggggaaaagcccattaaaaatagatttccatcagctgtaacatgactggacgtattctgtaagacttgggttaacatgcttgatattattttgtctagctcatcaacatcaacaaggtagtagggcaatggtgaagttaggatcagactgatgtaggtgagacaattctgcacatgcaaacttttgaggctcgaatgtgaagattcaagaaaaatcatgggatatacaactcttgcaccaaagtagaaatacttgatttacaaatttaaatataaggtgcttctatcctaaaatatctacaaaaatgggacattatcagaaggcaagcaagtggcttaatctgtaacataattgaagcagtgaccacacagtgattcagccctgaagaacacaagactaaacttacaaatcttgtgcaaactgtgttcgttttggactatatcttgagaacctactaccaaaaactctttaagagcttgaaatatgcaaagaatacataaagaagtaaaatgtcatcaagtcaggagagagaattttctatataataaagagcacatgaagacaaagtatttccaggacagcagtggtggcaatgccagaaaaggactttttattatgttatctgcatgacgaccacatatgtgtgtgtgtgtgtgtgtgtgtgtgtgtgtgtgtgtttacatcttcactcctcaggttgcagtttaaaaattaagcagaatagagaaagtgagagaaatagcacgaagacagaggcatttgtggttttaaaaaagcttttttgctgggtttcatcttgttccagcttgggggaaattttcaatgaaaatatcccttcctcctcagaattttactccttatgtttgagagttacataaatgttccacaattctgtgcaacatgttaattttcatctgttatattttaacgaataaaatttgcaaaagttctagtatcccttgagtcttacagatattacttcaatgttcaaattacactttgtgcaagtcattcacatgctgttgaacaggaaaacagaccaaaggatatatcactagtgtaatactgaacctcctcttatgaattgtcttgttcatagaaatttctaattttacacacatatttagagttcataaagctaaggattaaggtggctataaccagagtgtttgaaaactgagtaattgagaattagagctctgttggagacaggctggtagcaaagcagtgagtgtacatagatcatagaacaaaccaatagattgattttttgccactccaaatagtgcttcacccaataatgtatcagcacttttctttactggcttcaaatatacaactgcatgactaatatccataaaaaatcagccaacagtttctgtcattccatttctaaaactgtatagaattgaaaatatgtattctttcattaagaaggtaatgctcaaaaatttttggaaaaaaaagaggatatcaagcttcccaagatagaaggttaagggactgctgaaatttagacatgatgctttttgatatggtcaccatcggcacagagcatacataatggcccctgtaaaaaaaggtctgcttaggaaggaaataacatatgcgtggggctgtgctcaatgtgtatgttacaaagaaagaaaaggaaaaaagcctttctttggatttgctttaaatacttttgcttccatgcagggcttaaattctatttaaaagatttttttttttttttttttttttttttttgagacagagtctcactctgtcacccaggctggagtgcagtggcacaatcttggctcactgcaacctctgcctcctgggttggagcaattctcctgcctcagcctcctgagtagctgggattacaggtgtgctccatcacacccagctaatttttgtatttttagtagagacggggtttcgccatgttggcctggctggtcttgaactcctgacctcaagtgatccacccacctcggcctcccagagtgctgggattacaggcatgagccaccgcacccggtctatttaaaagagttctatctcagttgggtttgagaatgaaagagtggaagccatttgctccttatatgaagagaaagacgtaacttagggataaaaacctgaaagtaggctgggcacagtggctcatgcccataatccgagcactttgggaggctgaggcaggcagatcgcttgaggtcaggagtttgagaccagcctggccaacgtggtgaaaccccacctctacaaaaatacaaaaatcagctgggtgtggtggcgcacacctgtaattccagctactcaggagactgaggcaggagaatcacttgaatccaggaggtggagtttgcagtgggccaagatggcgccattgcactccagcctgtgtgacagagcaagactgtctcaaaagcaaaaaacaaaacaaaaaaacccctgaaagtaaagatgtcaacatactatattaaaaaaaaaaaagactttgtaaacatggggttctttaagttatagagagtcacaggagtactctaattatcacattcataaaagccccctaatgaatgagaagaattacaggacaatttacaagactcttctctgtgagccatcctgcaactgccctagtctctgatctccaatgcactgggctgggtactgaggagacaccaacaaggagcagtcagggagtatggagaaggatttccatttcaggagaagtgctaaaatacacagctcctctttccacctgtcacaggcttcatacagtctccgccaatcaagtttgtgtgcagaaaagaccttttactgctgagtcgtatcttcagaacataaacagaaaaggctggcttcaccagcggaatgcacctctatcacctagatttctctactaattagggagcatcacagtcattacatatgtgcaggctcactttcattttttaagatatttcagtgaaataaacaacagaccagagatgctgcaagataaaggtagcagatctgcagcatcagggaaacattctgattttaagatcccactctttcctctcaggggaagtcacacattgcaaaatgtaggaagagaagatggctctaagtaggtaaactgtcagagaatgttctctcaagcagggtttggtttaattaagctgcagccagcactatgtactttaaaaagcaacaataaaaacccaagtccatccaccgtctgccactcttgcttggcttgctttgaacagcagagttattacataatttgcctttacagtgtttcatggccacttccagcttttggggggttaaaggtggaaggatagaggtgatgggtattcaaaaactccagttaactgtaaaaagccagcgagaaatgattctttgtgttgattcttaggaatttcaaagaaaacggtagtgcgggtgtctgaatcccccaggagctgttcagaagacttcggctgcagctgaggctgaggctgtgcaaagaggggatagagttgatggctaattagctgtatttatgtggcactgcattgtctccaggctctccttgcaaaagacaggagggactttgcatttgagagattagaaacccgcattaaagaggcaggatgaggtgctgtctgaacaaagcgttagggcaaaagagattcaggaatagccttgctgatgcacctcctcctgtggggggccacggggcccggtgagcacacatccctcaggagtgaagctggtgatgctgcctactccacagactggcatcacgaggccggccactgtgctgtgccccacagaagacagctgtcaaggctgctccatatgactgggcctgcctgtcccttcccaaagtcactgtgatggaaccaactggggcatcactgatgctcatctagaattctctctgctcctaatttgccatccacatctagggaaacctgggacatggccgtccctgttactgccttctaaaggggctttgtccctgacgtgccaacctccttcagataatcctgtggtcttggtttatatgtttggtaatatgtccttcgaaggacaatctagtccaatggtctcaaccagggcaattttaacacccagggggacaagcggcaatgtctggggacatttttggttgtcatggctgtggcagaaggtgctactggcatccagtgggtagagtccagggaggctggcaaataccctgcaatgcacaggccggctccctggaacagagaggtatgctgccccacatgtgaccagtgccgaagccgagaggccctggtgaagttgtaaaagacagtattgatggtgtggaaggctgagagataaaatacaattaagaaaactaaacgagacacctgaaacagagttttaagtctataaactcactgaaactaaaatagcagcacttttaggtgatgggctatatcttccactagaggtgagaaagaagtagaagaatatggttcatccatggataatggcagacgagagttgctgcgcaaaaatgcacagccgtgatctttgcaggctcatgagatatgttgcttccaggacatgaaatatcatgccttgagtcaacaagctcccagcatatggtgaggtgaaggccgagggagactgtactcgaaccagccaagaggaacgggcggcagctgaaagaagcagatggttagaaaggaaatgatattaagcggcaaaagaaagagtatggttactaatgagaaaatgaaaactgtctggaagaaaaagaaaaacaacctgtgatattaggaaatgaaagcctaggagcatccaaatgtcatgaggagcagatgcatgaagtgataataaaaaatcaagtccacgaacagaaactgtcactgacatttagagtgattaagataaattctggtttgcgtattgagagtcttaaaagcatgcatttggtctagctatttcacttctaagaatgcactctcaagaagtgattaagggggtaggtgagatttaactacacagatgttcattacagtttacattagtacaaacttggaagcaacctgattttctaggaataggggattggttcgccacgtcatggtattcctctaccatggaattcacagtagctcctcctcattccagtgtgaagaactgcttactggcaaggaaaaaagtcagtctgtgtcaaatgataagctgtcataaagtggtcagcaaagtgacatagagcagacttgtgcctacaccttcccgcccatcagtggtgtgccaaagtgggcagtgggggctgtcacctgggggcaggtaataagaggctgcactctttgcagggaatgtacaggtaatgaaatgaatacaagttgggtttttgttcactaccatgtgcagacaatgctacacgatttcactggtaagagactcctcctcacaaggagagccccctactcactgcacaccctgaatgggccactacatgcctttttttctttattaagagaatgcccaaggttcacctagggtcatagttgtcacaaaagactacaatccccagcctccctcgcagctctggtgccactacgagccagtctaggccacagggatgtaacagtgatgtgtgcaacttctgggtggggtcctaaaggaaaggatactcctgtcttctttcccccatttctgctcctgaactgtggatgtgaagagccagaatcgtgaccatggggaggaaggcagcaccctgaagatgagagccccataaaatacaaggagcccacctctgaagactcaagagaccggagttctacatcagtggaaatacacttactaactataagaccttatgaattttgctgtctgatatggcctctaacagaaaaacatctgaaaggatatatgcccagatgtaagttgtaactatgaatctctctagaaggaggcacgctgaaggtgtgggtattattttcttcttggaggttagtgctattttactcacatattatttacatgttaactatgtaaatgtatacctagatatttatcattaatatctactttgtctgaaatgagaagaaactgttaaagttcaaatctccattgtggtcattttaactactaataaaattcatgtttgtgctttgggatatgcatgctgtttatttagccctagagtctcacttttgggtcaagagcatccgaatgacatagcaggcaacgtgtgaggctcttgaagaagtggtggccaataccgatatcctgaaaatccaagaaaaccttgtaggtggtgggatttcatgatttctcataacaccttcagtgcaaagaatttgtttagtctggcaggatcaaaagtcctgcttctccagggatactttttgacacatacacatatacctttgttgcatataaacttaagttcttagatgataacagtaatttagatggtgcatttgttttggtggtgattgcagattcagaatactgactaacagtgagataaatgcagcactgtcatgagaggctggggaacagctcaaaacacagggagggaagactgcggaagacgcttggctcacagcagcccttggggcaaagtctcaccaggaaagaaacagatgagtctgggaaaagtcacagctatgagcatccacccacaattaaacccacagcaagagctaggggccaccataggccacagtgtaattggggccaggcattgggctagaagtcacagaccgaaataagacccacagagtcctttgccccagaaaattcgctctctttggggatcaattgctatacttaacccataatatgataataactagcagagaagtttaaataaaattatggagaagtagattagggagtaattgtttacttgaaagaagtcttggaaagatagaggggatgttttatttgctcttgaatgattattctccaagtagtgagtggggaaagggagggccaggcagtggaacagcatgaacagaagcgtagaggctggtctgcgggatcctaagacaggccaggaaagagtgcgggcaagaagccttgaaagttcttccaagacatctctttcattgtgggaaaaataagggggcattgaagttttacacagaggcccattcctactgcttttatgcataaaacagcaccgtgtatatcacaggtgaatcttccagtcatttatgcatttggcatctacaacttaacaaagaggtgaaaaagagcaaaaatatttactgttaaattgactacagtgcactcagttgtgaaacaaagatgatcatgaaagaagacctaccagataaaaatagtggatcagaatcctgtttgaattgataggtttgtctcctcacccatgcagacagacatatattttttacccatttaaattaaataactttaaattgatttataagctaaaaagggaggttttggattccatcaggtcctgcttatttagtttttgtttttctcagtggccctctgcccatggtcaatctcacaccaacagcgccttgaagaaggtctgacctgaccagcagctggtggaggacaatgtcccgtcacctccaaaccacgctgaaacagtacccacctcaggacaccatcacaggatcgttggccatagaccaaggtgaaaacaaaccaaaaaatgctgattgctacaaaaggtgcaaaaagtaaatgaatccattttgtctcctcctatttccctggaccccaatcttcggattccctccaccaaccatgcagtgacagtctgctgtcataaagccctgctgagggcagagagggtccttctgggggagacgcgccttcttggcagatgacatgctgactgtttcatgggaggttttgtccaaaacggactagagaaactagcaattccttagaactcagcaacaggcacacagcagatgcaaaaatggatgagtttgcaaggacctcttagaccagaaagtgatgcatagagtgtcaaacacttctgcacacaggagctcgtagtctggtgcttctagactagaatggcctagaagtctgatacttctagtatggttcaatagcaaccatttcttgaactaacagcatgcatgcatcatatttttgtatcatatattttctagaattatccctacagggatttttttttaaagtttctgagatttttcttatagctaaatttgacatgcagaatattatagtgtctttttaaggtcaagaacaccaatgccaaaggtaagggtcaacataaatttctggactagaaaaagttctagaggccatcattaaaccaattattatttgtatcacttttactcctgttataatatttggctcctctgtcctggaaggtctgtgttgtagactagataacctttcattttacataatgtcttacacctttcagtgaggtataaatttctctgaaaaaaaccatacacttttataagcatacattaacttagtgcctttatgaacattattttttaaaggccatttgcaaagattacaaatgtaattttcattgtagaagatttataaatacagaagtacaaaaggaatcaatcattatcttctcttggatcttactctgctttttcaagaaacacatatattttgtacaggcaaatagcattttgtatttgcatatgacatattatacaaaactggccagattgtatctgtatcatctatacctatatctatgtacgcacctgtttttatattgctttttttcactttacttgtgaaactctctgtaagctccttgatgagataaatcagtttccaggccctgaagttaaccgctgttccagtgttagcaaaggtggggatgctttgtcctcccatcgctccctgtcctggtggggcctgtggtgaggggtttggtctctcatgggctccccaagacaggagcagagactgttctgatgcatcagggttgtgagttgctgcctagcggccttcgttttgctgcaggggaacctacttcccgctgcagcaggtgagggccattctgttctcaagaggcctccagctccagctcaacattgttctgaattcacctgaattgttccccacggccaagcttctaatgccatcctgtggaagggctgtgaattctctgttaccccatttccaatggaaagtgtgagactgaaaatctaaatgcttcgaaaccagcgattaaatacatgatggatctttggcctccctctgtctctctctgtttcccttcttataccacatctcctgttccacccatccctgtcacctggatggcatcaaatccagctccgacaatgccctaagtaaatgtgtgaattaacacagcgcctgctcagaggtggaatgtcagagcttgctagggcctcaggtgtctttttttcttttttaagtaatttcctatcctggctcaactgcgagacgtgagggaaatcatttcatgtcccaccgtctcagctgtgaaattcccacaggaaaattgtgcagatgcattagtgattttacctcctgatgaaaatgcagggctcattctctatatattgaggatatattacagttgcaattaggaaggggataattgcatgcagctgcaagcagcctgcatcacctgatcttgggatttctttttcttcttcttcttgccccagcacccagagctctcagcatccttgccattggcctcgccacagagtagcccgtccagctcgtccgtgcccatgtgctgtccctgagacgtttctgccgccagccggtacgagaggttccttaaaatgcacacacagttttcaacggtctgcagaaaagggggaaacagaggaaagaatgagtaaaactagcactcagcactccattcttccacctggaaaggcctctttctccatggacacatttctctttggaagtgtttagctgccagcttctgaaagctcccctgatggccacagtggaaaacaattggagaaacttagaaaggtcttaggaccttttatcccccacaaataaatgacttatcagcaatagttacttctataaacatctgttattgttgattgaaattcacttgtgagaagggaagaatgtacaaccacgagagatcccaaatatcatccactaacagacagcgccccacctctgactccctggctggggattggggatcgggtaatgaggaatcaaagacttagaatttcggtcagctctggtggggggcatatttactgcccaccggagcattttccgagtgtcaaggaggctacaggtgcaaaccagggttgtcccaggaaagtgaggggctgtgatcacctggggtgcataaatatttttagtctacatttttttgagatgcctgacactcatgttttcttagccaaaaggttaaacagtggttaaggacacatgttgtggagccagacacctgtagaaccctaggtgtccgatttagctgtgggactttggacaatgcacttgacatctctgggacatggtgtacccctctgtaaaatggtcataacaggtcccacatcttaggttcttgtgcattagttgagctaaaacatgtgtgtggtacgcagaataatggccctcccagaaggtctacattttttttttttttttgagacggagtctcgctttgtcgcccaggctggagtgcagtggcgcgatctcggctcactgcaagctccgcctcccaggttcagaccattctcctgcctcagcctcccaagtagctgggactacaggcacccgccactacgcccagctaatttttttttgtatttttagtagagatggggtttcactgtgttagccaggatggtctcgatctcctgactttgtgatccacttgcttaggcctcccaaagtgctgggattacagtcgtgagccaccgcacccagcaggtctacatcttaatctctggaacctgcgcgtatgttaggtcacgtggctggcaggaggtgggaattgttaagctaatcagctgcttgtcagatggggaggttatctggattgttcgggtgggcctgtgtcctcacaaggggcctgtacgtcaaagaggaagtcaggagagtcacagtgatgtgatgtgagaaggacatggctgaccatggccggatctgaagatggtggaaggggccacaagccgaggtatgtgggcagggtctagatgctggaatagggaagggaacaaattctccccaagagcctcaagaaggtaagcctcagaccttaccacattttaattttatcccagtgagacccacttcagactgctggtctctagagctataagatcataaatgtgtgttgggttcagccaccaagtttgtggtcattggttatgacagcaacaggaaagtaacacagcgtgcaagtactgggaagaaagctggggcacagtaaatgctcttcaaatgttcatatcattaacagtggcaggagatggcacagtgcggagctccagaggatgggatctagggctagccggcttggcttccaatcctgggcctaccatttcacaagctgtggggccttgggcaaagtgcttaatctttctgtacttctatttcctcatttgtaaagggagggtcatattaacagtatcatgtacaggctgggcgcggtggctcatgcctgtaatcccagcactttgggaggccgaggtgggtggatcatgaggtcaggagattgagatcatcctggctaacaaggtgaaaccccgtctctactaaaaattcaaaaattagccaagcatggtggcgggcacctgtagtcccagctactcaggaggctaaggcaggagaatggtgtgaacccggaaagcggagcttgcagtgagccaagattgcgccactgcactccagcctgggcaacacagtgagactccatctcaaaaagaaaaacaaaaaaacaagcaaaaaaaacaccagtatcatgtacagagccacagtgagggttaataagctcacagatacagctctttgaatagtgtctgctcaaaactatttgctaaaatactagttgtaataacttctgattgttgagaagaggggtgagcaaactgccgcccaggggtccgatccagcccacagccggttgtgcataattggtgttttcctggaggacacccaggcccatttgtttatgaatggtctgtagctgctttcatggtacaatgcagaattacatggctgtgactgagacagtatggcccgcaacaccgggaatatttattctctgaccttttgcagaaaacgtttgctggttaagacaaagctgaccttttgactacaggaaccatggaaagcggagaaaaatatccaattttagaaggggtgaaacaatgatggaaaaaaaaataaactgagccaagttttatttgaagaatcttaccaagctggctatcattttttcaggcacctgctacgtaacagccactgtgatggcacataatacaattccattgtatgggtgaaaggaggacagctaaagctgtgagtacctcccaccagactgagctgcttctctgcagtcctggggtgggactggaatgggcaggggctgctgggatcacaatcctgcactgcttccctccactggctggaatctggtgaaaggtagcaggtgccctgtacttattaccgagggcatgaaaacttacgaggaaaaccagttttcaggaaatatctctggagcctttgtcattccagacctttcttgtcagcttttcaaggtgtcatgggctgctaatcccacaggctctgagtcaacctgattttctattccaagcatcctctgcatcaaaaagtggactggcacgaaagcaggtaaactcagggcgatgcatgaaagagagaaacgactctcattgaaaggaaaatgttatggcataagtcagaatgatctttaaatcagctcaaacttatttttcttacatcaaagacttgggagaataaacttctttctcatcccactgttcgtcttccctggaggcatcactgttcctctgtttaacaaatgactcctggggaataaatctgcagttgggaaaaatgctttataatcgagctgcagctggggagatgatttgggaagaagctagaagaagaagagaaagtagggatgggggcggatggggagggaggaatgggggaaagaagatcacagggaccacatttatctgtcatttaagcctccaggagttctgcagtctgggttggtttgggagagttacttaattcaagagcttttctctaaggggataaggagaaagagaagacaaaagacttgggatcctagcaggagggtggcagccggtagctttgcttgggacatccattgctgtcagcagtgctttcagcagttgcttttggttaccagggtcattttgattccttattttctattagaaagggttaatctggaagttgtagagtgctccactatatgttatccagtcaacacactggcccaattataggaccagagtcacaagcttgtatggaatccacgctcttttatgtattaacttctcaggccttaaaaagaaggtgtactcattcaaacccctcaccctcaatttgtcattgtgaaagctcaaaagcggccaagcagagggctgagtggaaaatgatggtacaataataatacattaaaacccaatagcacaatccagccagtgaagcacctgctgagtaacatcacatctgatcctttcaacagccttggcattcagctatgattatgctccttgtcacagagttgaggtcagttggatatggtgctccagccagtgggaggtggagatggcacagtccactggcactgtcttgatgccagctcagggctcttcttactccaccagggatatctgggttttctgactccagccctgaatactcccaattatttcaacttcctcttttggggaaaatgtggacattagaaaagatgatctaccaagtctcccaggttttaggaatctggtcatctgacagaaagaagatgtttgtgccatgttggttcttgaaccatggctcctgaaagatgccttaatctttggtgctggtggctgcacttagccaaagcatgaggctgttgactcttattttattttcagctgtaaggtccagctagtatcaaagctcttttcgtagccatcacagtaaaaggtatagtctcccagtgcctcactcaccactctgaatatgacgatgctgagcattgccgcttcagtgatttaccttcaggagccctttgaaaacacacgtgtctattacgctaacaagcacttgtaaatattcaagacatcttgactggtcacttgtttaggaatttaattttcctgtcgatgatactaaatggtctaaaatggtcacttaaggccttctgtgaaaggggaatgcttactctttgttacattatgttcatctttgaaactaaaaacacacagtcagtgaatggatgtgaacctaactgagcagaagttaaaagatgacaagtggtgctcataattggggtgaactagtactcaaagggctgacgtcccagaggtaccttgcattcagatctctggggagtaaggctcaggcatcagtgattttctaaatttcttggtaaccctaatatgtagtcagggttgagaagtgctatgctaacttatacacacagccaattaatgactacatggatagaaacacttttatttgttctttatctaactttgtaactaaattacattttaccagattcccaattagagagtcatattaaagctctatctactatggcaggttcttaatctaagatgtacatcaaattacctgatgaacttttaaaggtacacaaacttgtgaccagagttagacagttgggttaggaggactgcaatagggtctgtgcagatgtatttacatgaacactccaaaggcaattctaataaagagtcagaatgaaaaccataggattaaggtcacggttcataaccagggccaattttgctccctgcaggacatgtggcaatgtctggagacactgttgtttgttactggggtggggatgggggctgctactggtatccagtgggcggaagccagggaggttgctaagcatcctgcaatgcacaagacagtcacatgacaaagaataattcaccccaaaatgtcaataagggtggctcttgagaaatccttattaagaaatcacatttattacctgcattactttatgactattggtaaagtttgtgtttataacaggatattatgaaattacaaacatatgaatgaatcaaacttatttaagactaaataaaatagctcaaacactggaaaagcccacccaattctattctggcttgtgaactaagacactgaatagactttgctgatttattttgttgggaagccccatttatttagcattgtgacatttatttagatcttgcaggccttttaaaatggcacttagtgtaatcaacagttgttaaaaagcaagtttataagaatatgggattattcaaatcgcaaatctgggtgtggtggctcatgcctgtaatcccagcactttgggagtctgaggtgggcggatcacttgaggtcaggtgtttgagaccagcctggccaatgtggtaaaacccgatctctactaaaaatacaaaaaaatagccgggtgtggtggtgcacgcctgtaatcttagctactcaggaggctgaagcaggagaatcacttgatcccaggaggtggaggttgcagtgagccttcattgcaccactgcactcctgggtgacagagcctgggtgacagagcgagactctgtctcaaaaaataaaaaaaaaaagcaggtagttttaacatcttgtcttttctgttgaaagtggattacattaaaaaaaaaaaactagaagcttgtgagcaacgtggtattcaagtttatacactcaactggaacacctgtggtttgagtaacttagaacaatctgcatatttactcacagctaatcagaagttaggttatatatctagatccatgctagaattagaagcccagtctaaaagtgttggattcttataaggaaaccaggagagagttcagaaggaaagtctgaaatactgcattggctctccagggttgttagctattgttgagtcccgtgggagtctttattctcaaacatgtttaatctatgccagcacaaccaaccttgctatcgatctcactgctccccagcgcagactggatcacgtacagcaaggcatccgtaagcccatcacactctctcatccttctgcgggcctcctctccggccgaactaacattcctgcaaagcaaaaggacacgtcagcgatcttcacggttgtcaccaaaagaatgtctttccatgcccagctgctctcatagtttgaaagtaaatgcatttttccccactttttcagaatgcttatcaagaatatatctttaatgaaaagggatggcttccacaaaacacatcccagagttgggtaagtcacagatgtctgtaatgcaactcctggaatagacaatgaagaactcctaatacgggatctgtgagtcccatgaccgtggagggtgggggaccttcagaaagtcttctaggtttactccatgtacaatcagaagctttttgattcaaaggattcctctttgagaggtccgaaacactttcaaagacagaacttgtaacttctgaaatattttagacatctaaatttgtctgccacaaaagatacctaccttggcccagccagaagtagacttctaggacttcattctaaggacatagttagaggtttctgtgacaatttagtcattgggatgtgcatgatacctcttatgagaaggggctgctccaagctcttttctgtactagcacatgctgagctaatggcaacagatggggtctactgtaatgaaatgtgtggctacgaagcagagagatcttctagtcctacaagagacagagataatccgaaggaaaatcttggggtgcttttagttactctaccacctgagcatatgttgttcttctcctacccacagttagcatatggttccagtagagaatttctgcaatgacttactacagacaacacaacctgtaaaagggaggctgcaggagatgacttagtgggtggtacaaagggattgaaagaatttaaggaccttgggaacagtggtagaaaaagaaggacgattctcaaactttgggagcatcggaatcctctggaggtgtgtgcagtacagactgctggctccatgctggagtctctgactcagaatgtctggggtagagtcagataacttgcatatccttggtgatgctgatgttgagaactcagaccccagctctctagggagggtctggctgggaggagggtggtgttctttgctgagtgctggggcagccatgaggcagatcccaaggatcagtaagcctggacggagtctggagaagttgaatgaaatgaatctccagcccgctataattgacccaggtagtctcatttcatattcacaacatcttttgctgttgtaataaattctgttttacagatgataaaaccgagcctcagaggttgtccaaggccacacagtaagtgtgtctctgcttcagatggccaagatactggagatcaaacccagagaggaccaaggaatgagattttgaggaatcaatctatttgcaattagcctcccccttcacactctcttggctctttgaacctcctttactgatcaccattgattttgtattggaattatttggctgtgacctcattactgcaccgagactttctggagggtagaaggcatgtcagtcttacgtctctacctagcattcagctgaggaggagctggaacaaaacctgtgaagatgggaaagaaagggcttcaggcctgttgtcaaatatgaatgcagaatatgattttttaagaattaaaataaaataaaacaggtttcatgttaaaatgctactgaacatgaagagttttttgatacctaaaaagttccacagacgtgttaagataggctctatcagcagcatttttgtgtaacactgggaaaggttatacaattcaaattagtatttttggcatttgctgatcttcgaatataaacaaaatttctcagcttcctagataatataactaggcaaatactgacagcatttttatgtaaaattttataaattccatcctgtgatggccaacctttgtttctgacacaatccgtggtggtggccagagaggaactaactttctgctagggaaaaggtggtgacaggcatttggatattattttaaactaaaagaatggcccttttaaaggagcattttagatcattccttcttgaaatgattttcaccaggttgagctgtgaagctgttaaaataataagtttgtcaaagattctgaatcagacctctttggccagaagaactttgcatggcaatgtgtgattatgtttcgctctttagcgtggcaagttagcatttccaaatagaattaatgaaattcaggctggaaagcaacttagggtagcgtgtgtacaccctgatctgaaaaaaaccctctgcagctcttctttgactaatgtgctcagtctttccttcgagtatcctttttttggaggcaggctgcctcccaattcaccaataaacttcctaataatcagccctaatttcactggtaatcattaaatgcgcaggaccaaccaataggaaataatcaaaatgaacaacttaacatcagaagttgtcaatactaatcttagcgtttttctttattctagtttctattccattctagtccagtctcctccaaaatttaaaaagttattaattggctactatattacaatgtgtaagatattgaaaaatgagaaagattaataacttaaggtctcagcagagaaggggagtgactgagatacgcctacacccacacagcacctatgatatagacttcaagagggggttatcatgctgtctgcaggggtgatgaggctcagtatacatatagacttcaagagggggttatcatactgtctgaaggggtgatgaggctcagtatacatatagacttcaagagggggttattatactgtctgcaggcatggtgaggctcagtatacatacggacttcaagagggggttatcatactgtctgcaggggtgatgaggctcagtatacatatagacttcaagagggggttatcatgctgtccgcaggggtaatgaggctcagtatacatatagacttcaagagggggttatcatactgtccgcaggggtgatgaggctcagtatacacatagacttcaagagggggttatcatgctgtctgcaggggtgatgaggctcagtttacatatagacttcaagagggggttattatactgtctgcaggcaacatgaggctcagtatacatacagacttcaagaggtggttatcatactgtctgcaggcatgatgaggctcagtatacatacagacttgaagagggcgttatcatactgtccgcaggcatgatgaggctcagtatacatttttatataaactgtctcttttcaatgggcaatgatttcctataggcctctgggcttgggtttccacttttaatcaactatgcctcagtgcatgaaacatatcttaagagaatatttgattttcacattggtggtaaggagggtttcctgttcctccgtcttccccacagacacaagttctactctttcaaccacaaatttcagctttttattgttgttggttaagacttttgatcaacatgttaaggtgaagtcatgtcagcttatgattgaaatagcataagcttgttagtacatgatacagctataagcatcacgacttgaacacagctcaaatttttgtctcaacacctttactatgaaacttaacaagatgtttcactgtttaaaaataaacaccctgataaccttccgcgatgctcactaaatggttagttgtaatcatggtccttagtgtttgacaattaatcaatgttcaatctagaaagttcctccctcccattgtacttaaaccatcttctgcccatcatgaggaaggtgacttctatgtctggttagaaatgggtatggaaaaattctatgcataaacatagtattaaatacctgtagattatttgttagaagcacaaaaatgtgcataatatctcatccttattagtaacctttacaatcgtgactgaattgtcagttgctatgtcattgggaagttcctgctaaaagtggattctataatctttttatctaatagataaaaaatgaaacaattcatttttatgtcttccaaattaaaagaccaatctattttttattttaatgcaactaaactgcttcctttcccctgtcttctgtgctgcttgaaatctcatttctttgaatctccatcactcagtgctctcctaggacccaacgtggaactcagaccatatgttcacctgtatgactacggcattttccatgaaagatgtgtctctgcttcagatggccaggatactgaagatcaaaccacagggaaaaccaaggaatgagatattgggtaatcaatgtatttgtaattagcctctcccttcacacactcttagctctttgaacctcctttactgatcatcatttattttgtattggtattatttaggctgtgaccttattactgcactgggactttctggagagtagaaagcgtgtcattctcatgtttatacctagcattcagctgagtgtgtgacacatagttggctcttattgagaattcagcccttccatcggattggaattcaggaaagcaggggcacatttactctgtgactgactgtgctctatgcttacagaataaatatcagatgtttgttccagcatttgaatactggcttcttaaactgtaccttgtgttacaagcctcatcttgagttattcgaggcagtttcaacttgcaaaaaaaaaaaaaatagaagatgcaattgaagatagcatacagcatcgcaagtaaaattagttcaagatataaactttcttatgattgttcacaagtttgtggcctggagccagtcagatatttcccagtttctcacccgtctacaacctcaggcttggaggaagagctttcacagcctggctcaaggctaggttgtcttcctatgtctgtttcctcctctcctctctccctcaccttctccttggccttcagggtctggactccactggagttgtctcatacccagcctacttacatgtccttgagccctgggtccagccctgctataatcaccgtccatcaggtggcccagcccttcacatccctgggcaggcgctccctgagctcctacatctcatcttccaatttataaccatcagagcccagatgctgggtctctgcaggatctggcctgggttcctgagaccatatactagtttgaggagtggggtgggctgtctggagggtgttagagaacagaactaggtttaagtgatacagagagtcccaaggcaccgtcccgtcgaaaaatgaagtcacatacttagtacagccttgatgcaacccagcaaggcaggccggggaggcagaagacaccagagatgatggcatggaccagagaccagacccgaccctggggatacctgcgacccctcagggcagagctgagggcctctggacgcttgaccaaggataaggagaggctgtctggggttcccaggcccactgatccctccccctggaatgttcttccttccaccttgaagccatcaactctgacagtcgcagttgccagggctcaatccaagcactgccttttctaccttctaagccttgcctcagccccgctactccttccttcatagctccaggcacaagcttctcttagagcacctgtaacacacgatgtttgagtctggtcccacaaggcgttaggaggtaggggggagcatcatcttatttggttgtttgtgctccccactgtgcaggacacagtaggaactcactggatatcgactggatgaaagagcatatggttcttttcaggactctttctagaccagtggttcctaactaggatgactgtgccaccagggaatatttttggttgtcaccgctgggtgagtgttggggacattacaggcatctcatgggtagaggcagccagggctgctgctaaccatcccacaatgctcaggactgcccccaccacaaggcacaccaactgtttcgaggctgagaggtctgctctggatagctgggctccatgaggatctaatctacatgtgtgcttccccagcacctaacctgtgttcagccctgtggcttctcaaacctatgctcctctgctgcatcagaatcagctttggagcttgattaaaatacaaaggcgcaggcccttcccctatacttcgattagccccattctcagtgtgtttcactggtctccagctgatgagaacgcattccaaaggtgagaaccacggccttagcccacggtaggaaattcaatgtggaaaggtagagtacttcttgaatggccatgaagccatgtggctgtctgccgtgtgctatgtgatgtatagactctgaacaacactccccaggctcttcctaacaggatgggaccatggcccccacacacaccagttatggcctttagaccaatggccatcagcttctaacagtcaaccagcaaatgatgggaaataacactaaacttgtgaggggggatctcacaagtagaacataaatatggagcatcttaattttttgaccatgtaattacctgctcagaaattgatggaaattttttaactcatgacaatcttttaattcaacaacacaggcacccccagtaacaagatctccagaactcccagcctctcctgcctgctctctcttgcttaggctaagcagagactgaacagacctaatagctaccccttcaaagagccatattattagcagccaaatcgattatcaagtattaattacacgtaaaaatgcaaaaaattggctctttggagtttgatgcctataattagctcctttctgtggagaacatccttacatcctcgatggcttgaatttatcataaattacctgatctgagtaagtgtgagaatgggaaattatgccaatcatacttttctcgattccacgaagcacacttgcttttgcttcaaaaacattaaattttaaagagatcttctatccgtgaacacctagatcaggagttaaaaactctctgtaaaggatcagagaataaatatttcaggctttgcgggccacacagggtttctgccactttttcttctctcctcctctttctccttctttcaacaaccttttaaaaaatgtaaaacctgttcttacttgaagccatacagaaacgggtcactggcacgatcaacccctgaccgagattctcatctgaagctcagatataggattcaggagggtgtctgtgaactcctgatattttgttccaagttttgtatatttttatatgcacgttatgcatggttttttgtttttattttctgtgctagaggtacagaactttcagcatattctgaggctgggatcctaaactgtctaaaaacatctcaccaaaataagtggtttgagcagcccctgcttggagcagcacgctgctctcctaaatctagagtctgggtttcaggaatcaaatgtatttgcctcctcggggaaacggcagctctgccttgtgtcctcccacaaggccttgggaaactttgtctgtggtttccaaaatcattgtccaaaaagcccatccttttcttccgtgcaggaagattgtcctctttgttgagtgcccaggggtggggaaggaaggggtgtcttcgcccagccactgggtctgctgactccacctggcctttactggagtgacagtaatccagccacagcctctctctctaggtgcagaggttgcagggctaggggggcagcatgagaccctccaagtctgtccatccccttcattcttccacgagggctcatccctttgatttgtagcttctttgaaaaaagggagtggctggcttccttattattcaaaatgttcacaaaagtggcttctcctgtacctgctgcggtgcacatagctgcgctacttagctgtgaaggcgctttctttgctttggcctcctcatccgggaggtgctgctgggaatggtgtggacatcacaggggatctgcagtgacacagggcagctgctcagcgccgggctggtttcttctcagtaaacgttagctgagcagctgctccaccagagacctcccagcccagaggggagaaacatgccaggcgggttaccagcaccccacaggaaaagtgtctcccgcaaatgtgtgagaggaaagaacagaaggtttcacagtagcattggcaattttagtcatttattttttaaaaatcaaaaactaatgtaaaaatattaagacagcgggggaaatgtagaactaaaagtgatgtccacactcttcgctttcccttaaggaaatcactgtgaccatttggtgtttatcattcaagattattttccactcgtattaatgaaccatgtaggtaagattctgttttttaccataacaattcctcaggcaactggcttttacccctcaaaagtttatctctgtctctgttcatgatggtagctacagttattgaatgacttttggtatctcatggtataaatagatcggctgggcacagtggctcacacctataatcccagcactttgggaggccgaggcaggcggatcacctgaggtcgggagttcgagaccagcctgaccaacatggagaatccctgtctctactaaaaatacaaaattagctgggcgtggtggcacatgcctgcaatcccagctacttgggaggctgaggcaggagaattgcttgaacccgggatgcggaggttgcggtgagctgagatcacgccattgcactccagcctgggcaacaagagtgaaactctgtctcaaaaaaaaagaaaatagatcacaattcataattttttaaattaataccctgttaatgaatatccagattatttctaattttttactgtattatgtaatgtttggttcaattttggaggagatatgggctttagaggaatcattctaggaagataaaatagcagagataaataatttcaaatcaacaaagcagccaaccttgactgggtgcctgctttcttccatacgcaatgctaagtcctgggataaactgatgagagtacctggcttgtgacctttagaaggtcaccgtccagcaaggtaaacagacattatatttgatgtgagtaaccacgatatcatcagtatgtaactagcagtgtgaagaatttgggaacccatcttctttggaagtgacatctagatatacaacagaaaacaaatataggctgaaatggatgaaaattttactcttcatctgttttagtaaaatatttccttaagttgtaattctgtaaatgtagatatcagttattttccttcacacttacagcagcaagtcatgggtggtaacttaaaaaataaggacacggaacataataaacatgtttccagcaaaaaagcagctcatgcaatgtaaatggaaagtattaaaaatgcgtacttttagatgcaaagggcaaggcttaaagtacaggcacaggtttgggctaagttccaggtgaacagcctgtgcaaataccatccacgcacatccgtgcaggggtggggtctgcaggctccaaccaaggacaggacctggcagggagccatggcattctgtggcaaatgttaattttggcatataattctccatttttactaagcctggcatcctcagccagtgcaatatgtctactaaaactgtggctggctcatggtggaccaagggcaaatcttgttaatggccttttactcaaccacattctctgtgctaagtgcttcctgagatctggccacaggacagcccaggtggattgctgcaaatcctgggccatccctcaccagaggtaccactcctgcctcttgtagttccacggcaggtggaaatgcagttctgtccttgtcgttctgtgcaggtggaaatgtgtgacgtttgcacgatactcaaaagtggactgaagcagggcttcttcccccaccagcctgatgcattcaagtcccttacaagaggcatttccactgtcatctttttctgacatctgacccggagggcaaagctgaggctgacgttcgataagctctggcctggaaacccaatggcattggctgggctgggtttccaggctgctttggagcagcaactccattttattttcaattcccccttttagaactggagtgtctataattgttactatgtcgtcccatcactgcatgttgggagcagatatgttgcttccttattttcacaggttcacagacggagagaagttcttccccaggagctgtacttaacagattactcatccagctcggatttggatgattcagattttggacttttgagctgaagagatttaagactttgagatgatgctgtaatgggatgaaacctttggggactgtggatggaatgaaagtatgtggcatgaatgtgactctttggaggccagagggtggactgtggtaggccagagaacagcccctccaagaggtctataacttaattcttggagtctgtgaacaggttactttatatggaaaaaagaaaaaaaaaagacgttgcagatggaattaaggttacaatgtttaaaatagggagactttccctattttgtccctggaaaatctccctattttattctctgctttccctggctggagtcagagaggtgcagcagaagggatggcagagatcccaagagtaaaggttcagctcccagctgctagcttcaacatatggggtagccacaggcaaaggggagggagaggccattaggagtgcaggagctgagggcagctctcaactggccaccaccaagcaagtggagacctcagtctcatggccataaggaacaaggttctgctaacaacctgcagtagcttggattcttccccagagctgctagtaaggagaacgatcccaccagcaccttgattttaaaccagtgagtccagtgtctgaagttctggcccagagaagctgtgggctaatgtattttgtttttttaagtcatggaatttgtggcaatttgttacagcagcaagaggaaactcacagggaggctgcagctcgttttgctccagggtaaacggattcttctcagcaccgtctccgatgcctcatgtcccattccctcccaggaaaactgctcagcctgcagtgggcacatgcaagtttcaagaagagttttctagataatcaaacaactggattgctttgctcaagaccaaaatgccatatatataatatatatatttatatatattatatataaatatatatattatatataaaatatataaatatatattatatatatacaatatatataatatatattatatattatattaagtatataatatatataatatatataatatataaatatataatacataaatatatattacatatataaatatatataatatataatacataaatatatatattatatataatatataaatatatataatatataatatataaatatatataatatataatatataaatatatattatatataaataaaaaatataaatatatattatatataaataaaatatatattttatatataaataaaatatatatattatatataaataaaatatatatattatatataatatatatttatatatattatatataaaatatacatatattatatattatatattttatatataatatataatatatattatatatttatatattatatataaatatatattatatattatatattatataaaaatataaatatataaatatatattatataaaaatatataatatatattatatatataaatatatataatatatatatatgcatcaaaattcttcctcggagcatgtggaagggcgtgaggtggtggcatagaaaatacctgctctcaatgccgtgaggccaggccactgttcgatgggactcagggcatgccaaggccctctgcatgagcaacactgatgtgatgttgggatgacgcactttctgaggctgaactacgtgcttcaatatattctgccctatctctgatctcatcagctacaagaatgccaccaaatttgcagccatcagcttggtccagactgctcttttgcctggttggtatcttccacttctgccagaaaagtcccctgaaaactggagttttcagagcttgcagagaaccaatagtgctacagttggcattctgtatctgtctaggacatgagtacactggattataagagagagaaatgaggcagcttcctagccctgcttaagtgaagtctgcagtgcagcctcgttattttaaatgaattcccataacattatgtgaagcaccaaccataagtaccaggcagtattacccgcattaggattagccacacctccataaacttttattggttgcaaataatgtaaggttaaatttacttgaaaagctcttgacttctctctctccatatgtgttttgaaagctggtctcttatcacagccaagtcagaataattcccaaaaaaacaagtttccctaatttttttttaaagattagcacagtcttgctgttcgaattactatgcaccttactgtcttctcccaaggaaggcaatttctttataaatcaggacaatgatggcttggtaattgctttgctgagctgcagagacagaatgcttcagtggctaaagaccaactacctattggggctggccgcgaacaccactgttgttctgtgcccaaagcggtggttgctaggttcataccacaccccccccatccacccataaacgtaagccatcagaaagggacggagggcccctcttttgatgacgattaaacactgcaccgttttaagactgcctggatccgtgccttctggagttagccatgcatcagggaacattgttccagagaagcccagagcggaaccagaaatacctgaattaaaagacaccctcttgctgtcaagtactacctagggttttagctacatgattccaattaaaactgatggtcgccacagagttaactgctctatgaaatgtctgctgaaagtttcccattgggctaaattacaaggaaatcagagggaagaaaggtgtggatgctgtgtggctaaaaccattaactgtgagcctaattgtgcgggtggccctttgtgctccacaaacactcacgtgccgctcacagttgttctttcctaacttgcagtacttggggaatgagctgtactcactaggcattgattttttcatgaccggacgacgtctcaagcttggagtaacgccatatggtccatcccccgggtcagtgcccgccctccctgtattctaccaactcccacaatgttttactctggcacattcatggtaggctcagaaaatcagggtgtactatatattgaaagccgcccatatctaaccttaattctggcaccttgacttcccatcaagaggacctctgttaagtccacccaccacacgccactgcagcaagcattaccatgcttgctaaatgatttgccagccatggccagttacaaagttacaaacacagcgaaaagaaaatgtcatgggtcaaaacacaaattagattaaaaaatgaatactagctagttgttttcttctttctttgttaaacaaaattatttctgctcaaccaggtgtgatttatatgacaagtcacagaacctaagccttaaaatgtatataataaatgaatatgctaggaaacattgcagaagagagatgcaatattcacttcaccaagcagttggcttccaggaaaataaataccatgtgactaaataaataatgagcaataccaatgtgatccaattccttgcattttgagtcccctatcttctaagaagtaggggaacagaacttgactaataagggtttatagattattggctacctggcttttaaatgtcagactgtgggcgttaagattttcaagatctggcattatgttctggattattaacagctattattaaaacagcctttccggctgggcacagtggctcacgcctgcaatcccagcactttgggaggccaaggctggcggataacgaggtcaggagatcgagaccatcctggctaacatggtgaaatcccgtctctactaaaaaaataaaaaaaattagccaggcgtggtggcgggcgcctgtagtcccagctactcgggaggctgaggcaggagaatggcatgaacccgggaggcggagcttgcagtgagctgagatggcaccattgcactccagcctgggcgatagagcgagactgcgtctcaaaaaaaaaaacaaaaaacttccaactttcatttcaattcatcccctaattccacatatgcagtcatgtaatcttttaatttatttacttgcaggatattttaacaaatcgtacttcaaagacttattaaagctgagaataaatgtgatttttaaaagctcacttatctagatggtaaagttttccttgaggtctatttcttgtttttgtgattgctttgatcactgactgatagcttactgaataccaataaccatcatcaaaaaactgaaagaggcaaagaactgcatatactctcacatactcttgggtcttaaccctttgttttgtgcaattctccagcccctctaaaatattgttttattgtggggagtcaccccagtatttctgtaagctgactgctcactggggggctaagtacttagaagagggagtcactcagtagggaagaaagggcagaagccgctgttattctgtggggtccaggcctaccacctgcgggtatccggccctctctgctttttatggtctttgttatagactgaatgtttgtgtcctccaacaaatcatattttgagattctaacccccatgtcacagtgttactgaggactttgggagatgattaggtcataaggatgagaaccttcttgaatgaaatcaatgcccttataaaaggggactccgagactctttgccctctttccgctgtgtgaagacacaggagttggctgtctgcaacccaggagagagtcctcactagaacccaaccgtgaaggcaccctgatcttagacttccagctcccagaatgtgagaaatacatttctgctgtttgtaagctatcttgtctctcgtatttcactatggcaggccagactgactaagacagtcttcttacatattttccctggaaaccaactccttaatttgtggcaaaaatgctaatagaaaaggagactccaagagctcttggatcaaaacattccttggatcaaaatagcttaatccccataagtttaaattggaaggaagtgattgaaaataaaacccacccttcctataacctcttagaaatttacccatctctgctaactgctatctcataaactgagaagttttgacaacttatttagtagttttttacttgaggcaaagaacaagacaaatgttagaaaatccggactccagttaactcggccagagattactgtatagctctagctaggtgaatactgtattaaaaacagacaaaccatgtttttggctaatggttacttaagactgccaagaagtctaaggaccactcgccttgtttcagaatgaaaatatcgcatatggaggtaatgggagatggggataagaaagattataagaacacatatatatttcatataagaaaaaatatacagaaaacagtaaaacttaagattatttagcctttttttttcctgaaagggaaatattagcacagtcttgctgtttaaattattatgcaccttactgtcttctcccagtaactagtaatttaatcttaattactaaaatatattcttaaatttcttttttctttttcttttttttgagacgcagtttcactcttgttgcccaggctggagtgcaatgatgcgatcttggctcactgcaacctctgcctcgcgggttcaagcaattctccaacctcagcctcccaagcagctgggattacaggcatgcaccaccacgcctggctaattttgtattcttagtagtgataaggtttctccatgttggtcaggctggttccgaattcctggcctcaggtgattcacctgccttggcctcccaaagtgttgggattacaggcatgagccaccacgcctggcctattcttaaatttctgaaagaaatttctggaaggcttattaaaagaaagcaggagttatttctgtaaagagaagtaccaatgaggtcttgcaagtttatgcacaggtcttaatcactagttaggaataatgttggaaaatgcgttaacagggcagctcgaagattctgcattttaaaagcaaggctgccatagtaccgatatagtctgtctgcttccattattgtcatgattgcacttttccccttcactgtggtagggagaattctaaagacatctctccaagattcctaccctttggtcgctcaaccaaatactaactggggaaggggctttgcaggtggaatcaaggttgctaatcagctgaccttaggatagggaaatgatcctggattatcctgctgggctcagtgtaatcacaggaactcttcaaatcagaagaggaaggcacaagggtcagactgagagatgtggctgaggagggagcaggagaaagggggaaagatagaggtagtggggctactcaggtggctttaaggatgaaggaagggagcaatgagccaaggaatatcatgccctctagaatctgagaacaactcctggctgacaccccacaaggaaatgcagcccttagtctacttcatgggtctgaatttagccagcaacctgaacgatcctggatacaggctcttctgtgcaaaaagagcccaatggccaatgccttgatttcagactcgagaggctccaaacagagaaaccagccaagacccctgcatttctagagtgcaggactctgcagtaatcaattagtaatgttctcagccattacgtttgtggtaatttgttatggtagcaatggaaaactactatattcacataagataaaacaaaaggaaacccaccatagtaattttcacaaatgttcattttaacatttctgctaacgtatttcaaaagttttagataaacatcgtttcttcagatgggggcatttcacaggctctgaatgacaagacgagatgtagtcattaagatttttagatgtctcttgttgcaggaagaacagtaagctaaatgagtttctcaccaactctaggtagcacctaagaatgacttttcttgctttactactaccagatggcttgcacacaatatgagtgtaggataatggcaccactgggtgcacaatttccttttactgcttcagttgtgaaaggagtaatgcttcaaaaatccaagaattataaagctgcacagaaaggtcaaatagcaatgacactttgaggagccacagagcatcattaaaaacaggtcacaagttggccatgaagagtttagttccattgtctatcttcactgcgctaagtgctgcaatcaaaggacttttaatcttttacagtacatgtgtcagtcttttgagcaagtgttaaggtctgatttaaaaattgtgcacttaaccagcttggtggccaccctgggaataactagaaaacaaaagagaaggctcgtgccctccaccatcagcccagggcacatttgtcattcaggttttactgcttttcgtaaataataatggttcttagaactctggcacaaactatatataatgacttcatgggggaaaatgtcaaggcaacagtactccatagaaataatctagaaaacagaatctagaaactcaaggtttttctaaagttcatcttaatataattactcttattatccatcattttatatgtgctgaaatgaaaaggttttagagatctgtcaattagtaaagaaaaaagttacagaagaaacagtggattcaacttttgacaaaacacatgcagagagaggatccttctatatcacacaaatgtacatcggtagattcagtgattgaatgacttcatttaatccaataatttgctaaaattctctaagacatacactgtattattttaatttgaatcacaaatactcatcatggaatatttttacagactatgctgaaaatcaaatacatagtgttaggtgattccaactccaaagaaaattaggatcgctgaagtctctgagtagtggtttcccatctttattttccacatggacacacctcaaagatagtgtgcccatgactgacactctcctacatgcactggccccttaccatgcagcgagatgcagtgggctgtgggttacatgaagttgcaaacaagctagccacaactttgcccttgctctccatctggttcatatcatggtggtaggtggagatatccacttctaaattagcattggctactgctatcatctgaatatctgtgtccctcctaaaatttatatgttgaaacctaacccccaaggtgatggtattaagtgagacactcatgaataggatgagtggccttataaaagatgcctgagggagtctgttagcctcttccaccatctgaggatgcaggaaggtattatctgtgaagcagaaagcagccctcagcagatcttgaagccgctgatgccttgatcttggacttcccagcctctagaactgtcagaaatacatttctgttgtttgtgaattacctggtctaagctgttttgttacagtagactgaacagagactgccagcctttttagcttgttttttgtttgttttttagttctgaattttcttcatcttagaggtcatgaattaaattagtgatgaataaaatagaaataataagagtgaaaaaggactttataaagtatatttgttgccacagtgatcaagagacacgaaagaagataaaatgaaaaaggcaagaatgaaaaaaggagataaaaatgaaatggggaaaaagaacaatggtgctaactggggcctattttgagggttttcttaatgcttatgttgttatgcaccagcagtgctacgcttgtggaatagatatgtgtgtcactcatctctgactctcctctttcccacacacctacattcaatcaggcagcatatcaagtcagctctaacttcaaagcatttccagaattgttctctaaggccaccatgtatctcttatatgttctctctgcttctgtcctcatcttctctaccttctagggaagtctcatgtagcagctgcagggattcttcaaaaatatatatcgaagcacaagtcctccagtccagggtcatttcactgagtaaaactcaaaggcacatgcctgaatactctctcctcttctaactcctactcatcattcaagtcttttccttaggagggctttccctgatcccctgaccaggctaaattcattggttctatgttcattcaaggctctctttcacaattcccaccccactgatgttacctgcttactgcctccttcctgcaaagcccatgaaaatagggcctgtgcctttcttgtcactcatatatcaccagcagctagtacagtgtctggcatcaagtaggcactcaataaatagttgttgaattgaaaagacatactattgtatctctaatccaattccataaataacatacttattccagattggtctggaggagctgaatgacagaaaagccatatgaggaattaatccattcattagttcatttcttatttattaatataagacatcccaattttattgggagcatgttgatctaaaggcaggaattttattaattttcctattcagagtccggaaatttgatttttttcatgccagtttagtcaagaagctgtatctagtcgtctagagcaaattatgatttggaaaatactataaatagtacatacaccccaacgtgtccaggaatttccttgttttttccttgcttgttatattcaagaacaaggttaatcctcataaacttaatagggtaatactctaagccttggtttactatttccatgtagttgtagataagctcttacaaaataacttgggaagaagacaactagcagcaggtctaacttgggtgtagggaggaagaatgcttttggaaaagaaagcaggtgactgatgactgccaggtcttcttgcaaacatgcaaaacacagacctcctagcaaacaaaacaataatgtttactagcaggcaaatccttatttatggaatgttttcttcagaatattcctgatgtctaggagtgctcatgggaaatatttaagttaggtatccatctggatatgaaattagaggtatttaatgaccaaaatgaccctgtattagctttttgctactgccacaagttacctctaatttaccagactaaagtaacataaatttattaccttacagttctctcttattacaggttgaaagtccagtatgggtctccagagctaacatcaaggtatcagcagggctgcattactttttggaggtgctaggggaaaatctgtttccttgcttattcagcttacttgcagaatttagtttgttatggttgtaggactgaagtcctgtttcctgactggttgtcagctgaggatctttcccagcttctagcaactgtgtgtatttcttggcgtgtggcctcctttctccatcctcaaagccagccgtgatctctcattctgctgcatctccctgactccagccagagaacattctctgcttttaagggctcatgtgattagactgggcccactgggaaaatcacaacaatctccccttctcatggttcttaaccctattcacgtctgcaaagtgtcttttgccaggtaacagtctcaggttgctgggattaggatgtagacatctttgggggccactattctgtcaatcccaggctccctatttgtaagtgttgtaaatgcacaccattctgcgaggacacgtgttaaactgggtcagtgcgtgtcctgacacagcaggaaggacctggtagtggcactggtggtgccatcctctccctgcccaacctgtgccctgtggttacctgtgtctctgatattattagaaaagcttgataccttgtcgggtctgtgattggtgtgagttcggctcaatattctaaaccttgttacatcacacagatttaatgggtggtccagattctgttctatttgtagttactgattaattattttttctagaaaagttagctttgctaggagctacacaacaggaccaaggttggtgtcttggcttataatttaggtcatgagagctctgctccatacatatctccagtggggagtgaatgaagtggtactgctgcattgattagtcatgaggaggttccttcctgcatgtccatgcagaactaaagcattggaatcatctccccaagaagctggcactgagtattctttccctgtcttcagaggagtcacagagtaaaaggaaacttttttttttttttcttttctgaggctggagtaaaatggcacgatcttggctcaatgcaacctctgcctccgggattcaagtgattcccatgcttcagcctcctgagtagctgggattacagctgcacaccaccatgccaggctaatttttgtatttttactagagacagtgttttgctatgttgcccaggctggtctcaaactcctggcctcaagtgatccactcacctcggcctcccaaagtgctgggattacaggcatgagcgaccacacccggccagaaaccatttttgatctggaaaccaaaagagggagaaagcatcttgttacccaagaagcctgtctgcatcccagcatactgcgtgttagagttcaggactgtgtgaaagcacgctgacagtggctggatttcatttcacatttgttttctcacacctagaacgggaccagctgatgaatccctgtcttacttgaatctttgctcacctccctggggtaaccactgcatcatcatgggtgtgatgtttatggaatcttggatgatagaagagcctgggttgaaagggagaaagaaaaacaaatcccattttctctctgtttgctgctagacctcgtgtcctgctggccagctgctcgtgcagctctgctccctgagtgctgagtgcttgcgacctgcctggctgtgtggcttcctggtgctccacaggaatgcaacagctgcctgaaggcatctgctaggttcctcctgctgctgtaacaaattaacacaaacttaggggcataaactgccgatttattcttatacatctggagaacagaagtcagcaatgggcccacaggctgaaatcaaggtgttggctgtgttccttctgggggctccaggggagaatgtttccctgcctttcccagcttctacatgcacatcttggctcatggctgcttcctctgtcttcagagccaggggagactttcttatgtggtatcactctgatactcttctgcctccctctttcacatgtaagaatccttgagattatagggatccacgcaaataatccagcataatcgccctattttaaggtcaggtgttagcaaccttaattccatctgcaaccttaattttcccttgccatgtaatttaaggtcttcacaggtttttggtgattagcacagggacatcattgggggtctggcctaccactgaaggtcagactattttttcattacagttgggcatacattggtacccaaagaaaacatgacaatctcctgcctccttcaacctgtccagggcaaaggaacaggttcaggaagtgtattcacaagactgtcctcaaagtactcctaggctcttcttttaataattttatctcaaaaggaaaaacaggtaaaaacattatctggtcaatttattggtcttctattgattaattggaatgcaatgctatctgattacattcaaacgattgtttttgcaagccaagggctaaagttgttttcaaacactatgtatgctaataaagttcaagcttacctgtaataatctaataataatgattctctataactacctattgagaagacatctgtatctatatttaccaatgctaccagttcctactgtgatgtcaaacacatgggaagagagggaagaaggagagcccattcacccccagctacaaaacagttactgaggccattcaggatgtgcaatggaaagaaggatctgggaaaacacagtctttaccaaaagttcatccaatgtataggagaagccatctgtgtatagtattggagagaaaatgtacacgtatttaagttgttatattctagatttattaaaaaaacaatttatataaatatatatggagaataattaactggtttggctctgggttggaaggtaagagacaattactaatactatttttattccttttgtattgtctgattgctttaaaaattatttttatttttatttttatttttttgagacagggtctcattctgttgcccaggctggaatgcagtggcataatcagggctcaatgcagcctctacctcccaggctcaagcgatcctctgacctcagacttccaagtagctggaactacaggtgcatgtcactgaacccaactaattttttattttttgtagagacagggtctccctatgttgcctgggctggtcttgagctcttggactcaagcaatccttttgtcttggcctcccaaagtgctgggattacaggcatgggacatcatgcccagctgtttgattactttttaaaacaaatgcatataagaccgtcatttttttttttaattttgtaaattgttggtgaacacaataatagaaaaggtcagagtaattagtgacaattgcatgcttaaagtgattggctttacctgttttctatgtggccagagtaccctcctgatggctcttggtgaataaaggagccaaagctaaaagttagaggctccagtctttggaaggcgtcttcagtaaaaatatcctttggggatgcttagttattctaagaatagttatagatctaataaatattgcctttgaacggttaagtttggatatgcaagaaggccagctgtgagaagaacaggcagccgtgcaagctggcaaagggagaaaaaactgtttagggataggagaaaacagatggatgccttaggccagctgtgtctgcactcaggagcccaggttggcagcagacagcccttgaaggttctgcatcttcatctatggccaattttggtctgcagatgaatatgaatggctgcttgtgattgatttctttgcctgttgctatagtttgaaggtgttctccaaattcatgtgttggaaacttaatcccaatgtaacagtgttgagaagtgggaacttgaggaggcgattagatcctgagggctctcaatggattaacatttttatgggagtgggttccttattgcaagagtgagtttgttataaaactgagcctggcctccactcaccctctggctctctcttgcccttccaccttctgccctcaaccatgatgcagcaagaaggccctcaccatatgccagccccctgaccttgtacttcccagcctccagatacgtaagaaataaatctctgttctttataaattacccagactgtggtattctgttatagcagcataaaatggactaagacacctgtcaaatagatgataacttgctcaaatgaaaaggagacagaaggactaaatgatgccaatactaatgtactctagccacagaaagcaaataaaattaaaagccagcaagagagctgcttcctagtgcctgcttcttctttagccctattccacagagaaattagaaacggatcagataatattcttatctcaaacatgttaaaggaatttcaagcaagagagtgtgaagttgaatgcaagggggattcttgaagagccagggagaagggtgtgaacagtgagaggaacacaccaggaatacttccatacccctaccttggcaggtcctcatttttatagttcacttataagaaatagaagtattttgttttccataagacaggctgtggtactggaaaaggtttggtgtcaaatttaaactctttttttttttttttttttgtttgaggcagagtttcgctctgtcacccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaaaatttaaactcttttattagccaactggtcttgggcaacacacttaacatcataccctcagtttattcatctataaagtgggctgatgttttagaaggattagatgaggcagtgtgtgatgcatgcaggagccagacctatttcctccttcccccttgacttctgctcactcaggcatatgtgcccgagcaaagggcagaggaacccatttaacaaagagaaaataagaacaatatgtgtaaagcacctaatgtcatgcacagagggctatcctattattcagctaataccccattagctctgggaaaggtgaacctcttttcctagctttattttcctagaaactctccatgacttcccctacccttcctatacacttgcacccctgtactagtttgctagagctgctgtaaaacattaccacaagctgggtggcttaagcaacagaaatgtattgtttcacagttcaagatcaaggtgtctgcagggttggttctttccaagggttgtgaaaaaaaactcgttctgggcctctctcttagcttctggtggtttgctggcagtctttgatgctctattggcttgtaggagcaggaccctgatctctgccttcatcttcacgtggatgttctccctgggagtgtgtgtctttgtgtccaaatttcccatttttgtaatgatcagtcacattggattggagcccatcctaatgacttcatctaaactaactttatcagcaatgaacttatttccaaataaggtcacattcttcagtagttggggttaggactgcaaaatgtgaatcttggagggaggtataattttactcaaaacagcccctaataaggagagtgaatcatttgactggtgggtgatgaagctctggcattggctgagatttttgcacttgttggagctaagctataatacaggaccagggactgtgggagtcagtgatgttgggtgggtttgtcagcttttcaaatcccaggttttccataggggcagtcgccaggtctacaccagctaggggtttctaccataggggcttgtccccaggtctgcaccagctaggggttcctaccataggggcagtccccaggtctacaccagctaggggtttctaccataggggcttgtccccaggtctgcaccagctaggggtttctaccataggggcagtccccaggtctgcaccagctaggggtttctaccataggggcagtccccaggtctgcaccagctaggggtttctatgagcagatccttagtctgccacttggcgggttagaaagtcatgctgtcagcccagtgttgtcaccagtaaacagactatttaagttccatttgtctgttttcattgtcttatttttcaattagtcctaaacttgggagaagaaaagggtgcatttattgggcccctcagtcctaaaatacggattttaaggaggcatcaaggaggcatcagggaggcaacggagggtcggggagctcgggaaggtttgggaagtggcttgagctcccactgcctccggtccacctgcaggctacccgaccagagcctggtctccccacttggactcacctgtgcttcctctgaggatctgtcacatgctctccttgtctcctggggcacaaagggctgagtgagtcagggtaagggttactgtgaccaccagcagaggagatgtcaaggccttgggggtctaccttttggtccacagaaatggaagcagagaatgaggtcttaggggacaacaggtatcctttgagttggtgggaagaagctgtatttctctcaagggaccgccgtctcaccccttttctggaggaagggcctccacccaagctgagatgatctaggagacaaatgttgttttacggagtgaggttcctagctcctgttggtggacacattttcctaaggaaatagatgtgtgtaggatgctatgcccaagatgcataagacgacccagtgctcagcccctgagtctccccttatcgttcccaacagctcccaagacagactttcattacaattgcacgatggctgcctcagcagagacagtggtcttgagccagcagccatccgtttctgattggtcagaccctatgccaagcaatttatgtgcatgactgcagggccaggaatgggtgagggatgtgaggctgtcacctcggtgcaacatttaagggggtgctgaaataacttactaattatgataaacaacgtacacatttttataataaaatatatattatataaaattaccatcttaaccatttttaaacgttcagtaggactaagtacattcacattgttgtgccgaagaatattttaatgcaatattttttcatctaaatcaaagcaaaaaaatacaggatgaaaatattaccaaaaatttaaactaaaggtgggatctggccctgcacagctcagcctcccttgcctccccctgtcccagccctacatgactggccaatccctctttacagagggagaaactgaggctcagagaggctacctcagtggcccaagattacacaacctgtagtttctattcagatgcagatgaggatgcctgctcctctgagcttggattttacacctgtccatatcacactcatctcaaagacagtggcaactaactgaggttcctagagcaacacctaggacagagtctaggatctgcaaatggggccagtgctatcatgggtcctctcatccttctgccagctccaccctcttctcctccttgtccctgccccacctctctaatcctctctccaccctgtgggaatggctgcatttgtatagcaagaggagccccgtgtctcttccaatcacacttccatggttccacgcagtctacgaaaatcaagacacctcctccaaatgacgctccttcacagacagtcttaacaatcagctcccaataggcctttcccctctctgtccctccctaccaaccgcgccctggctggccacactgagccacctgtctgtccccagacatgcatcatcttcctcctacaggtggatcttctggcctggagcatctctctgcgccttcaccggcaaactctccttcttcccccggacagactctggggtgggttcctagagttcttcaggtggagtccatggttccatccccaggagctctctggcagtttgccatggactgttttaatgacattaagtatccccatgatgcaccacagttcagatttcctcctcttctgttaaaacacaactgtcacttcctcatctttgttcctatggtgcctagcaaagtcctgggcacatactagaaattcaagatatgtttgtgtgcaataagagatgtgatccattttatctaagctgttgatttaacactgggccaacaaggagaggatgagatggctacggctgctccaattatctaggggagggggcagactggctgcagagttcagtgctgacaggctgaccacaaggcagcagcatcatgggaaaagcattccgtccagattcagaaagcccagcttcgaattttggtttgtggctttctaccaagggctccagggtaaactgctaaacctctctaagcttcagttttttcttatttaaaattggaaaaaaagacataatatatcatttatgatgctatcctgagaattacgtgatgattagaggtattaaagagttatcttgtccacaaagcactagagtgatattatttattgatttcttaacggtgctgataagcacagtctaatggcttccttcagatgaggtggttgaggaattcagaatcataaaaaccaagggcaacatgagcacatcgtgaggacaaaatgtactaagcaagtcagtgaggccacccaaaggaaaatatattctgtttgataaaacaaattgatgcggtggtttcatttagcagaattatcagcaacacacacactggaaaacaagcagttacatggctctacccaagaaattaatctcaacatgtggaaactgggaaggataaatgtgaagttagttatctctccaactgggaagattttatgaacaaccaggagagtgaaaagtttccttgcttggtgctgattagtacaggacagttattaggcagctggcacagcagaaaaagaagggccattcatcaattcagtcattcactcagtcattcaggtaggagctatttattcaggatctacaaggtgccagatgttgttttggggaaagacaaaactgatactgatcaaagacatgatcgtcatgtacgtgagaatgtcacttgtgaagtgatgggccttaaatacccaagcacacaggcaagaatatccctccaaattgtgagaagttctggatcaaaagcccagaatgctttgacaaggccatagagaaggccgaatatatacggaatgaacgtgtcaaggagtgtctcttacaacaagagacatttaagttgggatacaaaggtggaaagtcctccaggtgttggtagtcacatgtaaaggtcctgaggtagaaaagacctcaacgtatagaacaacggaaaagaggctagtattgcaaacatggtgaatgaagagcagaggggccccacatgaggctggagacttgcaggcccaggccagctatgtccacacagctgagacgggctgataccagttctgagatgcttaaaataaaatggtgaaatctgtgtagagcctttctcctaaggactcaagaagagtgatacaaagacagatggccataataattcagcagttgaaaaaaaaaaaaaaaactttttcagaatgaggcgacaacatgaaacgaaggtaatgtgagaaaaagagaataggcccagataatgtaatggaggtgaacatacagaaaaaaaaggaagagctgtgaaaagcagttggcggttttcaaaaagtgatacagagttaccatacaatccatcaattctgcttctaggtatatacccaaaataattgaaatgggtatgtaaacaaatacaatagccgaagagtgaacacagctcacatgtccatcaatggataagtggatacacaaaatgtgctatatccatgcaggggaatattattcagccacataaaggactgaagttctaaaacatgctacaacaatgatgaaccttgaacacatcatgctaagtgaaggaagccagtcataaaagtcatctattgtaggatcctatttatatgaaatatgcagaagagatagattcatagagaaagagcacagactggtaattgccagggcctgggcaaggcagaatgggagtaactgcttaatgaatatggggttttcttttagggtgatgaaaatattttggaactaggtagatgtcattttcaacacactttgaacgtaccaaatgctgccgagttgttcacttttaaatggctaatttgatgttatgtaaatttattctgaattagtttgaatgaaagggatagaaaggataggggaggaaatgcctgggaggtggagggtcataatctggtcataacagaaggtgttgccgggtggaagggctcgtttctgctgctagttcgatctgcctgcaggcaggtgcatctgggcttggtggtctatggcactccttggcctttgtcttcacctgaattaaagtcttcatagctcagtaagttttaaagacagtggagggagcttccaggtccagtgaggtgagaagtgaggggagccctttctccagcagcgtccctgcctcatggtgctttggtgctgtctttctgggctgctgtccccttctgtccccgtgggagtgggaagctgctcagacaggcagctctaccttcccaaggcctctgtgttagctctggggatcccggctgggtgcttgggaggaaacaggaggctattctgcctcaatgatttcccctcaaacaggaatgctccctgggaaatcctaagaagccctggcattggtttctttgtgagcctgttaccgcaggagctggcagaggatgctctgcttcatctgactcttaatctatttcagctgcttaggagtgacaggggtcaaggacaaatgacatttaatcatgtgtggtagccagtgctgcctgcagaggagaaatcagtaaagttcctttgtgttctaggaagaaactcagcgctgcttccgtgcacattaaggagaaacgctgcccttcaagccccatcaggttctgagcaatgcgacaggccacacaccacgcctcctggcaggcctcaaaaggacacgatgcttttgcttacctgaaaccattattttttgcagtaagcttcatttcctccaaccacctgactctaacttgtgcaaaatagctccgtgagcagtcagcacccatcacggtgacgctttcctttggcagaaccctcatgtgtttatataaattagtccacaattggcaattacattgttgttccaaaataagggcaggcaacatgtaaccccgggaagaacaatggtctggacacggaagtccagacaggactattatggaaaattatgggggatgattcatcagctggcctctccctgggcacggccatcctcacatacaatctttgtgctaacgcagctactttctggtaataagttaccataagagaagtgtaattagctgttgggattcattagctccagtcagtgcatcactggtacaacatcttccttgccagtttactgcttgttaatggggagcgatgatgtatttgtacctctacggaaagacagtgaaggacgcaggactaatctgaagtcctggcggtctgtccttttatgtagcagactgaaaaactgaaaatgagtgtatgacacagaggaagagcccagggtcctaaaaagccagtgtggaaggctatcagcccattcacacatattattactaaatattgcttcttcggttaaacctgttggaggcaagaacatgctgaccaagcatgaaacctggacagggctgtcttccctttagcttttccctgctttagaaaattttgtagtgggtacttctagaagcttctgtcagtttagaacaagaacttacaagacttaaggagtaatgacttttactttcaattgcttctcaattctgtttccagaataagcaattggctttctgtgacacaatgaagatcccatcccagagaggcagacaggggccccacggggctgtgcaggaaggcaagtgctaattctctctgctcaccccaaaggcacctctgcttcctatgagacccccacactactgttgagtcagtgttcagagaccccacctctcactcttccatagcacagctgcacagggcaatggaaaagaacccagggaaccagacctcccgctgagcctccaccgcccccgcctactcctgcagtgattgtcaaacatccctgagtaaatccggtggacttctctactggcccgcacagtgacgggacaaagtcgttatcctaggaaagggggccagagagcatagaatggcacatggagacttttctactcacttacttgaaatagtcttggtcaattagagggaaactaaatttgatttcaaatattcttggttaattaaggaccaaccagactcaagaaaaagaggatgtggggccagcagaatgtggagaagcgcagtgcagcacagatagcatccagctctgcatgctgacatcaggtggtggcaggtggtgaggcctctgaactgctgccttctttttttttttttttttttttttttttgacggggagttttgctcttgtcgcccaggctggagtgcagtagcatgatctcggctcactgcaacctctgcctctgggttcaagcaattctcctgcctcagactcctgagtagctgggattacaggtgcccgccagctcacccggctaattttttatttttagtagagatggggtttcaccatgttggtcaggctggtctggaactcctgacctcaggtgatccacccgccttggcctctcaaagtgctgagatgacaggcgtgagccaccgcgtccagcctgaactgctgccttctgagtgcctttcatgcctctcattgctgatgttttccttcctccaacaggatcacatctacaagctggagatcttcacttaaggttcatcaacaggggcatggccccacgtggactctgcttgttctgtgagctgtactaactcacgggttgtttggcccaactttggtaaatgtcagttttatttattttcaaataatgccactttgaaatgggaaagaataaacagcatgaaaatcgatgtgttacagtgctggagaggctgggtacgtaagcagtacatgaaagcgtttggtgtgctctttcttcttcaatttatggttaatagatttgtttgcttctcctccagggaagttacttcttatgcaatgtaatgtaatttgggaggcagcaggaagaaaaattacatttttaatgtcaagaagttatgaaggatttaaagaatgaaccagctttttatttatcagggagctaataccctgtactaatgttttatagaaatatctattaaacatcattttaaaccaattgataattcactaaactttttcattgaatttcttttaaagtgagtaatttgttcatattaatggaaaaatccaaatattcatgtcttcataggaataatgactattcattcacgctgaaaagataaattaaatatttgcttgtccttttaaaagaagcccatatttgcaaccaaattacaggatacataatttaaaacaaatctcagttggagtgtgcaaattttcataattaagtagatcaaagtttgcagaaataagtgatgaaaactttaaaagggaatagcatgatgggggattttatattaatcatttatattcaaggagaaatcattatactctcactttttctagcttaggaaaacaaaatagtgtttgggaagaaattatccccaatactatttcagggaacaaaaatgccaggaagaactttggacaatgatactccttttggggaagaaaggccatctgaaagaaatgaaaaatgaagctttttcgaacttttcctaatggaaaagacagggcacatacaaaattcctaacagatacaaagctcaagggctacaagatagaaactttaagccagcttcaagtaaaaagcttttatacgtaaagaaagaatgtgttagtaagagagaggtggatcagccacggagatactgaaaaaaggaatattgtcttctgaggcattaattagggaaaacatatcccagcttgtccagtctggggcatataatgatgacctaaatgcatcaggctgtcttatcttaatgatattatgcagtaatttcaactgcaaactccaaggattcttctatttgccactaagtgcaaagtattaccttttctatgtatggatacgtttagatagacacatacttaccatttgtgttacaactgtctgcagtattcaggacagtgttgtgctatacaggcctgtaacctaggagcaatagacatatcatacagcctaggctgtgtcataagctataacgtctaggtttgtgtaagtgcgccctatggtgtttacggcgtttccataagaatgaaatggactcaagatgcatttctcagaacacgttcctgttgttatgccatgcatgactgtataaagcacacctccttctgactgggtgggaggaagtgatctggaaatgttggggttgcaccacaggagacccgagccctcgtcactggtggagctgctgagatgggcagccaactgtcttttctgaggagctcctaagatcaccttactcctcctcactccactgaactctgtcccctcccatcgaagaggactgtcactgctgagaactgactcaataaaatcacttcacatctttactagacacactgatcaggactaagctgcccggccaggagcttcctctgctctaggaccaggtgtgggaaaatggggtggagtggggtgagtggtgtgtctcatctgttcccatgtccacacagagtccttctcattttcaagaacctggattaagagtgctgaattcaggctgggtgcattggctcattcctgtaatcccagcactttgggaggttgaggcgggaggatcacttgaggtcaggagttcaggactagcctggccaacacggtgaaaccccatctctactaaaaatacaaaaattagctgggtgtggtggtatgtatgtagtcccaggcactcgggaggctgaggcaggagaatcgcttgaacccaggaggcagaggttgcagtgagccgagatcatgccactgcactctagcctgggcaacagagcaagactccatctcaaaagaataaaaaaaaagggtgctgaattcagctgacacatgcccctcatctctggccaagactgggatgagctagtttggggctcatgatacaacactttaaaaacactttctcaaaaagattctttttaacagatgaataatattggcagacaactgaacttaacataaaaataataataattcctcttcttacctgtggctaatgcaagagtaagccacagaaaataaacgtccttggagctttgtagccagagtgtgattatcattaacattactttgtgaaggggcgtttctcaaggtcactctagaattagaggcaccgtgggaccaagcactcatccattttatgggttaaaatgactaattgagggtctgagtttaattacaatcgtaagcaaaggcacagtgcagatactttgacgggcttaataacattcttatgtacacaaagatagatggaaaaaattagggttgtatattgttgtcctttaggacaagatactgaagtgggaatagaataataaaaataaataaacgactcagcggcaccgggaaatgagctgtggaagttagccagccagccttatgcacatacttcagctggagataaagtcctaagtatccatgactaaatataatgcgactatacaggagtgcagatcacagttgttttattgagctagctgctagattaaaaggtaaaaaagtatgctctgcaagcttctacccatagttcaccctgaaatgatgataacagccacagcgggatctttaggatatgcatcggtgatattttaaatgggaaatgcagtcatgtttcacagaaaatccacaaagcatcaggtctgtacacagctgctagagtcgacatccttaaatgacactgatatggtgtcacatcccctgcgtaagaacctcaaatgacttctggctgtccatagtgtcagaaaaatccatgcaatgttcagaagctagttcaatgtcgggaggaaaaggaaaggttggctcataaataagagcagaacacacagaaatcagatccgtgtgtggggagaccctcatttcatggccatccagtcaagaggttggatatgaaccttctttggccgagacagccacatcttgacttgtagaactcaatcctgctacaggtagtgtttggttttgtagctaagctacagaggggaatggccttgtgcacaaagaaaaacagaaaaacatctttgatctgggttgtttgttgagtgtgtgggcactgtttggggacaggcagcatctctgagttgtctatctcctcctcttctcagtgctgcatcctcaggcggctccttggcttcctagcttagcagcccctctcttattttcttactggagtgaccataatagattcccagggctgtcagaaccgagtaccacaaactgggtggcttaaaacaaccgaaacttattatctcacgttctggacgccagaaatctaaaatcaaggtgccagcagggccgtgctctctctgaaggctcttgggaaaattccttccctgcctcttcctagctgctggtgttgcagcaattcttagttatccctgaattgtggctgcaacactccaatctctgcctttgtcttcacaaggccttcttccctgtgtgtctctctgtgcatatgtcctctttttataagatgccattcattggatttagggcccactcttacctagtatgacctgatcttcatgaactaattgtatctgcaaagaccttatttccaaataagatcacattctgaagttctgggtagacaagaattttgggggaagatttattcaacacaccgcagtgacttcagccaacatgagcttgtccagagagagcggagccagctcaatgttccctggttagcgttcagaccatggtccctcaacacatgtttttggttgaaggtgatgattatagcggccacaggttaagagatggatttgatcacacgatgtgcaaggaaacaacaatgagtgcaaaactgaattgatttcaaggtctgaacctcactctatatgaaattcatttccctggaggactccttcatcataaaacaaaacagagaagactaacaaaataacctcatttattcttacatcctaagcctctccaacattttgccacatttgtttggggccatattttaaaatgttttttgttaaaaatggatgcttgaatctggcagaattggagcaaaaggaacaactagcaaaggggaagaaatgaagaagggagcattagtgtgcctgggattaggggtggtggggaagaggtagcggaggcagagcgtagaaatgaagcccttcccttctgatcacccacagctctaacccccgcaaccccacctccccatgccgcttggcctctcacaatctagctgccatcatccttatcaactcaggcctccaacaaaatttaaggcttttttttccccacttctatcctttttcctcagtgacagacagatactccaggaacacaaagatagatctgctttttaaaaattcaatttcttgtccccaaatgaatttcaaacgaaaaaggactaagggcattaacttttcattttacatttcatatgtgcttaaatttttgctatgtcaacatgatatagcttcccatgaagattctccattcctttctagagaaggcaaagcaagtgtctcctctctttagaatgctccctgtaaatgtgcctccttcagtagtctacgacctggaggtggtagggaatggggtggcgttagggcatgaagtggggacagccactgatattggtacaatatccactgcctagaggaaagcttgagaaactggacagagcctattaagcctgcatgaaattgtctaaagacagaatagtgtcacattgtcaggttctggctaagccttaggcagattttactgacttaaatttatctctaataagcttttggacatttaagagcaatataatttgcattcatagattatttttttccaaaaaatgaaaaggtgacctctttaaaaacactaattccttaaattcttaaccttggctccccaccctgaaatcacataaacaagtctgaatcctgctaggaagaaaaatcaagagtaatgattttcaataatgaccagatgaatttacttttacctaccacatgctccttctgctggatttccaagctatactagtttaggaaatagtattctaggaaaagagttttattttcttggatgttttattttctttatatattcctgaaacaatagctacagaagcaaaccaaaaatatcaactcatcttaaagtcattggcaaaagaagaaaggagtactggaaaaacaatgtcaacattattatctaaaatatgccttaaaatatagtcttattttaaaacacaaaaaggcacccacagttctagttgtctacatgaacatcaaaggtggaggtcaagagactacttgcacttggctgagtggctaatgctgtcccaggtagctacacactccgtaggtcctagcagggaagaatttgaagtaagaaagaagggagagggagaagaccactggcatttaaaagccaaatgatgttggccacatggatgccactccgtttatctctggaagcaaatttaaggaaccaacagagaggaaagtgttgccccgtcagcaggtggtggttgtgtattgttttaagcacagatctgttagcagtctcctatcccataactttgaatttcctctctgtgtgatagggtggggatggtctgaaaccagagtcaggatgtggctcaagtcctggcttcacgacttaactacacatgagctcattgggctacgatgcatgtgagaatcaacaacatatctgaagtggaactttcaggcccctggaagacagagattttatgaataataacacttactttaattttatttaaaaatctaatctctattgatggtgcatctcaaactcctctagagtcctttcaacgctgggtagcgagtgctggcctctgctgccctccatgatgctttcccattgcatcatttctatgtttagcccaatctcacctgactcttcaagccttttttggccacacctagctgtcagtcactttctcaccagtttttcctcctgtactgccatgatcataacactaaattgccactaggctgttgtgctggggctcaccggctgagtgccatttcttccactcagtcatgagtttctgcagggcagagtctgccctctctcagcctccttagccctccccaacacaaagcaggtggtcagcaaatgctcctgggataaaactgctgcatagcagaagcagcacaggaagtcatttctttaatgtgaatagtgatcttggctttgttggaaaaatgaagaatgtaaatacacttgcatactaaaatctaaagccttctgtcatgatatggacgactgtgactgttctggtgtcacagatgtctgcatgacaaactgaatcaaatggcatcattttttgcttcctattatgtggtcactcctggccagcagcagaagcagcagcaagtgtcgagctgctgtatgtgtgaatagacagggatggggagtcattctggtctcaccaaactgtgctccagcaacacaacccagaccctaaacttagccagatgatgtgtaaaggggacccgtgagcctacactggtctagcttcttcatctactttttcatcaaaggatgtcaaatgtactttaataaaggtggtagcctatatcctttcaaacaccacgaagacatacttatgctactatattaatcagagagcattttaacagacagagctagccaggtccttattgattacacttctacaattgcttctgagacagttccttctgcagtcttcactagggaccctgacactgtgaaagtagggaatgctagcaagggaaaaacacttttaaatagttgtgaataagtgaaatagaaaaaaatcaggcatgggagttcagaagagcctacaattttagctttggaggagttatatttcttctggtgggacagatgtttgcccaaggataacagaatttaaggggttatgaaatggatgcctcagtagggggtttcagagtactgtatatttgccatatggtagcacctatccagagaaatcacgtcagatgttcatgatttcgtgactcagacgaaaagcagaattgtcagaggattcccattcctgcccatgaacgcatgtagatattcgtggaggcaggctcttatcttgctctgtgcacacacatttcacacaaacacataccgcctctcaagactggaggctgagagcattgggatgaatactcatgagatgacgattattaatgccactgaggtggattttgttccttctcagtagagactggttgttatacctagaaactgatcaactgtaggagaaatggcagctttgaaccatttcaactaaaacaatcctgtatgtttcactttcaaaatatagattatttggctaggtgttttcaatcaccccttttgcccctatcccagcaatttcatccagcagagatttgcaactttggtacaaaatacaacacttttgggagcacagtttctagagtttagaagaatcatatcttggtaactactttccttcctaagagcaaaaattaaacaagacataaagttgattctaagaaatctcaatagattcctgatgatttttgtgaaaaacgcatcaggagagaatcacaagacatttgctactttcattatttaaaaaaccatttaatacaacaggccttattaaagagctatttctaagaattatagaatcttacagtcaaacagagaatttttaaaatgagaatttttaaaaaatggctacttgtgacagttaaccagatccctatgtatctgttatgaactctgcccaaccagtcagcctgcctggttgtgctatatgcatgatataatgtgaaattaccaagaactattgttttcggccaaagaaaatgacttattttgggttggaataaaaatgtttgtttttcaccttagacctaagaaatcatgtgaagtaagtctaacattaattaggtagagaaagatacctatatgtctttattacctggttagaaaatttaaaattaacttcttatactccgttgccacatcaacattcatgttttcagaatggtctgatcctcagtaaaagagccactaaagttatggaaagagacagtgtctggccaggggaagatggtgggaggaggcactcgtgacacaggactgaccttaggcacccggtggcgttacgcagcacctgtgatgaatgcagctgtattttccgatcatcctgaagaggcgaattttcccagcctgagtgggggataatcaccgcgttggtcagtactgctagggcatcctggatgattggcattttgagtgcatcgcatgaggagaggttccaaaggactcctgcaagagacacacaaaaagaggttttgggtggccacaagtttttctcatctccaaaactgtcttccttatttgagttaacggaactggcaggaaggatgaaaatactgtggacacacatcctagagtgtgtccttaattttagaacattcgtgtgaacccattaaaagcattctgtgaaaaatctgatgagtgagcagaggaactgtgacatgattatctttatttcctcagggagcataatcaaggttgcgaggtctgattgaactgaggctaccaacaacgcttctgttccattttaatacaatggacccaaattgctaaattctaaccaagaccaaagagatgtgaaagttatttgaaatggactagtagagcatctttgtcttacccaagacctcagtgtgcacatgtggttgccatgaaagctaagtgctttcataaacaaccagctaccatgggtaggacccttatgagaatccagcatcaggtcagatgacaactggctcaacaagcaatttaaactgttgccccttgtgactgttttgtcagcttttctctgaaagcaatgctcatggaggacctacagaatgttcctccttaaataatgacaaagggagaggtgagaagaagagggcatgtccacaatggacagagcgtcacagtaattcatgcaggcagagcaatgcaaaatgttaacgacaaatagaatgctttaggcttttaaatattttttaaaaggagatgttctagaaaaggtcataaacattgcatatatattataacatcatttgaaaatgcttttaaataattattctttttttgttaggacagtctacataaagaaaaaaaggaacagagaataacattctatttttctttgaaagaaagcctgtatacaccctgaacctaaacacgtaccatcactgcagatattggaaataaaacactatagttgtctttggaaatagaacttgtagcttatgtttttaatgagctttcgatatattttaacgaaatgcgattttgttccatctactgtgttatgaatagaacaaacagaacatgtttatttccaaaatttgttttattggttccttgcgttgcacatgttgaactatccaaggacattaataatacaaatctgactgttaataactaaataagtgactataaaaataaagcaactataaagttcaataaaaatgtgactacagaggcaaactcaactgtctttagaaataccatttactggaaattttattgaagtgaatgcaaaggaaacaaaatgtttttagtgcccagcatgcataaaataatccttcagtacagggggttaacctgaaggcaaatctagcttctcttcttttatgaataaagttttattgaagcacagccatgtcggttcatttctaaattttttacatctgcttttgtcctatgaaggaatagctgggtattagtgacagagactgtacagcccacaaaccataaacaatttacaaactgtccccttacagaaaaattttgtccaactgtgctttagtgaatttgaccattttatatacactttcatttgtgcttgtattgccattagtatcctaaattgagtacacaaaaagtgctcaatggtacacagaaggtgctcagaatatattctgatttggactgatttgaaatactaggaatattaacatatgcatctatcttgttttaaataaaacacaaagctgcttattcatccattgagaaatgttttgccaaagtttggtaatctaaataatcaaaatgacttcattcatttccagcctcacaaaaatgttaatttttagagtaaaataattgattttgcagttttaaatagtatattaaaaagaaattagtatctaccccagtatttgaggataactttcaggaataccatgttaagacatttgtgtctgctcttcaaagtatacaatgcgaaaatataggaacaaaatgtgcatttttttcattcccaaatccagactcaaaataccaatatctaaaaattgaggcttataaatgttttaaaatatgggtgacatattttgctgtatggtatatatcctttaaaaactaaatagcaggcagggtgcaatggctcacacctgtaatatcagcactttgggaggctgaggcaggtggatcacgaggtcaggagctcgagaccagcctgggcaacatggcaaaaccccatctctactaaaaatacaaaaagtagctgggtgtggtggcgtgtgcttataatcccagctacttgggagtctggggcaggagaattgcttgaacctgggagtgggggggggttgcagtgagctgagatcgtgccactgtactccagcctgggtgacagagcaaggttccatctcgggaaagcaagcaagcaaacaaacaaacaaaatagcagagagaaacctttgcatttttttacatgcagtgagtatgaaaatctcaaggctttctatgagaatacagctatttttactgttttcttacaaacagaaaagaaatagggaaagggaggaaggaaatcaaagaaaacctaaaggccaaatctagtacctgacaagaagtgaaagaatggaaaggcagatgcagtctggaatatctttttataggctgttctatctccttcacttttccttaattagttaattagtgtaacctaattcagaatcacgaacaaacagaagttcacattcattccacccttccaggctgtctccatctgcgagtcacattccagtgaactgatcacagtacttgatccatatctctgaaccatctatctcaatttataactgcaatgcacaatgcttcctggacttattacaactgcaatgaatctctatcaagcaactttatcacctcttgatgaagtcttggtaaagtggatggaacgcggcagattttcttgagggggaattcagcaaaccagctgcatggggtcgtcaaaattttgagttttggttagattacctggacatgagacaggtttaagcatagaagcagcagtttctggagacaactgagatgaagatttatatcatctggcaggagttcaagtgggaaacaactgggaattccacatctttcctgctacacacacacacacacacacacacacacatacagacacacacacacacatgtcttgactgacggaagagagattagtggagagaactggacgtatctaggcatcctctgaacaaatggaaaataaattttttcctcaaacttttacttcactcctccctccccttttccatagtggtttaaaatatgtccacaaattcttggacatttccttcaaatggtggagcctaattcttctctccatgagtggggatttgatttagtgactcatttgtgaccaatgaaacatggtggaagtgactgtgacttgagactatgtcattaaaaaggctttgtggctccctccaaaccctctctcagattgttatttgaggggaagccaattgtcatgccatcatgaggatcctcaggcagccttatagagagaccagcatggcaacgaactagggctttcagccgaaattttggaagtggattttccaaccccaaccaagccttcgaatgactgcagcctcatgacagaccctgagccaggaccacccaaatctgtggctcctacttgtactccctcacacttagacagtgggtgacataaatgttggttgttttaagctgctaaattgtggagtaatttgttatgcagcaatagacaatatacctttcctttcctatgaagctcccactctctctgttgctttcttctctctgcttcactttcctatccctttgcctttctacaatggatggactcatttttccctctcgccttcccaggacactttaattcttactcctctcttacctaaatccacttgttcccttattccttccaaattccaatgtgagagtatacaagatatagcaaggatgatccagctacactttgtaactaaatttaaaatgcattttaagtgacaagtatttaatttaaaaatatgtatcattcttcacgtttgcaattcaataagtgacccaacactttctttaatttggaataatcctgctcttatttccaactgctgccttaacaaatcaccacacaggggcttgaaaaacacaaatttataggtttgtgtttggagggctggagtctgaaatgggctggcaaggctggctccttccagaggatcccggggaagatgtgtttcctcatcttgtcaacctcctgggggctgcctgcatcgcattccttggcttgagatcttacatccctctgattttggcttccatcatcatatctccttcctggactctgaccctcctacctccctctcataagggcactctgatcacattgagcccacctggataatccaggataatctccccatttgaagccctcctaccttagtcatacctgcaaagtccctttcatcatgaaaagtaacatttacaggctctggaaattagggggtgggctttttttgcagggtagggacattattcagtctactacgtatcccttcaaaaataacctgttatgcttaaaataaaattaaacttcctatggtagcctcatgatcaggcctttctctaaatctctaaattcatcttgatcacattcattcattcatttatccattccataatattaaggacctagtacatgcatggttctgtttgacgtggagtggagacatcagtgaagaaaacaaaaaatccctgtgctggtgggccaggtaccatatagctctagtcactgtgctccagccaaaatggcctgtttcttcttgaacacacaagctcctttgtgtcgcagatccctggacttgctgctgcctcattctggaacattgtttcctagatcttttcatggccaatacttcttccattcacgtcaacttaaatgtgctaaactcagagaggctttcctggatcagtctagtctaccttcccagatgcttgctgtcagatctcctatttaatttcagcagaaacctcaacactaactcattctgtcatttgatcactgttccatcctccaacagggtcccaggcataaaatgaaagcagacacttgtctgaatgcccatcgtatgcagaacacagagctacagaatccctggcatacagaatatgccctgacaaacatgaaccaaacaagcactaaagaaaaataaaaaataacagctggatggtatgatcttataggatgccatgtgctgtaagcatcgaaacttctgtaagtattatagcgttagcaaaatgacgtcatgcctagagaaaataaaacagcagctgcaagatgtaatttcacaaataataaatccaaacaagaatagaaaaatgttatttaagtgggattatttactttgaatctacagaaattccatttttagctagtagagaaaaatttatagcactgaaacatattaatctgctttgtattaaaaggcttatctctggtgcttcatttgggtaattttcttatattaactccctgataattctaaattagcccaggtaatactaaaatttcaatctgaggaaaaactataaaactgatgggattcacaccaattttcagcattcataacaaattaccctgtttgtttatatctgaggataacatgaaaaatggtttaatattttggttgatggtcactagaaaatttaaatttccctgatgaaaatatgctaattccttccagattataatctgtgacaaatttgttttattagcatctttcttttattatttccatccaatagctttcctttatcagtgtaaaattattgctgttccaaatataattttgaaagtttaattgcgaagacatttacgtatactaaagatatttaaaaatatagtttatttttatttcaggcacagaatggctcttttccttgatattatccatattcatgagcaatgattggtttaataaaaattccttaataaaaccttaattactttcatttgcttctttataatgctttaatacagggtaattgtagtttctttttactgaaagagatgaagactatcttggttaaaaaaaccccagatgaacaaaaagaatgttttaataaaagcaagttttaaatgatggtagaatcaaacactgcctggtggctatgcaggactttacgacagcccactggcttgctttcagctctttagacgtagcatgaatcctctcatgtgggtgaggctcaaaccaagcccaaaggaaagctgggcttcattcattttaaataaatgtttataaaaatgtatttacaattaattagtgaattaaggcatctacttagtgtatttatgaggatttattttaaacaaatttgtcatttcttttgggagtgacagtttgtgtacctggggggagggggaggaaaaaggagaagaatggggacaaaaaagttctttttttttttttttttgagatggagtcttgctctgtcacccaggctggagtgcagtggtgtgatctcggctcactgcaagctctgcctcctggattcacgtcattctcctgccccagcctcccaagtagctgggactacaggcgtgcaccaccacgcccggctaaattttttgtatttttagtagagacggggtttcaccatcttagccaggatggtctcgatctcctgacctcatgatccacccgctttggcctcccaaagtgctgggattacaggcccgccaccacgcccggccaaaaaaagttcattttttaaaaaaaccagagttaggcttggttgatggtgggagtgggagggggaggggtataaaggggctgtcaccactacctcctccacccacacccattcacactttgagtccctagtgtgtggaggttgaatgattaaaatatagaggcccaggacgccctgaagtcctgttatactattgtgtgtgtgcatctgctatacaaacgagtatttggatgcatataaactctcaatatggccccgagaagcaataaccctctggagtggctgctaatggagatcattttgagagtccttctagatggaaaacattcctataccacactcactgaatgcttttaaaaaattaaagcgtttatcttgagtcgatgttagatagagtttaccaaatgttgctgtaataacagctccttaggccaaggcttcttgtaggagtcccaggggttggttggccacaacaaatgacctctacgttttcctctttaatattccagaagaggaacctgctgttgcctttgcagtggggattacacaaaggtcgattcttttagaatttcaacaggctgaatcatcattctaggctgagtctcagagagccggcaatgggaagaaagggcctctgaggctgataggcgtgggaggtgaagagagagaattggagtgccatggtccataacaccgtaaactctcattctacagttgccacataacgcttcaggtccaaatacagaattttttaaacagaatcacttaggcacaaatattgagaattaggtagaattattcttgctcattttcaaaatacatacaaaatttatttagccccagaatggatgaagaatgagttgtccttgacatttgaaagtaattcagatctttgctgttgcatacaaggcaaattctggcttaaactgactaaatttacctgggtctccatgcaatgttttaaatctgcagattctaaaacaattttgttataagatacagccatcaatactaaggtactgtcttgttcgaagccaaaactgatcccagcaacattctgatgttcaaatttcagtaccagcagcaaacattaaaagtttagatcaagatgataaacatttagatggcaagaagccagaagtcatattcactttttttttttttttttcagacagagtctcactctgttgcccaggttagagtgcagcggcgtgatcatggctcacatggctcactgtagcctcaacctcctgagcccaagtgatcctcccacctccgccacttgagtagctaggacttcatgcacgtgctaccatacctgactttttttttttttttttggtagagacaaggtcttactatgttgttcagccaggtctagaattcctggactcaagtgatcctgccgcctcagcctcccaaagtgctgggattacaggcaggagccactatgcctgaccctcacctaaatttttgattagtttaaaaaataaccttcacttttgttttcagagcctgaattaattttatttaaaatcagttaatattacagacaaaagactataattgactgatttttttaaaaatgaaaatcaaaactcagatgtatctatgatctctcttttcattctaaaatggagtatacatatcctagtttctttagaattcttctattagatgtttaccaaaaaggcacaacagatcaggctctattaatggaaaatgatgcctgtcccaaactggatgcctatctgcaactggcaatgcagctactacaagaagtagaaagctcttcacacagtagtttttttaagtaattataattgaaaataatttgtatgtcagtgtttggtagtggccatctgtaaaagtcatgggttcatctttgatcacagcattttataaatgaaccatagaatttcatatttctcaggccccaagagatcaacagttaggaatacaaaattaggcttgcttagaactatagccttcctcaatgaccttgggtgtgcaagaactttgaaaaaatgtcaccaaagcaccaaggctgagttgtataatctctggaaagtggtcctggaacttttttcctaaaagttatgacagttaaagactatactcttttatctgacagctgtcatattcttctatgtgtaaaatgatttcttatactttgttgtgtttcttggtagttttgtgccctgaattacatacattaaataaagtaacttaagtttgacttttcaataaatagcataatgaggaagaggagagagagaaagtgaaagagagagagagagagatttaaagacaaaatacccccactatctgattaaaaaaaagtaaatgcaggaggtgaaatcaccataatttttggccctgggttaaacgatactgggacagatacattttcctatccctgtgttagaccatgctgagactgatcaaaaataatttaagtgcttgctctaggaaacactcgcctgtgaatgtttaggctgtgaactagagagctggcttatcaagagtaatagtttgctcatcatgacccatttcaagaccctcccctcactgtgctactagttaaaactctgcccaatccccatggttccccaccttgcaatacccaccttaaaatctcccagccaaggacctacagccttataaataccctgccttcattttcccttttgacactaagactctttcaagggagcattttagatccactgcagtgagggaggatacttactgcagtatgtctaacaaacccagctttgctgatcaatgggtttttatggtagtctttggggagctgacagctgacaaaccatataaattactgaaaatgggtggatggctaatgtcatctttggtaaaaaatagagtctggcaaattcttgaatattcaggggatccattatccataaattcatcaccttatctctatgcatggaacaaagggtattgagctgtttacagttccattaagtactataacccagaagttacacagccagcacacatcttggcaaggcccctagctgccattccaaactctctgggtctcgagtgagcatgcatatataacctcttacaaagatagagacggctattgccttggggtttctttttttataatataggtagcacatctacctcataggtcctgttgatgtcaacataagcgcgctaattgaattcgtggacgcttgcttatccaagagtccccggattggagaccctgttatgcactggggccactttaaagagcatcttgggttctacggctttcaaagaaaagcaaagcaaccttgatgaagatatggtggcagagtaaaaagagcaacagctttttcacagagcatcactgaactacatgtccaaaacaagaccacattgaaaaaaacacaacacaaattgtagccgaaaatatctaacatctttgagttcttgtcatgcactaggatttttgttaatcacctgcatgtattaacttgtgtaaaccttcaaccaagtccattttacagatgaggaaactgagacacagaaaagttgagttacctgtcaaagtcattcaacttttggggaaaatgaaggtcagataagagtctgactgtgatgcatatgaacaatcagacaaacgtcagacacataaatttgctatttgaattggagggaagagatgtggcgtgctatcctttcaagcagaatatatgaacacaagagaatgttctgcttttcatcttttgccagttcccttttcgcccaggtaatgtagcttgagaaatttaaagaaggcatttgagttcacagaaggaagaacattcagttttatatgtttttaactgacagatacaattgtatgtatgtatcttcatacaacatgatattttgaagtatatacacgttgtgtaatgattaaccatagttaattaaaaagaactttcagctttgaaactacttttacaactaatttttcttgcaagcatttaattctgccgacctctactaaaacacacatacacacacatacacacacacatacacacacacacagctacaaccttctgtgggaagcatggaagaaacatcagattgagatttggggtaatcaaaaaacccaattgttcatctattcaccacactaatttcatgactagatctttttttcagttacatcaaaattgtctgatactgtattagtccattttcatactgctatgaagaaatacctgagactgggtaatttataaagaaacagagatttaatggacttacaattccacgtggctgaggaggcctcacaaccatgggagaagacgaaggaggagcaaagggtcgtataacatggtggcaggcaagagaatcacgtgcaggggaactgccctttataaaaccatcagctcttgggagacttattcactatcatgagaacagtatgggaaaaacctgctcccacgattcaattacctcccatggggtccctcccatgacatgtggggattctgggagctacaattcaagaagagatttgggtggggacagagccaaactatatcagatactgttgctctatcataataatgtcactgatgatcatgagccctcatttcctgagacattaccatgtcacatgcactatttaattaaatcctgaccacaaccttagaagaggggtactgatctgtgaaggaaaccaaaggctaaagtggttacagaaatctcccatggacaggtaatgaatgagagagagagctggggtataaacacaggctctcacacttccaattatattgtttcttacagacattctaataagagattatttttcatggaaaatatgctatcactggataataatattaacactcatctttaatttctgctgatcatgctcaaatttatatttctgagtttcatttctataattctgaatgtgaacatttattactgcatattttcctccaaacatattctcttcttccttttggtttttcagcaggtattttgtgaatgcctgttgagacaagacattgctaggtactctaaggaatacgcagtaaattagtaagagtccacttggggagaccaaattacacttgcccagggaaaaataaaacacattttatagagttgtagatgctaaagtccatcaactgtcagaggtggtgtgtcatgaaaattctgacagtgaaaagtcaccatgggagggcatcacggaaggttctatgggagagggaggtcttcactggcccctgaagaacgagcagaattagccagaatgagagaaaacattcaggtatcaagaaaaagtgagcaaaggcttacagataagaaagggtgatggataacaatcctaaagaccgtgggcctaattgtagagtagatgccacctaaaatattaattgagtaaaaaagttcaacaacaaaattatacttacattcggacaattgtggtcttacactagaatagtattaggtcggtgcaaaagtaattaaaaacaatgacaaaaatggcaattactttcgcgccataatatttctcatgtgatccacctggggggcattaagaaagataccgatgcactagcttcacctctggaaaatctggaaagtgatctggggtgggtcctgctacctaagaattttttttaaaaagtagccagagtgagggaccactggggctgggagttattttatcttagtcctggtgactttaactgacttcaccaacatcagcttcctcctgagaaacaggaaaaaaaactctaagttatgactatgggaaagtgactactgagtttcatatgtgagatcttcatactttagcctaatcatgactgaacaacttcattcatttatttatttgttcatttgtctcattatccatcctttcagttgacaaaatcttctttgggtccagaactgtttcaagccttagggcaagcaaaccactaaagaattcaatctcacaaacattcagcaattttggttcagttcctctgcagagctgggaagacaatgataggaaaatgaaagaagtggtctcaagcctcaaggagcttcagtgggtgatagaggataaaacaagaaagcaaacacatgtggtatgtggttaaggatggagagcgccaatggggaggaaataacaaaggttgacgttaagagaagatgcagcgtggagcttcctggcactaccaagaacaggatgtcacaaaactcataatatcaattaggcagagagaacgtcctccttggaaataaaaggaaggtctgcgtggagagagagtgttggagaaggtatgatggacactgaattcactccctgtgcacacagctaggtttccagcaaggactatacagtggaagtgaggactccaggaagagagtgggacataggtattgtatgttttggacctaagggaaatcactgtgcttttgttttttagtgtctggatggcgaaactgatgttcaatgatcaaattcaaggcatttaattttcagcttcctaccagctccatatatacaacactgtaatgtctggcactgtatacagtcaggactcacattgtcataaaaaatgtcaactttgcccacatgccgaacttcccgggtacccgtgccctctggcttgcagccaaccacagggttcagctaatggaagaataagtaggcagtcagagggcaggaggagagagagctggggaatgttatgcccactcctctgctgtgcccctagggctgggaagccttgtggctagagcagcctctcttcacggctcccaattttcccaagttctggagactgtgtttgcttccactgcttcccgctgctgaccaccctctagatcagtatactaaccctgtcgactcctcggaagagtccctgcattggattctgtagagaatcccagctgagtgttcttttcatgtcctgtggaaaccttgatgagagctgatgtgcagggggcactttctaaaaaggacctcagaggccactataagaagtttcaattttatccaccaagtgcagtgggagggataccattaagcaggtaactgtcataattgggtttttgtgtttgttttataatgtttcattccttcttggtggatcaatagcattaaataacaaagtacaagataaattcccaattggagctataaggttaggctttgaaaaatcttttattaaaacttaagatgaaattcccataacatacagttaatagctttaacatgcacaattcagggttgtttagtgcattcacagcgatgtgcagccattacctctacctacttcccaaacatttctgtcaccccaaaaggatggttggtttttaaacaccattctggaggcatgcagcagagaacaggctgaagtgcggtgaaaagaagtgggcaggcaaggtaggaggccacttcagaaccctaagggagaaatggccagcagagatggacgtggtcaagtctgagacgtaattcagacgtaacactggctggctggcagctcggctggatgtgggggtgcagggagatggagacgttctggccttgagcacagaggtgaggaacactggaggagggagaggcctggcaggaagttgtgggctccagtttgggatgtgttaacgtttgagattccaatcagacatcactatcaagaggcagctgggtgcatgagttgagtgctgcacaaaggtagaaatgtagagccttcagcatttaaatggtatttaaagccaagggactggatgaagtcacagaagtaaagaaataaagggttcaaattaagaaccagcagcccagggctggtcttgcattgaagagtctggtggtgaaggtaatttggtataaagaagaaaaagcagtgtaaaaaaatgtagttgcacaaactgttaatcttgggatggtttgctactcttgaatgtcagtggaaaccttcttctgttagttgctgacttattttttttttaaatatcacaagtaatttgaaactgtttctcttttattgtgcatatttgtaaaaaatactgagccgcagttcccatttaaaagcatctgtttcaggactatcagagggttgattgaggacaaataaaaatgcgttagccagttgatcattatggcacgtattcagtgattatacgcagagcacgtcacaagaggggataaaaatcacttattttaggaatttcctgagtcaaggcaggagcaacatcagcagagcgtggcaaagcacgcagaacggtgcagcctctattatgattggaatgtaaagtgtaataggattttcagaaaacaatttagaaaaagtgacaatcttgcttatttaaatgctatgtgacattcagcactactccttgaggtaaaattacaaaactgataaactggcttttcaagatattattgaatatgctgaacacaggtaatgcatttatctattaactaacccttaggttagtataaagctacattgtttcctgagaatggaaggtgactttcctgagttgtgataccaaaactttggaatttctatgcttgtgtatttcaaaccaaattttagattgcttctatttttttttacatagtaatttctctgtatggatatatatggtataaaataaattccattttatattataattaatctttatcaaatcttaggttcagaaaaagtgcatgtttttggtatatattctcaagttttctagatgaacataatagtattattttctatgattataaaatacacatggtaatattaaaatcttcagcctattaaaaagggataaagaataaagtaagaataaaatcacccagagataatgagatttgggagacaagctcttgtttatcgctctattcttatcatatactcacatgtcactttacagaaatagaatcccagcacgcacgctgttcgttaacttgacttttgcattcaacacatgttacggatatattttgatatcaacatctagccacatcttaatttttaatgcctggtaatgctctatttgatggtccatttttatctgattgtgtattgatggacatttaagttgtttctttctttttttatttatttattttttttgctgacattggctcttactatgtactagagtgtttgaaatgctttccatatattaactcatctgctctaaagatgcttcttaatagtctctcaatatgaattcctaaaacttggatcgctgggtagagtctacacattttaaatactgaggtatattgccaaaatgctctccagaaagatcaccctcttgacactgtcacccaatagtgtgtgttgctgcccctcagcaaccctgggtgccagcaatcattctcatctttggagatctactagcagacatggcatctccttcccatgcgcattccttttaattaaccttcttcttatgagtgtagtagctggttgcatgttgttttttgaaatgccaattcatttcttttgttattttatttcccagttgggtcatgcatgggaatgaacacataagttaagctactaaaagttgcagagctgtagagacgctaaagaactgagaagttatcagaactagtactgatgcccaatatcattatttttccttcttcttatcatttttgtgacccttagtctattgacacctgtatttctcttttcatggtatcatttaattcatttgttttctacagtgaatcctctatttaaaaatccaggggacatttatttttgctgtttcccactgacatgattcccccatcttctgtcttggtgagagcaagctttgacgatttataaacacaaggtgtaaaaaggctttggaaacatgtagccaccgacatgttcattgttgacaatggacattaatattcacacactgtttccatggcaaactcttgtctctgttgctagtctaaggatgcaaagctctagtcattcactttaccaagtttatccattttactgtgtttggaggttgagaatgtaagcactgatacagttgaaaacaagatgaattccttcatggagtgagatcctattgaactatctagtagcttctacctctttctccaaaccaccttactctgtgaagactggtttccttatcctaacttgcaataatgggaactcaagatccagcaaaatctgaattgggctctactgtcatgactgattcataatttctagctaaaaatccaaccataacctgactgtgctcaccccctctgtttatctcaactggctatttattccaatctatcatgtcattgctctcagattaatgttcctaccctgcaggagggattcatggcactgccctactcaacaaccatctgtttgtcccatcctccacagatttagcaacaaatgacataacagcatctaaaagtccaagtttgtaggatttgctgacttgtttttcatataagtttcttacataaactcttaataagagtaagagtaataacattaaaatatgacctctcttctgggagctgagctaatgaggtccaggtacataatcttgtgattgaatgttatgaacagatggagtttataaattcctgcaaagatgcatgagtattacatcccttatttcacgtcaacaatttccaatgcactcaggttctcagcagggactatataagttgatggtaaggccccaagaagagagtgaggtttagacattctgtgttttaccctcaggggaaatcctggtgcttttgtttctaggtgtctagataggaaaattgatattcaattataaaattcaaggcatttggttttcagtttcttactatgtatctacaacatggtgatacctaacactgtctatagtcaggacacccattgttcttagacagaaagaaaggacaaaaaacagctaaaaaattattggcctatacaagactctaaggcactccttatttgtgattccagaattttttaatatagaaaaattaatcaaaatatatgtataaaatatatgtattataagttattaagagaagcttttacctatcacctcctggagactaaaaaaatatttaaaggaagtgaaattttgaggaacttttttttggtcttgttcacagataattagatctacaaaatgctctcattaaactacatggatcaagttagatggaaatttatatcatccatctaaattctgaataatatattgcaaaaacaacctttgtcattttgatattaagttgttctttatggcaataattagatagaagtgccatttatttccttaggtgaattatgatttgtgatgataaaatcatatcatcagataaaaagtatcctcaattccatcgcaagaaaacatgcatcaattaatttaaatactatagcaagttgtttataccagaggaatgtatataagatgatacttgttggttcctggtagctactgatattctggcagtggtgttggcgaaggcaaagaaatagaaaaggaagacttgaagaagacacaaagttggcttaggattcaagctggttttatattgtttaggatagaaatgggatctctcaatgcccatttctattcctgcaatagtgttcaagtattctttatagatgtgttaacatactgtcacccatgatgactcacacattaagcaagtcttactatgaaatcaaagatggatgagcatcagtgaataccaataagtctgctactgacctaagcctttttctcagtaggttaaaaggagaacacaacagtggttattagttgaggaatactcttgaagcctgggaatgcagctcaatgtggggaaaattggaatatagtttccaccaaattagtccaagagggatttattgaactcctatgatatgctgggttgaacatcatggaaacaatcatgactatgaaacttcccctactcttaaggagcttataggttaatgtaggtgatagagaggcagagatgatacaacttgaatggaaaacctgtgatatgagtcctggtaggaggagtatgattaacaatgcgtcataatggaagatgatgctaacaaaatgaggcaaatgctggttatggaggtctgagaaatttgagatgtaagacatcagtagagcctagcagaattttactctttaaaaagtatatatataattggaaatttatggtatataaatggttttgttaaaattaattagactcagggcactcacaacattgaatcattttaagttggcaaagaatgtaatgatgattatcaatttagtgtaccaggaagacatatacaatacattcttcgccttatattgaaatttaactcttagaaagacatatgtcctactgatctttatgatactgtggaactacaatagcttatagctagaaaactcttatttaaaattaccccactgagatgacagtgcatatattttacaactatttcttaattatgaagatggtatgttcaacaatgagcagataatttttcatagcttgactaacttttctcaatttcagttgcctacagtctcttggatggacacatttcaaggcaaatcacatgggcctttattcttaaagatacagcagagcaattagtccagcgtggtggcaggtgccctgtagtctcagctactcgggaggctgaggtaggagaatcgcttgaacccaggagatggaggttgcggtgaaccgaaattgcaccactgcactccagcctgggtgacagagcgagactccatctcaaaaaaaagcacaaaaaacaaaaaaacaaaaaaacaaaaacaaaaacaaaaaacaaaaaaacataaaacagagcactgtactatattcctaaaacaaggttatcacagaaaatatgaaccatgcctttaaatatacatatttatctcgaactcctgacctcagatgatccacccacctcagcctcccaaagtgctgggattacaggcataagccactatgcctggactaaatatacatatttatctgtacctaaccctgacattctataatgtctccatttttagttatcttcacaaaggagataggagatatatttgttataagagatatggttttaaaaaatcattttctgacctccacttctaaaagttagtaaatttgagggctgaggacctattgacacctcaaccctcttattaaaggcttaaatgactctcagaatagataaccctggatattatataatatttaaaaaaatatgtaattggcttggagaaagcaggtatttgtattccaaaatgatgctgcgtaaacatggaagaacttttggtttggtgcttattacattaaccttttaatatttccttctcaacctaacatggggataacaatgacacacattttatttgctggaaataataaactaaaggctctgctcattgaagaaataactcacagcaatgaccttcattgagggatcgctgaggctagagcactaattctgtaactagcaataaaaacagggttgatatggtttgctctgggtccccacccaaatctcatctcgaattgtaagccccatgtgttgagggagggacctggtgggaggtgactgcatcatggggggtggtttcccccatgctgttcttgtgatagtgagtgaattctcatgagatccagtggttttaaagtggggcacttcccccgcatcgctctctctctctctcctccactatgcttccttttggccttccgctacgattgtaagtttcctgaggactactcagccatgtggaactgtgagttaattaaacttctttcctttataaattacccagtctcaggaagttctttatagcagtgtgaaaacagactaatacaagggtcatgtggccttaaatgtaatatgttattttggaagcagagtcctaggttaatatttaaagcatttaaagaaagaaacataatagcgattggttgagaactcacttttaagtttcacacactgaaagcacaagcaaggcttatgtgcctcacatattgtagagtctcagcatcatggtccctgcaagcagatgggctcctctgttcatgtccctgacccccaaggcaggatgtagagtgaagaaggacctcacttatcctgctggggacagggtctgtaacactgatctcttttccatatttgccctagggcttagctgagcaacacactctagatcctgctacctcgtagaaaacagtgaaaatgtgatctggctctttagagaaccaaactgaaatacatcactcctaacgatgccaactggcaactcctataaagagttcccatgtagcagggatgctggctcccatctgagttgatgtctctgtcctcttcagagttcagacagggctgagcactcccggttgcctgaggatgtggagctgacagagtctactagtatgtgggcccggaggttctggggaagaaccaagtctgtgcacttgaggtctgggatgtgtttgggcaggttaggcaggctgggcagaggctgactggtggggcaggaaaagctcctaggagggaactgatgtgaatgcaaaccagccagcgggtaccaggagcagggtgcagtggcggggagggtggacccaatgactggagtgggagccattatttgactcgcccttagcccagcaacagagaggcaagtctcaattcccgggaaagaggctaaggtgggaaaagctctttctgtaatgcctggggtataagaagtgctcttcagggattctagtacaaattgtaatgcaaggggcagtgagccattctttctctctggcttacctactacctcatagctgcagtctcctgggggctcagggtagacacatgtggggccactttgcccgggaagcagcaggtgagatggcgacaaccagcagagcacacaggctgtgccccggggagccatggtgaccagctgagagaactgcaagctctaaaagcactgtggaagcttctgccaagcccagtgtatagaacagatacacaaagaagtcggggatagtagtgcttccagtgtggaactgcgtctggtagagcaggatggtagggagggctgtgtgatagccaaaaacccaggaggctccgtgtgtatgtgtgtgtgtgtgtctgtgtgtgtgtctgtgtggtgtgtgtgtggtgtatgcgtgtggtgtgtgtgtgtgttatgtgtggcatgtgtgtgtggatgtgtgtatgtgtgtgtgtgtgtgtctgtgtgtgtgtctgtgtggtgtgtgtgtggtgaatgcgtgtggtgtgtgtgtgtatgtgtggcatgtgtgtgtggatgtgtgtgtgtgttatgtgtggcgtgtgtgcatggatgtgtgtggtgtgtatgtgtggtgtgtgtggaggctatgtgtgtggtgtgtgtgtgggggggtgcgtggtatctgtgtagtatgtgtgtggtgtgtgtgtagtatgtgtgtggtgtgtgggtgtgtgtggcgtgtgtgatgtatgtgtggtgtgtgtggggtgtgtgtggggggtgtgtgtggtgtgtgtggtatgtgtggggtgtgtgtggatggagtgtgtgtgtggtgtgtgtgtggatggggtgtgtgtgtgtggatggggtgtgtgtgtggtgtgagtgggcgtgtggtgtgtgtggggtatgtgtgtgtgggtgtgtgtgtagtgtgtgtgtggtatatgtgtgtggtgtgtacgtgtgtagtgtgtgcatgcacacacccgggcatgtatgttcatgcctgcatgtgctggtctgtgtgggtatgcctacattgcacaggtatgtttgcatgcacccaccttcgtgtgcacatctaagagtgtgcacacctgtatatatatgtctgtgtgtgcaagtaaagttagtgacttagtttttggaggagagggatggatgtgagacacttggttttaagtaaatttgcctcaacttcaacctctctcttcccccatccatgtctaggtagcttttccactgcccacgatggcttcaaaactcttaattgcaggtgattgccctcaacttcccgccctcaacttcccacccgcaactcttactactagccatgtcccccaaggattgggtaatactatctttgtataaaagagatacagcaaaagaaactggcaacagtcaatggggagaagcaatgccaagggtagctgtgggctgttgtccttgcaaatttcatatgactgacagactttctgtggcctaatgattttttaaaaggtaatttgcatagatatagctgtttccatagcaactcagattgtgtttcattacactgcagccctaatggcaagcagctttaggaaagctacctagagatggtgagggagccccctggaggtaaagggaattttagtaagatcctggtatttggagtttggatcagcaaattttagagatattcctttccattcactaagcatgtggcttatctaatcagacatagtgtttgcttttgggagagttgcccttctgagatcacctgatcatttccttcttttcaatcccattttcattagattcaaattataaatacctagccatgctcaatgtgaagtttatacatgacaaaaaaatttcacatctgtgtttatacacttcaataactaagttaatagcaagggcagttttgcagaaaattattaaattgatagactgcttgaaaatcctaaatgatccatgttcatctcataactacaactgtatgttaaatacaaatttctatctcctgttaatttaacgaagccttaggaagtctcctgaaaaaggcatggaaagtaaggcatattaacatgcccctccacccatacgtgtccttaataaaggatgcacgtgattggctgtgcataagtgattacacagatcagaaaatgccccaaggtcaaaagtagagaggatggcatcgacactctccagctagcgggtacagatacccagcagctaaggccccactgctaaagaagagcaaatcaatttagtttcttttttttttggtttttttttttttgagaccaagttttgctcctgttgcccaggctagagtgcagtggtgcaatctcagctcactgcaacctccgcctcctgggttcaagtgattctcctgcctcagcctcctgactagctgagattacaggtgcctgccaccgtgcctggctaattttttgtatttttagtagagacagggttttatcatgttggccaggctggtctcgaacccctgacctcaagtgatccaattgcctcggcctcccaaagtgctgggattacaggcttgagccaccgcgcctggcctagttttgtgtactctctctctttctcactcgctcatgctgtctctctctgtccctccctctttctctttctctcaaactcttttctttcattaccacaagcatgcgtagaaccaatataaaattaaacatctgcttcaaaactgcaaactcacttaaaaggcaaagactgaaacataacaaaaaccgctaaagttaatgtccaagacttcttttggttaataaaagtgtttctgaatgctttgaaatcagtatctcgcagtcttagatttccatgcatattactgcctctcactaacgatggaggggaataatttttaagaataaaggatgggggatggttctttctaatctaaaaagaatcatttgacataaaatgtgagaaatgaaagtagccttttttctactgatacctgtgaatgcaaatgtggttcactgttaagtatatctggaaaccagataagagcgcatgtttatgtttgcttttaattaactgcacagataagcctcagaaaataaatttgtgaacagagcaggtatgccacttgaaaacagaattgcacttatgaattaaaatccattttctcaaaaaaaaatccaacatgcatgaaagccaaatactatgtagggcaagcagctcttttaactaatatgtatcataattttaagtgctaactgtgtttgctatagactgctgtacttgaagtactgaatgcttttatgctcaaggttccatggtttttaaattgcctgaaaatatgtcctaacttttaagttggccgactgtcatttgcatagtagattaatccttgttcactattgtgaattaatagtctgtggaattattttgtctcatcaacgaggacacagctgactctgggtgtgtccctagcaatttttgtgtgaagtgaatcaagttatgtagaaacttatcaagcacgttcctcattattccttccacccaaaggcccttaacttctagaagaattgtagattaaaaggcaaatatggatggaaggagaagaccagactgtttgaacccgcagcactcggactcaatgcaaggagagtggcaagcagatatgcagaaggaagctgctttgcgcaggagtgcttgtgccttagtctgagcaggtgtgcaagaacacacatgcccacccctgcatgcacacggatgactcagttctcaatccattcttattaaagaagcatgcaaagagagtttgcccctgtaaccttcgtggcccatgttttattctcctgctcccattacctgcacgccaaacccatatgcatctttaaaacccatttcaaatgttgctttcttcataaagtcttccttgatctcttcaactgaagtttctctttcctcctctaagctcctctggccctctctccatgcttttcttatagaacagttctctatctccctctccctaactcagtggactgctcctggagaacagagctcacatctacatcatttccatatgctcttgtctaccctgactgagcaaccttgtagtgctgctcaggcatctattgtgaactggagaagaaagaaggaagacaagaaggtcaccttctaagcagtcccatttcctgacttctctgggattacaggcctcatgatacaggctcctattttaggaaaccacttcacagagattcttcttctgggcattccctggggatggcacacagttgatgtacacagctgccatgatggcaacgacaacagccgtcatgatggaagagcgagttgctaagtgaaaagagttttgcatgtgcaaaactgaagcttctcctcctctaggctgagtttcatcctctaacggataaccaaaaaggaagtttatttcaaacgtttcatcaggaatgacaaacaaaaacatctgttggaaaggaaaccaggtgttgggcaagggatgtagacgttatataatttggtgttctcctccaggatccagtggggattgctatgttgtgttcgttaacactagttaatgtaatttttgtgataattgtagagcaaatagagcaaactctcaaatataattagggaaaagtgtttctaattaacttgtaactcgtgagttgcaaagtaaagccacaaatcagttatgcattgtcagacctaacaaatggaaatgcgctgtacatttcaatctcggcaaatacaaaacaaagcacaaagacccagaaaaactttcctttaagcctttatacaattttggcatgctctgaaatgtaattagagataagcacagatacatctcacgtcaccagccctaatgatcacggaggtgaaaactgaaggcaacttcagacggttcaagaacatccaacattttactgctgcagaatgtaaaatggatcatgctcacaaaacactctctgatcggtgtacagaaggttctgatgaaacttcacaaggtttcatagggaagtaaaggactataatatatgcaagctccaccccagttaacactgccatcagtaacagttgcttactgctggctgtaagtcagagggggatacaggaaatttcttctatatccagtggaagcgattccacttattttctctctcacttgaggaagcacactgtaatatgaggtaacctcaaattcattctaatttgaaaaaagtgataaacgggccatatattttcattggatagtgtagttaccattagcgtcaaattattttggcgtctctcaaaacacatccatgtctcctaatcctccacccctctgcagtccactgtaattgttggtcctgttaaagtagaaagtggtgtttctcaaacatgcatgatcctaagaacctcgagagggtattgctaaatgtgtggattcccaagctattatcgtgaaaatctagggtccagaaatatgtattgttttatcaagtgcctccaaagaaactcttatgattggagaaactggaaaatcactggtgtaaagcagactggctttggaaatcaaggactacactagtaccacagaccagctgtgactttaagcatgccccttacatccaacctcacaggacctcaggagtattcaaggcaatgatagactggacggtacgtagcactatgaccggtaagtgtgggtgttcgtaaatgtatgcttatctcttcttggtccacaagaaagaaatgcagagaatacctggattctcaggttaggcacattggacaacaataagaatgtaaaacacaggaaataatgtgacatattggctctagaggcatctgcaaagtcctactctgtgacaaaggtaataaagaaggggtattaagcttgacttacccatatataaatgttagcagtctaatcttaccatagcacaactaactacaactcccttaaaaagactgtttatgagaaacagagacaaatgggacagaatagagaactcagaaagaagactgcacatctacaaccatctgatctttgacaaacctaacaaaaacaagcaacagggaaaggactccctatttaataaatggtgctgggagaactggctagacatatgcagaaaattgaaactggaccgcttccttacaccttacacaaaaattaactcaggatggattaaagacttaaatgtaaaacccaaaactataaaaaaccctagaagaaaacctaggcaataccattcaggacataggcacgggtaaagatttcatgacgaatacatcaaaagcaattgccacaaaagcaaaaattgacaaatgggatctaattaagctaaagagcttctgcacagcaaaagaaactatcatcagagtgaacaggcaacctacagaatgggagaaaatttttgcagtctatctatctgcaaaggtctagtatccagagtttacaaaaatacttaaacacatttataagaaaaaaaccaaccccattaaaaagtgggcaaagtacatgaacagacacttctcaaaagaagacattcatgcagccaacaaacctatgaaaaaagctcaacatcactgatcactagagaaatgcacatcaaaaccacaatgagacaccttctcataccagttagaatggtgattattaaaaagtcaagaaacaacagatgctggcgaggctgcggagaaacaggaatgcttttacactgctggtgggaatgtaaattacttcaatcattgtggaagaaaatgtggtgattccatgaagacctggaaccagaaatatcatttgacccagcaatcccattactaagtatatactcaaaggaataaaaatcattctattataaaaatacatccacatgtatgttcactgcagtactagtcacaatagcaaagacatgaaatcaactcaaatgcccatcagtgatagactggataaagaaaatgtggtatatatatataccatagaatactatacagccataaaaaggagtgagatcatttctttgcagaaacatggatggagctggaagccactatcctcagcaaactaacacaagaacagaaaaccaaacactgcatgttctcacttaacttaaaagtaggagctaaacaatgggagcacatggacacagggaggggaacaacccacactggggccagtcagggagttgggtgagggagagcatcaggaaaaatagctaatgcatgctgggcttaatacctagatgatgggttgctaggtgtagcaagccaccatggcacacatttacctgtttaacaaactgcacatcctgtacacgtaccctggaactttaaaataaataaaatttaaaaattaaaaacaaatactgtatatggaaatgtcttgttcactgagacactggtgccaccatcctggtcactggtaagagagccatcccataaggaagggggagctatggctggaagaagccatatggctagaagggtttctgaagactctatgggatacagctgcgttatcaccttggaacacttaactccagatttcacgtatgggagacaaaacttcctctagtttaacagatcattatccggggcttttcctttcttcaaacttcattctaagtagtaaatttctatccctttctaatctccttagcctgcttgatttttcttcacagcacttgtcacatgctgaaattacagatttatttgtctcagtttattgtctgtcttgtccactacgacacaagcgttaggagggcaggtctacgagttccagcttctaatagcccacaatggttctgttaatagattatgaaatttcacttattgtcttgacacagttcactcctctacatatgaatcaatggaaataccaagactcctctcaatgctgctccttcttttctcccttcctccatgtggctccttgaaaaacaggtgccatgatcttgaccattaggaagaaagccatatcataaggaaggctggtctatggctgtaaggtgcctgggtccttactccttgtatcccaagcacctaaacttcacttccatatacatttgactttgaacaacatggtttgaactgcgcaggtacacttatatacagattttcttccacttctgccacccctgagacagcaagaccaacctctctgcttcctcctcctcagcctactcaatacaaagatgatgagaatgaagaccttatgaggatccactcttacttaataaagtgcatacatattttctcttccttataattttcttaataacattttattttctctagcttacactgttgtaaaaatagagtatataatatgtacataaaatatatgtaaattgactttttatgttactggtaaggtgtccagtcaacagtaagctatttgtaattaagttttggggagccaaattgtatgcaaattttcagctctaggggttgtcagcacccctaactcttgggtcgttcaagggttaactatagtaggcactcagcagcaatttgtttaatgaatgaatgaatgagactcacagtctacagaatggcttctgtctctaggactgagggtggagtatacagaaagttaaaggtgtggatttcctaattggattacagtcagtctgtttggggaagcaattaggaatcagaacagtgctgagggttgtaagtttttgccctctgcctgtgcatatgatttgggcttgcctctgtgaagagataatcctaaaatgttcaaaatgacaggagacaagaatgggcaatgtctcagcatagaaggcatgagatacaaagctggttaggagatgacttgccatcaaaaggtagaccaaatacttatctcctctgcccatcattgatccatcagaattaacagcaatgtactgggaaggattcttccccaggcctgatgtttccttactgcgaatggagcacaattatgtaacactggactctcccagcccctcacttgctcttcccctgagaggtagaggaacttgtccaaggcactagtaagcgtgcagggcttggcccagctctgagcttcttccactttgggatgaaaggccatgaggaactctgcttcccctggtctccataagatgtgccctagtggctggcagaggagaagggaagctgccctgatccaacggctgcctgtgccatggtagataagtctaactaattctggcatctggcattctgtgtgagcaaaccaatgtggctaaaaggcctggagtctggcctccaacccaacccctagcagtaatgaggtgacaatgtggccttcttctttattctgttagaacttggttgcagaagacagtatgaaatagaaggttctataaactatggcctgagctacctgcttgcataaatacagtttaatacacagccatacacatttgttgatgtattatctatggtgctttcatccagcacaggtagagttgagtagttgtaacagagacctagggcctacaagctaaaatattttctatctgtccttttactgaaaaagcttgccaagtcctgttctagaatctagaagagaatggtagaaaagcatattgcctctagtgcaatgctttcaggttcacgaacaacggaaaagtagaaggcaggcaggattcaatttcagcaaacactgctacacttccaagtgctgaaaagcaaagtgtccaacttaggaagcaggttcaagagaactgagccttcctgagatctgcagaaggaaagcagaggaaaatgaatcccagaaggacatcccatcccagcagtaaaaagaagtgctggaaaaatgcatttctcagggcctagagcaggagcaagcagagacagtggcctgcagtgcacacagcagaggtctgggcttgaaggcgcagcaggttcccccaatggcaagagcagcttcaattcaggagtctgttgagggtgattttgcaatcttcgtagggataggggagcaaatcaattccatcataaaaagcagagaaatcactgttgccccataggattgaggaaaacctgctaacaaaccacaggacagtggaaggcttgtcacgggacagaacacactcatgggacactggaccaaaacacctgactcccatagaggaaatccaaaatcaaaggtttccattatgtaggaagggaaagaaaccacctcatataagacctggagtggtgggtttgtgctgtgtcaccccagctgaactgcaactatgcttcccaggatttccctccctgcttggttgcaggttgagactgtccatggagacatctgcgggatgcctggcaggtccaagtgaagcacagtgctgagctctgagggctgcgggcagagggcatcagggctgctgcagtgtgtgcacgtaccccctgctgctgctccaccttttaggccacagctctgacagctcccaccacatcccctctttccacttccctaggtcctggccaggaataatcatgcagagttccgtggcaaagagcggcagctttgtgtatcactcatgtggcagatttgcagccagcgagaggcaaaagaggggtgccatttgtccccatgagtggcagctggctctggcttcccctgcttcacatcctgctgttctttctgactgctgcctgctggcccgtgtcaactgcaggcccatcaccagacacagcggcaaagccttccacaggcgttttcaccagctctcaccgtggtgtcaggtctaatcctgataacaagtccccctttccatgtcatctacagtgcttctgcctccctggtcaaaccatgatgcacctggagacaggcgctgcctctgctgccagtatctaaatgttgcaaggtggcaacaattcctgtgattccagtttcctaaagaagagacaatgggaatcgaggaatctcccttcgagtgggaaatgcatcatgccagaatgaacctttgcctggacttatttctcccaattcaggttaagtccacagatgatggactctcaaagccacacaacaccaggctggcatcccccgactaaatccaaggggtctccatgtgctcacttccctcagacactgtggggagcagaataatcattctccaaaggtgtccacatttgactcctcaggacctatgaatgggctcctttacatggcaaaaggggcttgcagatgggatgaaggtaaagaatctaaaatggggagactaacatggagagaatcctggatcagcccggtgggcgcaatctaatcacacggggctttaaaagtagagaatcatttctggcagtgatcagaggaaaatgtgaccatggaggactcatcagggatgcaatgctactggctttgaaggcagtggaaaggggtcatgagccaaagaatgtgggcagctttggaagctggaaaaggcgaggaaatggactgtcccctagagcgtcctgaaagcaacacagccccggtgacagctggattgtagccaggtgagtctgtgtcaggcctgtaacctccagaaccgtaagaaaatcaatcttccttgtgttaagctgctaaatgtgtggtgaactgtcacagcagccacagatgaccaatacaaactccactgacaccctaggcaaacctggtgagggctggcttctgggaacatgcctgtgcctgggatactttcccttagggggtcacaatgacttgcttgctacatttgatgggcagggaccattgttcacacctttgaacagtgagaggagggagaactgacaatgcaatcttgcatcctctgaggtcctgaaagtatgtggccaattccagcgtgaggcagccccgaattcaggctgctaaaggacccaggccccatagaggcacaagaatccccctggctgagactgtgcagaataaaaaattgggagaagatgatttttacacatcagctaacttaagaattgtggattttgaactttaacacacaatggcaagaggtattgattctttgactttaattcctttgaaccttaatgtcttcggacttcaacatgaaagtggatttaaactttgatttttaatttctccatgggaatttgatatttggtagggtttatattaaaatttgaagcatctctacattgctggcatttcattattgaaatgtctgtattcatttttatctttgggatgttgtttaatcttctcatagaacctctaatttgctaggttggacaatgtacctggacattatttggaataagaaataaaactggacttaattttaaatcttgggaacatagtaaccctgaatttggtttaaataatttgctcctctgaccccttttggtgcctcttggtgtaatatatgaattgcccaccaagaattccaggtgatccccaaaaagtgccatcaagatagaagaagagctttcttgacaaattacttagctcctgctctggggagaggggctatgcctctgggtgatcataacaaagagggtgaaggaaaaataggctggggatgttagtgggataaatgcatcctctctgttccagtgtctcctttcatgcagggtgcttcattaatgctatacctgaacttctattaaattagcaaggtcacttggctgaccttaaagaaggcctccagcctggcttctgtcagcaacagagataatatctgtaaacatatttatactttgtttaatattcaaaactgttcagagttcactgtatgagttctgaactcatacaggacagaagatgttatttaccatggacataatggaatagagaagagaatggaaggagtaattcagacaagaaatttcatcacatttctgtaagatacaaaacagccagaggtgagctgacagatggagctcagggagaagccagcatagcccaggatacacacagaggggaccctatcccagggaggtggctaactttcctggtggaacactaggaaagatttatactcaagagatggcaggcacctggggtgcagaaatgggaagacaagctagaaaggggtgattgaaaggaagtagtcacctctcattctccactttcacctaggttgaaagaatacccagcagacaggaaagtactgtccccttcctccaggccaacaaacaaaataaacaactcagaagaatctccacagagatggattgtgatggggagaaccaaaaaggtactgaggatatttgggccttagagaaaaaccctcctgattaagacacttaaaagactccccactacaacagttccctcccacccattcgccctgaagtgaagcttcactgtgaacaagcttcaccgacatgcagagagctcagaaaaactccattccactattttaaaaataagcagaaaacttgaagaccaccacagatttgaagtaagcctgcaaaatcagtgaaaaagcccaccataaaaaaagaaaagctgacaatgaaaaaaattgagataattcatgccaaagagataaaaacaaacttcagttctaactaatatccttagagaaattcaaaaatatcttacattcataaaacaaaaataggagctattaaaaaacacaaaagagaattcttagaatttttcttttaaagagatgatattctcttgggcccctggtagtgggagcatggaagtcacagaaaaattgggggaaaataaatgttggatatcagtgaattctttcagaacatatgataaaaaggcaaagggctccaaattacataagaaaatacaagagaaataatccaagaggctcaaaatctgactaatttcagaaagagaggacagaggaaatggagacaaaagaattattttaaaagagaagaagaaaattttctggcactgaagaaggtcatgactctttaaattgaaaatgttcaacgatttttttaaaggcacacacctagatatatcacaagagaatttaatagtattaaggttaaaattaaattatagaaaatattcctgagaaaaagaattttccatctagaattgtgtatctagtaaacatcactcatgtgtgagggttaaagacttatttttttagaatttaatgtcctaagcatcccttttcaggaacttatgagagagaaaaacaagagagaagagggcataggatcttggaaacagaagttctaatccaggattgctgtgcaggtctggagagcaatatccaaatccgtcctgaagacagaagattctggaagggacttctatggagaaaggagggaattaatgatgcccgaaatgaaggacaaggttaagtcctcagcccgactccttaactaaaaggaaaggccatctggatatgcgaagcatcagacggatggacactgtgctcctggagaagcagagctctcaagacacgtgctttcaccaaaatgaaacctatttactaagttctatagtttaataaaaaccattttattataatttgtaaagcattctgaaatctttagttgggcatactcaaaattttggtcaattatttccatatttagagagagaaaaattatattagtcaggcccaaaggacgtgcagcatttctaatcaaagtttatttgcttcggagcttttcaagcaatggctagcatacaatagcttcgattggatttaaataaaattatcatcatcatctcatagtaattattgcataggaagaaaattatttattgcaagacatagcaggcagcaaaatatattctgctgtgaagagatattgccgtgcaaacagggagctgtttttttcagcatgcatgtttatgcgctgaatgtaaatgcatgtaaatatctcaattttaactctttatcattgttcaaattgtttgccaagcaatattcaatacataatttaaaactctgcaagatcatttctttcttatttataatttggcactcttgacatcataggttcttctggatatacagctaggtctaatctaaaatctggtttataaactgtgctttagttttttaaaaatcactaaaattgttcttttgaatatttgtttataatatatcctagtctacaaataagtaagaaattcaaagggagacctcaccctgccttcccctgtaattttttgttcaacatttgctctcatccatgagataataggtaggaaagtgatcagaaaaaactcccctgtactggtggggctcctgtaacgtactaagtcatttttctttgctgagctctgtattagatccacgggagaattgcaaaggaagtaaggggtatagttcttacacttagatctttgttttgtttaattcatgcatggatacctgacctaattcctaaacagatttgcagtggctccttgcgacaaaagacgtgaagccagcctttcttcttgtaccctactccacctcttggagtcatccactcccttgcggctcatctagcaagttcccaaaatgtggacatgtttgtcaggcctatcgctttaaatatttagcagccagtgctgcacactcctgaccattcagagcagagcctcaccactgtagggggcactggtgtagacatctccgtggctgcactgtgtggtcaactgagggcatccaaggcttggtcaacagaatccaagctttctctgaggtgaattccttttgcctcattttaggtttgctttgtgcagtgaagctggctttggcttgctttacatcattgaggcaatgactgtgcagatgtcagctgagtcctgcaggtttccaggccccctcaggtttctgtcagtaaggaaactcagaaggctttgtctagagccaatcactagactggcttacagtagcaattcttttcacactagaatgttctcctagatgctctcttccaatttcctttactagagtggaagcttggccaagtggcttgtggattttctaaagaatccatgatggcaacttcagaaaccatgaagttcagcttgtcaacatgttctgatatgtttttctttgagaaaggtgaaactgatggctgaagttcagccaagcacaacatgaaaatgctctagaaaggcagaaaacatctattgaagtaacaaccactgtccatcttaacggatgtggctatcacggcaaaagacagcatttcgtctaggaggagacagacagagagcctcaaacccccagcacatgctgatgaaaacacagtgggtcaagacatgacagtgggtgcaaacctccttcttcttaaaagaagtggaataagagtgtatcctctccatacatcaagcaagcatccttcctacagcctgcgtttcaccaggaaaagaaacaagaggttatgcctttggttttccaaatggggctcacataggaatttctgatgttgcccaggcacacgtgaacggccgacacccagaagctgttggaagcaatgtcgaaggcaatggagtagactgcggtcagttcctttacagctgcttcaaatggcagcacaggataagacacatgctgcagaagatgtcatgtgtcaggggtatgggatttccattctgttttaagccatcattcatctcaacctttggcacgtggctgagtttttctggcaatcagggaagccacaacagaggggttcttctacacaatgaattttgtattggagcaaattcaaattgtagtcaaatccaattcttttcaaatcataaatgaatccatacggtgtacacagaaggtgctctgctggtcttcctttctcgtggcttcatgtatctgttggtggagtcttactgcacggaagcctcctgtccccatcacatgcactgagctctttcttttgcaggcagttccaacttaagcacaacccacaaatataaggatgggtgttcctaaccataatggtaggaaatattttcagttacataactcacccctaaactatcatagatatcatactgtgtagataaaagtacttttactttccctgactcatgtctccccacattagtttggtgtgaaacattgctttagtagcacggcaattttaacaattattattttttccacaaagatgattttctagttatagaaagaaaaaacaaaagaaaaaaaccaatttacatctagttctaatacaaccaagagtgagaaagaaatgtgacaataatctcaaagagtgtacatttaagaaaatatacgaaagttgggagtcttgacccgggactggacaaatatttatgactctctagcttgaataatgtattttctttaaaaacacattttcatctacttcatcagcatagctacaaggaaattttagagttaagacagaaggtcgacggaatcacagatgattaaaagatctttttagacagtcaactatgcaatccatttgctaaatacttgctgatggggtactttttgatgaactgaaaaccaaatatcacctagaatggcagtgagcctgattaagatgagtaagcagcagagttatttgaaatgctgtattgaggccacctgggccattagtactccaagtaacactgcacattttaaaagggagggatgacagcttatggctaacacggactgtgtttacatgtattccatatatgtgccaaatgttttacagagtctcatttatgaaaccttcacgactatggtgtggctactataattatctccattttactaagcccaaaagttctacaatcatgaaaaagctttaatgttccctttttgaaaattccttaatatgtaataattgtgacttttaatagacatgaatatttcatttaaaaaattaactgctaagtaggataagccgtctgttgttaaacacactagaaaccagaatatataccttattagcaaaaactgacacaccttgtcctttgatcaattattattaatgctattctaataaagagccctgggtattgtacgatgctcaactactacttcatccactgacaaaaactgttcatgatcacagaattttagtgaggattacatttactggattattgaatatgaatccatgcatgtcacatctgataccattttcttcagttgtttactcatttgaaaacacatattgagaccgcctatgttattagaacaccacaatatttatttgattagtacatttgcctctgtgttggataatggaaagtttatcttgagatataatataataatttaataatgattctaacctgtgaccagctcccggatctccaggtcagtcgtcttgcggagtaacctcaccagtgctgggatgccaccacagtttttcagggcaattttgttatcatcgttggccttcccatacaccaggtttctcagagctccacaggcactacggtggacttcggtcatccgatgatccaacaggtccaccaggagctggatgcctccttgtctccttatctgaaagagcaaaggacaccacttttgctttacagtgtaaggtttccctacctacaccaaaacatgtttttcatataaagtatctgctaacaattaatcgcaccaaactgaattaaggcatacaaaaggaaacaagaaaaaaataagtgtttgctttatatttgattgccggtatttgctttaatatcctaccaataaaaatccaaatgtatttctttcgaactatagaattttggaaaggtgattttaacttcatattgagtgccttagacatttctctccataaaatatgccacaacctcatggatgaagcacatgaagaaataaaaggcattagagtgatcctcattccctagacttattaaatttaaccattgtcttaaagggctgcaggaatgatacacaaaatgttaaaattatgcttaatagggatatgctctaaacatttcaaaggaatcagaagcgaaacgagagactggaagaattgacacaaggagttttatctcagaagacccgcggaaataagaacgtctcttacatgagagacagaaggtgtgaggccaaggcacgttatgcttaatttaggtatttgattcaacaacaacaaaaccactctacattttactcttctttttatcaaaagaaaattttaatcttttataagtaaatgcaaaatatttttgctgtgtattttgagatgcatgttctcctggctgccctttgatttggggaacaattttaaaatttaaattagaaacaaaataaagtggctacttaacacacaggctatattagcaaagctgcatctgaaaacttttgcatgtatatggacaaagagcatgattcgtgcaggaatacccttcttttacactttatgcttcaccgttcttcagggatcgaaggattagcatcttctctacttaattttttgattacagaaaaactcattcatgtcacagatgtgctgggacacctggctacatccccagcctctttcttttctctttctttcttttcttttttctttttctttttgagacagagtctcgctctgtcacccaggctggagtgcagtggcgccatctcggctcactgccagctccgcctcccgggttcacgccattctcctgcctcagcctcccgagtaactgggactataggcgtccgccaccacgcccggctattttttttgtatttttagtagagacagggtttcaccgtattaaccaggatggtctcgatctcctgacctcgtgatccgcccgcctcagcctcccaaagtgttgggattacaggcgtgagccaccgtgccaggccatccccaggctctttcagtagtgcccaagtgctgctctgtgaggtgactctaaccacaccgtttaaaactgcacttagaaccacaccctcaccccaagccagcattcttgtttatcttcaagtgctattgaattcttcataggatttgtcatgttctaacttatttgttatgtttatcattattgtccgtcttctcctgttaggatgtgtgttctgggaggaaatgtctctgttatatatccctatccctaaacccagtgcaatgccagacacctcataaatgttcaggaaatatttgtcaaatgaatggagagggttaattaatatattacttgctacgttggtgttgctcagctttgctaaaatagtgttttcaaaatgaagaaatatccctctttaaagacaacaaacaaacaaacaaacaaacaaacacctcttttgtgaacagccaaggatgtatccagaggcctcagccctgcagctcttccaatccggcttacaaacaaaatagagcatgcttcattcatacagggtggcctctgatgattccgaatatgcctacgggaattattttcattcatcagcaaatgaaagcagaaaaagtggaaatcttcagagcactcttggactctaaatccctaagttggaaaccatgaatgcagcgtttcacatatggtgcctccaagggaacatgacagggaaggaagagggagggatgtagagggacagtgtggttgagggggttatggttgcccagcctgagggtggtcacagcacctgggtaagggagactcaaggatcttttgggtcaaataaggaaagagaaaaagaagtgggaaacaactttacccaacttacagttctacccagggcttgcttggcacccacccaagagagatgatgtttgtattcctatataggtgtcttgttcatgtacccagattataagcacatccactttattatagtgcttgagaagggatattccacgtgtacaaaaaaggttaaactatgagtatcactttctctatgagtgtatatttgcccatgtgtgatttagttcaaagttctctgaatttagttatttaaataatgatgaaaccattgaaaagagataataaatccattcttgcagtgaatctattggttatgtactaaaaacagatggcatcatcaatcaatctatgcattttattcatatgtatatattttagctatattggatgttataattaatattcctaatttattataatacatttccaattcatatgatttaatgaattaaatgattaaaatatattaaaagggaaaatgaattcaaactgaatgcagcatgaattctaaatgctaaaatgaaaacacaatgttttcagtatggccctaattaatgccatatacccaaatttatagtgagattttcaatttgattttaatctatttagataaacataagtaagtcaattaacctttttcttttgctcttatttggggtcaccagatcctctatattaaaacttgttttcttggggtttaattttatctaagaatgtgagaaccctacttctgttttctgaagccaaacattactcagaattaaaatgtaaatggccacatgtgtgaaatgggatggccaggtccttggttctccctcctccccctgcagcctcccctctcccatcaggaccagaagggaggccctgacatggactccagtcctcttgcttctggtggctgtgcgtggctctgatgctgtccttttcactttccctctattttgcttttctccaggatccttcctttctccaatttcttttttttctttttctttttctttttttctgagatggagtttcgctctggttgcccaggctggagtgcaatggcacgatctcagctcactaaaacctcctcctcccgggttcaagcaattctcctttctcagcctcccgagtagctgggattacaggcacatgccatcacgtctggctaatttttgtattttcagtagagacgggatttcatcatactggtcaggctggtctcaaactcctgacctcaggtgatctgcctgcctcggcctcccaaagtgctgggattacaggcatgagccaccgcacctggccccttcctccaatttcttgcacccaatccatctaccagtttcttctggtacctaacatgcaatctttccaagcttccaaacaaacctattttaaacacttaaaatgtacaactttctgaaaacctatcagaagaaacttgtcttctttgaaatggcacctttatttattctcccccaaaacgacaagttgtctagttccaatttatccccctagtcgatcactccacatccagcaagctgagcccaggtttttgttaacatatgatcattgcaggtcagtttaccctctcctcacattattactttaatcatcttcatgcaaaattgtttttgttttgttttgttttgttttgtttttagacagagttgcgctctgtcacccaggctggagtgcagtggcgcgatcttggctcactgcaacctccgcctccagggttcaagcgattcgcttagaagacatgaggtttcgccatgttgcccaggctggtcttcaactcctaggctcaagcgatttatccgcctcggtctcccaaattgctgggattacaggcgtgagccactgtgccaggcctcatgcagaattctttaaaagtcaaatcttgaaagattttaggtttcatagcattaaaataaagtcaataaaatgctagttaatgtatatcttgttatttatatataattcaacaataaaataaaatgcatacaaatgattaaaatggaaacaatgaatgttgaattacatacggggaaatgatagcttcatttgaatctagactgaacaattctcatatctgctactttcctggacctaatagaattggacagtgaccagaagggacttttcatacttgacctgaatagacagtcttaaactcacttattgagtttaagtgagtaaagtggttctttgacaaatgattgaccttagtcagttgttcctgtgtcaatggctcacatttatttttctgcttagctgtgcacttcaggaatctagatgtcgagagtaatctacaaggagtaagggaggtggaggctggtaaaccccatccccaggggaaacaaaagatgaattaaccaatcaaataaagcaaaactatgccctgcctgtcttttgttttgtttttgggttgtttacagtgagggcattcttgaacctgatgcagataatctctggggaatgaacactagaatgtattcccagtttgcaccaggggagaataaaaatggttttcataccctttgccctaaaatccgctgctttgaagtatgtttacagtttaaactctagaactgagagtatctaaaaatcatgcaaaagaaggatgcagtgggtatcttccttgttttttccttaaaaggtagaatatatctaagcctttcaaatcagaaaacaaatggataggtaattaaattatacacaagagatatgcaagtaatgcaatagcacctattgcaaaaatagggccccatttgttactcttaacataatctgcatatattgacaatagcatatatttgccaatgaattagctatcatcattaaactgatatcaacatcaatgagtaatttatagcatattcaattacagcagtgttcagatatttatgacagtcttcataaaaatgtaatgataatgatgatgtatagtggataaaaaaatactttaaacagcttgcaatagaattcctctcgggaggtatctgtctttatttaaaaaaaaaatactatgacaagttgcttagaggatagtgagaccccgagggcgtggcctcccaggcattcagggcaacagaagatatcgctcacctgctctgcatttgcaaaagggagggatttggagctgggaagagaagacagaaaaggttggagtagcttttgtcaacctattatttggtgatacaaggacctcaaaacaggtaaggacctgggtgtgtgctgctattcctctcaggaatctttcattttaataaaatggatatatctttaggcttctgggttcatgctgaaagaaactaggctgtgcctgagactcaaagtaaattttaataatagtgtgcaagactatcgctacatactatatatatatgtatagcatatcatatatacacacatacacatatatagtatacacacacacacaaactatggatactatgtactatagtaattactttcttcagatacttatgaaaactcaagtcccaatgtctgagaactggtttatagaaagagctgattaaaaagaagataagggaatgcggtgatttttttgctaaattttcaattaactgttatttttcaatggtactggctttgaaaaagctttttaaaatgatataattattacacattcttttttaatattacaaaattccaataattttctctgcttataagctactggaagatacaaattttatagatcccaaactagatgactaagcagatgtatgtagaaattgcaaggttatcagtttgtaaaacacacaatttacctcactgaatttcaagccttactcttattgaaaagccagttaaaccatcagtttccataaaatatgaactgaggtaagtccatgtagttgcctctgagtaatacagaagtatatttcataaaggtcataattttttagtagaaattatttttgagaatctctctccttccaattgtatgaaatggcctgcgttctccattcgataggtgaaccaagatgagctatgtttctttctcaattgtgttttcgagagaaagcacattgcagtgactggaggtgctgcctcagacctaggttcaaatcaaatcttaaaaccggtttcccccaggcaagttacttaaatgcctgtaaagcatgaacaaagtgtgaacctacctcataggttgttttcaggactgaatgagatttcaaaagtgaattgtttaacaaagtactcagtaaacattatgtgtcacagaaccatccactgtatcaactttttaaaggatattcttaattgctttcttacccggccaaaatacaaattaatttaataaaatgttgatatgtgatagtgaaaggaatacaatttagggtttaactttataaactggatttaggatgtacggtatatatcgaatagatctcttgctaactgtgagacgagcagtgaagttttctgagaatgaagcaggcttggaggtcaaatgcacctcaaagctgtttttttctggcaactgtttttctgagagcagacaccctccacaaacacacttgtgagtcctcagaattgctgaacaccgtaaatgagtttcaactttactcattaagtgcacccaagaaaggcctctccattttttttaaacacaaaaaatttcaagcgattcctcaagtttcttttctaaagacaccactcaggaaatgtgatcttgataagtctaatggtttctatcacttcgtgtaaattttgagctgtccttgcagatactgaatgcaaaaatcacaaagcattgacaattacaaagaatgcctccagtaagtcttagtgcattctgactaaactcaaatgtgaatttttatttccacatttagatatttcatgatgctaaaatcccatgattttctctaaattacaaagtgttgatgaacccagactagaaagtacctaagaaattctagggcctggaataacttgaataactgctttccctgaataacttcataacatcatcagtcagaggcaaatatcgtgtggtgagtgcagggtggatttctcctcccaagaccatgttcccaggtttaaaggctacacttacacttactctctctctctctctgactactatcctatctctgcagatctgtacatacaatctgttcaagcagatatatgctctacttcacagtaggagatttaatctattggatgtttcataagaatacatgctacatatataccatggactactatgcagccatataaaaggatgagttcgtgtcctttgcagggacatggatgaagctggaaaccatcattctcagcaaactaacacaggaacagaaaaccaaacactgcatgttctcactcataagtgggagttgaacgatgagaacacatcgacacagggaggggaacatcacacactggggcctgttggggggtgtggggcttgcggagggatagcattaggagaaatacctaacgtacatgacgggttgatgggtgcagaaaaccaacatggcatgtgtatatctatgtaacagacatgcaagttctgcacacgtatcccagaacttcaagtatttaaaaaaaaaaaaaaagaatacattcaaggcctcatgttatttaactttattatatcaattacatatagttagtaccataccctaaaacaaatattcactgtctataaagatggacattgtttaaaatatttaaagatggatggtgagggctgacacattctttctctctcacttctctgaattctgatctttcggctttttttgtgtgctgctggacagctctcatcctccccacctgattaagcagaggtctctccttaggggcctggattagatttccttgcctggactccaaacccaccactcgcctttgttattggctttagctttgtaagtccttgcttcacagctaactgagcagactatttgaacttgaacttgactctgagaaaacctgccactactatggcatttaagcaatttttaatccataataaagtgaagacaccggttaccagccttatcatttaaccttgttgtgggtgtgatggtcaatagagtaaaactaaaaaactgaaataaggaggtgagtcatttggaaaaaagactcagattatcaagattgatgaaaaaaccttttggaattaattagaaaattcagtaaaatacaaacttaaaattttaaaaatgaaagcttcctcatggatatatataaaaattcataattttcttatatactaaaaataattggtcagaatattaacagaaaattattccattcagaaaagcaacatggtatagaaaatacttaggaaataaatatgttatgaattgggaaatttctgtatgaagaaaacgacatgtatttactgaaatacataaaagcagatgtgaataaaggtaaatggactaccacattccttcagtgttataaagatttccactggtctccagattaatttaaatatttaagcagttcaaatccaaagcccagtaaattttaagttgtttttggacacagtgacactaaagttcatctggaagaatgaacataggaaaaaaatcacaagaaaaatagagaattatggaaagatgaacatattctaaagcaccaatatacagaacaatatgaaatgaccccagaatcaatagataacaatgggagagaagaaaaaaactccagaaaagatacacatgtttacaagactttaggatttcatcatgaagcagtatggattcgatacctagaattagtaataacaggctcaccacataagggatgacacagcatttgatttcttcacaatgacaaaaagtaaattccagatggattagaaatgtaaatgtaaaacataaaacaaaaaagcactagggggatctacaaatggatatttatatactactgggaagacctaaggttgatacaaaagccaggagccataatgaaaaggaccgatgcacacacattataaacaaacttaaagtcgggtggaaagaactaaacaaaatattggctacgaacatgatagataagaagtttagatacttagcattgctaaattcttccttgaatttaacccatctattggctgtaaagtgatatctctttttagttttaatttgtgttttcctaattaccagtgacgttgagtctttgaataaattctttaccaaagaggtaaagaatcaacatgaataaaattaaagtactttactgaacaatataaatacaaacattaataagtataaagaaatgctctgttcatgaatgaaaagagtggatattgaaaaggctataaattccccaaaatttatttatacttttaacacaatttcaatcaaaattcaagggattttctagaacatgacaaaatgattctaactttcatctggaatattaagcaagcaataaaaagtaagactatttcaataaggaggaatacaagggagacattattttatctcatttataaatgctacataaagcctcaatagttaaaacgttgtgatactgatgtagtagtcaagatggcttagtggaacagaatggataaccaggaaatagagcccagtgtacttaggagctaacgtgtgataaaaagaattacaagccaatgttaaaggcctgaatcacacctaaaggtcttagagaagttgactatagatcatgtacattccaagaatttaagaactaaatgaaccaaataagggcaaaaataagttaaaggaaatctatgagatttcaagaatgaatgaggagtcctgaacacaaacaagaatggaatcaatttaattccaaaagtaataactgtatgcagatataagatactgcttcagctttagtatcctagtgatacagaggccgaggtgggcagatcacgaggtcaggagattgagaccatcctggctaacatggtgaaaccccgtctctactaaaaatacaaaaaattagccgggcatggtggcaggtgcctgtagtcccagctacttgggaggctgaggcaggagaatggcatgaacccaaaaggtggagcttgcagtgagccgagatcgcaccactgcactccagcctgggagacagcgagactctgtctcaaacaaacaacaacaaaaaaagtgtaaatataattttaatatatccttatagggaagcatactatccatactgaagttaggatacatctttagatggttcaggtattcacttccttttctttctcctcctccactccctcaatacaataaggatagagtgtgacactgggtagttttatagagataatttaaataaagatataagattgggcgtggtggctcacatcagtactttgggaggccaagatgtgcagatcacttgaggtcaggagtttgagaccagcctggccaacttggcaaaaccctgtctctactaaaaataccaaaaattagccaggcgtggtggtgcacacctgtaatcccagctactcaggaggctgaggaatggggatcatttgagcccagggggcagaggctgcagtgagcctagatcttgccactgtactccagcctggatgacagaggaagactctgtctaaaaataaataaataaaaataaaataaacaagaaataaagatctaagactgactgataacaaatactcttcaaatgccggtcttactttttaaaagaaatagtcatctcccttgagcataaatatctactttttaggtgaatggttactaatctaattatctcttcatttggagaggataagatctaacatatttatttgtatgtggcaaagctaaagtcacagattgttcaacatctcaaagagaattttggatgacctcacataaattttgaaaacacacaccccaaaaggtagataggtaacttaattatttgaaaatcattaaaacatctaagaatgtgattataagaggcccacaaatactgcccacaaagctttcattttataaggactggacagttgcttgtttggcaaatgtttcctgtgggccttgtctgctcaaggtgctggggcttagaggaggtgagatgggccatggtccctgctggaaggagtcaaggaacctgtggagtcaggaattaagtaaggaaaccaacaagggagcaaatatgacctttgcaataatgaaaactggaggcggctttactgaaagaggatctcgcaattttctagtcattattttgtaatcttctgcttaaagaagatccactaaacggacaagttttaggtccatcaacaactgggttcttctgggtgataagaaccaaaaagaagtcagagaaggaagaaaggataaatagggtgtgatggtgttgccggggagtgggtcagcgcacactagagcaaagactcagtgacatgaagtgacagaggccccaaggagagggagacctggaaggcctgtgtgctagtgatgagcaaaagagaggcagtggggctgggggaggcgagatgaggttgcagggccctgggtttactctgaggaagacaggaatttaagttgccctaactcattgcttttaaagaccatgtgccatgtgaggacagactgaccatcagctagggccactgcccttgtccaggtaagagaaccacagcagcttttgactgattgacaggagtacaagcactaaaaaatggccaaattctaggtctgttttacaggtagggtggtaaatatcaagtctgactgaaagaaaggaatcatgcgtgactacgatttggggccttgggcttttaataaatgagtgtgttgataatcatcacagcagtagtttttggttgactgacagatggcaaagcagttcagaaagacacagcccttcatttaaatttctatgttactggcatgacaaaagcacacattttaaaaactgctattcttttgttcatgcaaaatggaaaataacatctttctaaaatatagagttatgctaagtatacatgcagaaataatagagaaattgttttgtgtcttagcctatggttgtaacaaatgaggagtattaaattaaaagtaatatattccaccaaaagaatttatgatagaaatgtcgagaaaattttcttacatatttattttaattttaaattaaaaatatactgactttaaaaaaatttaagtcatctcaagactttcattaaaccggtaaaaattgtatagaatataatttgctttattatatgtattacatgatggaaagtattttttgttatgcacatatttttttttctttctattttaggtgacggagtctctcatatgttttgaagatatatttttgtagtagtaaaagccaatgcttaaccacactaaactgtggttgagaaaataattccagttttgttcagttcagctgatatttattaagcattggtccacattccctggggttgtcatggtttagtgaaggggatacacacaggaacaaatacagtgtatgaagcccacaggaaagtcacaaaaccagcctccttaggaaatggggtggggtaattgtttctggaagaaataccagctgaactgacttcttgggagttgaaaaactggtgacctatacaatgtagtacacgattaaactctcaaatgcttggagtgcagtaggtccacgctttttaaagttgagagcacatatggtagggttcagggaaaggacaggcatcagtatgccagacaatggtgcctcttcttggcccttaaattcacccaaagattgggggccattatttttcatactaataaagacttggagactttacgaagtagaacacaagatgtatgggaattttaaagccaaagtacagaatgtaagagcgtggcacgtttctagagagctgctctggtcaacaggccctgattcctggagcccacatggctgaggcctggctccacagagagaccagcagtggaaggctggagagtgggagctggtctcggtaagggcctgggcctgggcctgcacggagcccctcccagaggtaagagacagggagcgtgggggatgctgggaggagactagactggagctggcactgaaaaccacataaatgaggaaataaacacataaatgaggtgataggacccacacatggtttctgggcaggaatgacaagggaggttgtggccaggaagacatgagaacaaatttgagagctggttcaaaagaaggaattatccatcatgtaaaagtgtatcttagctattcaatggtttgaccattttcctgacacctagaaatttataagaaatttatagcataacacacacaggggtttctacatctctcaaccatttttgtttcaatcaacttaaatgtttttactccaatagctctgtgttctgagccccagcaaggtaactggtggagccatcttgtgtttctgtgtttagctcggcctccacaatcagagggtggaggccgctgggatcccagaggctgagcaaaaaggaaaagcttaagttccaccactcagagctccccggagctccccgaggagtctgctggatttgaccactatgacccgctctttcgagactccacaaactgaaccatgtcaaccttattttttcacatttctattgaacacaaagaaagctgttaccagggaaatctgtccgcaacaaggcaaattgaaatatgatttatttaatggtgctgctcagctgattaaatattattcactcttcattttgtccttcagcccaagcagaacattgatatgacacttggatcttggtataagaaaatacacatttggtgcatctgtgacccttgaaatttacaaaattatgtaccaaaaaatcccatcaagtgcaatgcagtgcatcccacactgatgtgtcatcctaatggagaaggagaccttctcccaggcattccatggaaggccactgcagaaattctgaaggctcacaactctcctagcagtttgggggttagtactgctatgttacacgcatgccgataattttatatgcacatatatatatatatagtataatgtcatacatatataacaatgtaaacatatatgtccataagtaaatgtatacatttaaaagtgaaaatcgttcagaaaggtcttctcctccttccctcaccaaaatgggattcattcagttctttatactattttattccaatttaaagcttgtagcgttaattttctttttttcttgtaacccaccacttgtgggttcagagggcctgcctgtaggtactctcctttccaataattcaaatagctacagatgttgagaaggctgttatttctttaataatttctgttcaaagattttcagttctggagtgtaccagattcaatggctataacctcaataataaatagtaaaatgctctgattttaatctactttcagaggttagttcttatcagtgaactcttttaaaatctttcatgcatgaaatgtcaggtttataaaaatcaagtttctttgttctctgttttatttactgattttctaattttgcatttaaaagaatacaggctatataaatacctttgtttgtatttttaatactttaaaaattttcagatgagttatttgtttattgcatacaatttttctccagactggaaggaaggcaatgattatactctcagatttcaatagaccggtagatgctgaggactaataacgaagcagggcctttaggggagggttttttgtcttttatttctacattctgcacacacagtagtcaaagtcatattttcaaaaaacatacgtaaccaatcagatcatgttgatcactgctcaaaatcctctaatgattcctgccacatttagaagatcattaaccttggccttcagtcctgcctgacctgccttgtcttctctctgcttccatctctcattattgtttcttactcacttcggcttccattgccttgggcttctggaaattcctgagcaggttgttctcccagagtctgcagagtagcttctcttccatcatgcaggtgtcccctaaacctgattagccatcaagaatgatggtatgaccaccccttcccccttcatcctcaatcttccccttctctaggttccatcttagctccatttaccacctgacatatttcacatacttattggttcattttccgcttccatcctcacccagagagatgtcagtgctgtgagagcagagatcttgcccgacttgctcaatgctgtgtccacagggctgagaggagtgcctggcagccagcagacattccatatatccatgtcatctttagactgagcgcagttttgactactgactttgaacttctgcaatatgtctgattggaacgtctgtctgtcaggagaagtatcatatatcaagcagattcacacttgggaacaaggacttccagtgcctaagaagatatctcggaaactcagaatattatacaatcatgaatatcatgacactggtctggcaaacatcatgcacctctaaaaatgtttttcttacagctttatctttttatttcatgaagtgagagtaattttcccacaagtacacgacagcactatgtataaaatgcctctgccctatgtacacctgcatcttgtttgtgggagccagtgctgaatatattagctaattatagatatgcagatgccttgttttctttaatgcaaaaatatgtaaaagcatgtgaaatagtgtagcactcaggtccatggttgaatatccaatttccattaaatgaacttgggttaaatagtaaagagacagataaagtcggaacaataaggaagattattcataattcaaaatcttcacattctgctgtcactctttaggctttaagacactaaaatggggaaaaatctaaattgcaaaacaaattatcatccattgattcatttattaggatgttcatcacagagaaattaaacacacagcctggaagactaccaaaagggggaaaatgttacctttgggaactctcagagataatatggaaaactgttaggtatttactaatatagatatgcttacaggggtgagggaaatagtgattttgaatgacaaattaaagaaattgtggtttacattgaaattttcaaaaggggattttcataacgagagttgggacttattcaacatataatcgacacatttgctttcaagaccatgtggtcattaatatggaatggattgatgtgaccagccaaccaactagtcaaaggaataatgctctgttaagtggtaaaaaatcctgaatcttatctgaaggaagatagctccacagagcaggatgtaatgtggcatcctgcaggcagacgtgcagctgtgcagggttcctctaagagctgagagagcattttccgcactctaatacacggtggtaggcagaacaatgcccccccaccgccaccctataagatgtcaatgtcccgatgcctgaaacctgtgaatacatcatgttacacggaaaagaggaattaaggttgaagatggaatgaaggctgctaattagctgatcttaaagagtctaacattaactatctgggtgagctccatgcaaccaaaaagttcctttcaaagccgaagagagtggcaggagagtcagaacagaagaacaacagtgtgagacagactcaaccagccattgctggctttgaagagtgaaggggccatagaccaaggaatgcaagaagcctctagaagctggaaaatgagagaaaacagacttcaccctagaggctccagaaaggaacacaaacctgccaacactgggatgttagcccagtgagaccaattttgcattctgagccccagagctaccagatagtaagtgtatgtcgtatgaagtcactaagggtgtggaaatttgttacagcagcaatacagtgctcatacataggtggaaaatctgctgcaaagttatgtgctcatgaggagcacttcaggctcgctggataagaagtggctgctttgatcagcacacctgcaaacagcagagggttgctgtgcccactcattcccaaagtccaagctgctccctccaggaggttgtaaccaatagatcatcctcctgctataaccaccagggctcattctttggctgctggaggaggtgcctactgaaggaggtggatctatattgcccgcctaaatataagtctgataggaccaaggcaatctcaatgtgtgctgtgcacacattgcacttctatgtaccaagaagtaccaagtgtgaagtactctttgtccattttcttgactcaatggtcaactcactggccattgtccacaaaccactgttaaatgactctcttttcagataatttcaatgacggaagacagaaaaagtcttcccaaggtggcagattgcacaatggatggctaatcctgtctacacaagtaagaaatcgttcattataactagcatcttttcagatgagtcattcaagagaatacagcctggtcaactgggaagatgtgctctggtattttggttttgctttttgtcctgttaacattaactttcccacaaaccagggaggaaggaggtggcttttcaaaagtgttctccatcatcttgtgctcttgtctgcaactcctgttaatatttatcactggccttgttctgataaagagtcataggcagtgcctatgatttcattgtggaaaagaatgaagcatcagaaaggatgcagagagacctgaattctgaggcttcctgctcatgcatttagtggacatctctggcataacataggaatttattaaggaaatccttacatttaattagagagttttcaaggcagaccctttttatgtctgtatttgaaattttccagggtctaacaggaatttcaggccgaaatgtctcctagggatgcaagcattctctaccagtgcctaagagcaagccactaatcacttttcaaaaggtaagtatttaatggtggactctggtggtcagtatgttcaaaagcttaaggttgtctttctgttgcccctactagcttttgccatgaactccaatctctttgggtgtttgttgctatttgggtaaagcagtttgtggatcttaggcatccaaggttgcggctcatattattatccactgaagaccttgagagcttcttgttgtttgggaccaccttaaaaaataaatccctccctccctcccttcatttcttccttctttcctcccttcctccctcccttcttcctccttcctccttcccttcttcctccttccttccttttcctcttcatctgtcttttttcttttttctcttttttttctaatgggacttaacaatatccctgaatataagataggatttcttcaggatccaaggagttgtaccaagtgttatatttcttactcatttcagggtagcatcagggaaatattttttcgtcagttgacaaatatccctgattcttcaaattttccccgttgagtcatcctcataattctccagaattgacaagccagcatcatcttgtcatcggagtcatgctggtgccaactctgacagtcttctcatttgtaagcccgataatcattataccagtaaagttgcatatcagagtatcttttatcattagtaagtctggatccctacataaaagttttgggccatgggtaagggaatgagcatatctttgtgtgaaaactgttaaaatagattgtgtgtgttctctcaaataaaggcaaattgagattggctttttctcagaaactaggattgaaaaaaaaggcatttttcatatggatgacagtactgtaagcccctggtgcctaccaagcttcctttttagcttgaactacgttgaatactgtcaaagccacatggagcaccactttatttagaccttaataatctataaagtcaacccagaaaagctgactgctttggtccaataagccatctgtatagagaggtgttgcgagccaggagaccagcctctgtgacatccttagttaatacagatgtcaccagtcccttcccagaaaatccatcttgttttcgtttggggattgctgggtctttctggcagagaggcactcagtcaatgtgcacaattacaacaggtatacccaccattttcaccacagctgtcccctcatgtggaagctcaccctggcctgcacatagggtgtggctggatatgagatgagacctttcattttaaacagccaccattcctttctctctctgagcagcctccagttctttagtatgatggccaggtataattacactgatcaagctcagtgtaaaatgtggtttcccaaccaatggccataaaagtagcctcagcatgtggtcccagatctctcgctagaagtggtggaagagtagaccagccatccccatgcagtgggggtcacctggctggtcctcctcacccacttcaactattaatcctcccaccatcacaagaatcaaatggagttaaaatctttcttcaagatcaccatgtttcctcccttcctgaaactccagcagggaatttttcaaatcagctaacttaagcataaatactctaaatttcctagaatcttacagaggagagaagaacatcagtttttatttcttttttcttccaaggtatttaggttttacttatcagtggacaagtacttctatgataggctgagtaattctcctccctgaagatgtccaggccttaatccctgtgaatatatgaccttacatagcaaaagggactttgctgctgtgattaagaaacttgagatgggacatttgttctggattatctggatggtcccagtgtcatcacaagagtccttataagaagaaagcagagagaggggatgtgatgttagagtcagaggtcagaatgatgaaatctgaagacgaaggaagagaccacaagctaaggaatgcagccagccttcagaagctgaaaaagtcaaaggatcagaatctcccctcaggacaccatgactttggcccaggaaaagaactttggaaattattcagctctgaaattttagatctctgttgacagagttctttcttctgtggtccaatttcagtatctcttagaatagggtagagttgttctagcctgtgaatagggggcctacttctcactccacctccccaactccactcaccaatcattgccaaacagctccatcttgaaaggggagctctgtaagacaactgaagggaagcgttctgctcaactgtccatgtcactattttatcatttgtaaacgatattattattagtgtcttcacaacatgagagaaaaacagaagagggacatataggagggaaacatttaactcctggtatgcttctccatcacctgtgaagatggtaaaaatccataaaaaaaaaaatttagagtgtgtttgcattacatagaaaagaataaagaacagctgggaggttgtgtctcattccccagtgaagaggaaagaaggaaactggcttaaaagccccatagatggtggcaacagaaaaaatattagttaggttaagcaaaattaaatgaagggagtgccaggcagtcggtgaagtctgagaagatcccctgggatttaagggaaatgcagacaggagcttctactcctcacatctccttcattcggtccatacttggggttccaaagctcacccagccctcctaacaatggcactgtcattgtctctgtgctccttttcatttgtctccattttccctggacccctgcccagacaacagatttgatcacctggggtcagtagcaacgataatccccacttccattccaaagcttgaaaggaaactgtgcagcgaacatacccttctatgcgagggtgtgctgggatgagtcccaggcatgctactggaacgctctttgcccgtctccataaatacttagagattggatatgccagtattattcacccactgctacagttcagagacgttttggcttaacaaagcttgtgtgggcctaatctcctaatatatcacaccgtttccaggggacatacatttcaattgcaagattctttcaaacaatctttggaagttgaagagagcctgtatagatccacaggaaacacagaaatcatcccataagtacaattaaatgcaaataacaaaagagttaatgccaactcagtgttctacttgtcatgcaagaggcaaattaattaagaaggattgtaagtacagaagagcaatgtgaattttgaagagctcttagcaaagcagatttttttttcttatgtttggagcatggttaaaaagtgcactagggctaacaaactagagtagtcatataatgagcacctatagcttttcttgaaacatttaaaaaatatttgtaatgctgaagtgcatctaataggaagacacagctcttccaatcagcgtctgatacgaaatgactgaaacatggtcaagccagaaatttgcatacatttaaagtcagccaactggggcacctgttcaagtcagggaggctcttcccctccattgtgttaactatttccaagatggcacatgtaggtgcccacagagcagggttattatgcatttgtagttccaccaggttgaggaggtctaaatctttagatttagaatgaactggaacaataaacttggaagataaggttggaagagtgatcagaggctcaaaagcagtaagtctaagatcatttgcatagggtggattaatgaaacagagattgcaaaaacataggaaagctcataactgcaatgaaatcttaggagatgacggcgccttataatctatgcatggacatcacatgatacgaagccttcttgtattgtttctctcagtattttcacaaaatgttctctccagttctgtgagccagaaaaacctggagaacgtctggaagggaaaaatcaagaaaatgacagataaacaaggtgtgtcttccttggttcaacgatttagagatttttacttggaaacaaggcctgagcgtgctgagtcggtagcaataagaagccaagtgtcaccaggaggagaaaggccaaggttttgctgccacttcccctacagactaaagcaaaagaaatgaccagaatgccagatgaagaagtttatggtggatataaagttaaactatgtccctgaaaaagcaactagttcttcaggtacaggtcttcttctctaaacgatgacatatcagaaatgcatcaaaacggcaaagcacagtgagaaatccctcagtgagtgccggctccttcacctgtgatgcaaatgcgaatggactgacattcacacaggtcatctgtttcttctgctcaccattgcaaagactacaaaccttttgtgggtgggtggagaggcggggggaagataaaaagaagacccattaaaatagaagggaagcatggcccaaagaagaaatggagttaaaataacccaaagtgatatttagcaaacccagaaaggaaacttcaaagagatctgaaaaatacctgctgcatcattgttcgcaagtcatgacccagtttcagagactgctgtctgactcacgtctgttttgcaaagagaactttgtgtacctggtggttttaatcaggagtcttgcctcgctgcagggtagctacatttcatcacaatattggtctgattccttaacttcattcactttgggctattaaaatggtctccttctggttataaagaaaaagccttgtggggtgtgttggctcacgcctgtattctcagcactttgggaggcaaaggctggaggatcacttgagtctgggagttcaagatcatcctgggtaacaaagggagaccctgtctctacaaaaaataaaaaaattagtatggcatggtggccattgtctgtagtcccagctccttggatggccaaagcaggaggatttcttgagttcaggaggtcaaggctgcagtgaaccctgatcacaccactgcactccagcctgggagatagtgagaccctgtctcaaaaaaataaaaaggaataagcctgtccattttaccacttccatcctttccccctccccatctccaacatcccacctcctgaagcaggctggacgtgagctccagccccctggtgtgcccttcccacccatctccttccatcctgttctttctcctttctcattggaggtgggagggagaaggaagaggtgtttccttacataaaggcaggctagaggccaccaggccactgcctatgtctgtgggccatctctgccaaggtgactcctgggctttagcaggggccagttaggtggctgaagctctctgccaccccatatctttgcatctttggccctacatctttgatgcctacaccttgcttcaccccttctgccatgctcctgcaggaacacgtctaaatccctccatcactagtctcttctctcccctgtgaccctgcccttgtccatcttccttgaagggacctttaagcataaaggaatacagtccttgctcaaagtctggctgaatccctgtgtgatctccccactgtactccagcagcccaaggcaagtcaccagctcagaagctgagttgacagccagttggggaagaagatgccagttttcctttcttgctgcctcctacaaactttaagggctattcccatccttaggccccatcttcccccagtgtagcttcctttcctctcctagttctcctgttaaacttctaaatggaaaagatcatcaaaccagtgaggtctctactgcccctagagagattagctcttctatcaagagctgggcccttgaacttggtcctgggggagccatatctactgaagtctctactcagtgacctctagagccaggagaggtgctcatttggcacctcacacagaactgtcacgctgacatctgatgcgtccctgacatttgggaggagaggcctttgttggaggagccctaaaatctctttagcctgcagggaaaatctccaaggccaagacaagcctcttgatggctacaggatgctagaatcagcttaggtttaggaggaaaaggaggagaaaggagagttaaaaggagcaggcagtggagataggagggtagagaggtatacaatgtgcaaaaaatagatgcatatggcagctagtagcagtggcccacctggcctgggatcccctgcttctcatctgtcccatctattggtaagtaaaaacacgactgaatcaccatggtttggtgtctctggagtccttcttactcggcttttccccctgtattctgagtccatgattctgccttaccctccaagttgatctatacctccacgcagcggtatttgtcctctttagttgtaattctgtcccaggctgttagcaatattgccttcttattatctcctccactgaggatgactcatggtcctttccactcaaagcactggcccaataattcctgagtgtgcctcgtccatcatccttcatgtgtgaaggaccaagccttcatgaaaatggaaaaatatattggcctctggctgcaatagtgctcactgtggatcacatatcacatctctcttgtgttcacaaaggttgtagaccctgagaagctttaacttctccacagagcaaacccctccaccgaggcctggtacactgaccctcagcacattccttgctctcttcttcctccttccctggctgtatttaaacatgacaagattccatatctttttgaaataggaattatagctctgtttgttaaagtcactgccttccttctttttctttgtgctgacctaacttgtcacatgtcacccagctgtttcctgcaggctgtgtgcatgaccgctagtatcctggtggccaacctcacaggagagcttcatcttgccttgtggctcctggactcttccacagtgctgttctggaaggttcttagtcaaatgcccctccagtttctcccacttactaacattctcttatttctgagtctttctggtttacttcctaattatggattacatgtcctatcataaatcattcacatctccttcagatccaataagtcactttgtttttatgacactttctttgtttttatcatactttctcagtcatttttggattattacaagaggctactgtaggttactgggcagccctttttggcttcttttacatcttcctgctgtgaagtgtgatatatgaaatggtgtctctgtggttcagagctctaaattggagtcagaaagtcattgtgagaaagactgcctgtgtgtcttgctaactggcaacagcaacaacaaaaaaaaccaggaacttgtcttgacctttgaagtgggtcaaactgcagtgaccaccacattctggaaaacagctgaatttctccagtattgcaacccctgaacagcgaccaccagtaaactatggacgcatgttctaagtcagccacctctaccaatgataattctccaaaacaacttgtgtaatcactctgagcttccttttggttttctcttaaaatcctctactcccctctgtctcttcagaagccaaattgtttcctgaattataattcctaacattaagacccctataaacaccaccttgtcttcttgaactgcagtttggtctttcacctgttcttggttgacactacccagtgaatttacccatttcccatcttcttcagagattctcttcctcttcttttatatcaccagctacccctcctttgaccatttcatagattccacaacctggtgaagcactgtttcttaagatgtatttctttccaaaccaccctgccaaaaagcactcccagctccttctcctctgatattaataataaggcactggcctacgtggtttatgtgatccaaccctgggatattacctgtctgatctcacctcctacccctcgccacctcacttgctaggttccagccacactctttgttactccttgttataggttgaatatcgtcccccacaaaagatatattgaaaccctagtacctgggacctacaaacgtgaccttgtttggaaatagggtctacatagatgtaatcaagttaagataggctaggtcctaatccagtacaacataagcccttataagaagaggagaagagatacagaaagaaacacgcctagaggagatggccatgtgaagacagaggcagagattagagataaagccaaagaatgctgagtactggcggccaccagcagaagccaggcagaggcaaggaaggattccaccctgagtttcagagtgaccatggccctgccccttctcaatcttggacttgtagcctccagcatcgtgagagaacagatttccattgttccacatctctcagtttgtggcacttggttcccacagcccttggaagcaagcacaaatgagcacatgccttagagatctagctctgaggtactctctctgactgccttcaagctctgctccgaggctacttctcagagatggctttcctgaccattttctacagaatggcagctgcctctcttcacccactccttattgctgtccacccgctttactgtgttgtatttcctccatagcccacatcaccatctcacccatgatgaatgtatgcctgtgtattagtcctttttcacatgtctgataaagacacactcgagactagataatttataaaggaaagaggtttaattgactcacagttccacatgactggggaggcctcacaatcatggcggaagatgaagaaagagcaaagggacatcttacatggcgtccaacaaagagagaatttgttcagggaaactcccctttataaaaccatcaaatcttatgagacttatttactatcacaagaacagcacaagaaagacctatcctcatgattcaattacctcccactgggtccctcccatgacatgtgggaattatgggaactacaattcgagatttgtatggggacatggccaaacaatatcagcctgtatgtgtttattgttgcttccccctactcatgggggtctattttgttcactgctggattattgaggtcaaaaacagagcctgcaactttatagctgctcagtgattatctgttgaatatgaattagttccactttcacatatcaatatatcaagtacttgggtctatatgttgctttatgttggtatgtgcagatggctttttgattctaacttcctaaagggcagtagttgaatctagttgtgtaaacagtggcttagcacagagccacacaccgtgtgtgtgtgttcaatttcctttgctgacaatagcagatctcaaaacgtggatgatgaacaatacaagtattctgtctataaaactatggaattggttttacatttaactgttggaaagagatttccttatttattttgcagcacatgctaaaaataactcatactcctttgccacctgctctgtgctggcagtctacctgtgttctctctgccatgatatggagtctcaacgcagtttcatagtctgggagactgagtctcagagaggtaaagaaacttgctcaaggtcatggagctagaaagtagtacagcagccagggttcaaatgcaggcagcctggctccaaagccgttgctataagctcagtggtatcctctctactgatatttaatcaaagaaatacaggctcttttccaaaaatgtgaaacaatttatgatgaaagaaagagaagaaatgattcaaaggtagttgactgaaaagatgaatagcacattccctcgaactatatgaggtagaaagaactaagaataaagtagaaattatgaagcactttaagtctagtagacaggaaccagtctcaatttttttaacagatgaaatgttctaaatttgttggaataaaaagttatgggggaggggaaaggtatgcatattttatgcacagaaatcaatttctatgttccatacttaaaggtaatctgaatttagccaaaatattattataaatgatataagtatattgcaactatctagtctagacacacagacacacaaacagacaactgcaaatatgagctgtcttccatgagttctaagtgggtatgccttaggttatatttttctggcaacttctaatttaagacttagcatggccatcagtgtaggaagcaggctgttttccctgactccacaaggctgggatgtaagctggactctcgccagctgtggcttcatctcttcatcatgcctaacacatggtattagaatgccctgttggctgggcgtgatggttcatgcctgtaatcccagctctttgggagggcaaggctggtggatctcctgaggtcaggggttcatgaccagcctggccaacatggtgaaaacccgtctctactaaaaatacaaaaatttttagccaggcgtggtggtgaatgcctgtaattctagctgcttgggaggctgaggcaggagaatcacttgtacccagggggcagaggttgcagtgagccaatatcgtgccactgcactccagcctaggcaacagaggagactctgtctctctctctctcaaaaaaaaaaaaaaaaaaaaaaaaaacaaagaatgtgaatgctcattttactgctgtggcttcacctctccatcatgcctaacacatgctattagaatgtcctgtttacttattttctgtcctgcaggttatggatttttttttttttttgagacagagtcttactctgtcacccaggctggagtgcagtggcatgatctccacttactacagcctcgtcctcccaggctcaagagatcctcctgcctcagcctgccaagtagcagggactacagtggggcaccaccatgcccagctaatttttgcattttttgtagagacagggtctggctatgttgctgatgccggtctcctgagcttaagcaatcctcccacctcagcctccaaaagtgctaggattacaggcatgagccaccacacccggccagattccttaaagacaggatctatatgctattgatatttggaccctcccactaacacaaagcaagctatcagtacactcttttgctttccactaggactgaaaatttcatttctttaaaaacaaaaatgttttatagcagttaggatgataaggtaattggaaagattgttaggagttaaaaaaataaaatcaatattgatttcctagagcaagaattcttaccttgggcctgtgtaagtttactatataagatctgtaaacacttcatatataagacagctgaagctactttttgatataacaaaaagtaatcaggtcgaaaccttaaattacatctttatcagtgctggtcaccggacatttctatcaaaaagaaaggagtacaagtcaatccttctcacatataaagtcacataataaagtttgaatttttgaaataaggcatgtttaaaaatgaggcatgttaatagggatggtctatgtttaaaagaaaatacattttccaattatttgaacatttataatttttgttagattaacttaaagttttaaaaagttaattgatttattaacttataacaaaataaaatatttagctgggcatggtggtgcacacctataatcccagctacttgagaggttaaggctgaggaccacttgtgcccaggagttcaaggctacagcacgctatgattgcacaccactgcactccagcctgggtgacagaaacaggccttgtctctaaaaataaataaatcaatagaaatatttaaacatttaaaaataatccctatatgccacttgaaaatgtgcaaacacttttaaaccactaagatacatattaccttgaatgcagccatattgcgtgtgtgtgtgtgtgtgtgtgtgtgtgtatatatataactgtgtatatatacacatatatatacatatatatacaactgtgtatatatacacacatatatacatatatatactgtataactgctttcatgtataactctttttgtataactgtgtacatacacacatatatatacatatatatactcctctttttgtataactgtctgtatatgaaagggggtgccacctgcatgccaactctggtgtgtgcattggaagaaatgggggaaagtacaggcaggaggaacataaataaactgcaatcctcactacccatgaaatgcacttagtatccccaaatcaatgggatactcataatattcttagctgaggtgagtttccaaaagaatgaagaaaggattcattaaaaatccgcaaaagggacatggatgaaattggaaaccatcattctcagtaaactatcgcaagaacaaaaaaccaaacaccacatattctcactcataggtgggaattgaacaatgagatcacatggacacaggaaggggaatatcacactctggggactgtggtggggaggggggaggggggagggatagcattgggagatatacctaatgctagatgacgagttagtgggtgcagcgcaccagcatggcacatgtatacatatgtaactaacctgtacaatgtgcacatgtaccctaaaacttaaagtataattaaaaaaaaaatccgcaaaagttagcaacatttagtcacctcctaaaagatgcttatagtccatacacctgaggaagtgtccatgtttaataattcctctgtctaaaggcttaatttatggtgactttcccaacaatctaggagacagtgtagatgacagacacagttcaaggagcactgccatccatccacactaatcatgcctgcgccctttaaagtgggaggatccacctccatctcagatattcattcacccatgaatacggaccacactaacttactgtgtttgcagcaatcacctgaaccctcactttattccttctccttctcccatcctctttaatttttccttgactgcttttcttctgatcttatctcagtctggctctgactactgcctatgtgactacacttctatctcagtttttaaaaacttgctgatctacaaagtatttaaagctaatgtcctaccctggatcagagaactcagtggaattcaaactctgccttagtcactggagattgctgagctagatcccacccagccctccctcctcagttcacctcactgctgggagggtgatatggtttggttctgtgtccccacccaaatctcactttgaattgtaaaaatccccatgtgtcaagggcaggaccaggtgaaggtaatcagaccatgggggtggtttcctccatggtgttctcgtgataatgagtgagtctcacgagatctgagcatctgacatttcccctgcttgaatacattctttctcctgcccccgtgaaaaggtgccttctgccatgattgtaagttttctgaggcatctccagtcctgtgagtccattaaacctctttttttaataaataacccagtcttgagtagattggtaccaggagtgggctgttgttgtaaacagacttgaaaacatggaagcgtctttgaaactaggtaatgggcagaggttggaacagtttggagggctcagaagaagatatatagaagtacaaaagtttggaagttcctagagacttgttgaatggctttgaccaaaatgctgatagtgatatggacaaggaagtccaggctgaggtggtctcagatagatatgcggaacttcttgggaactggagcaaagatgactcttgctatgctttagaaaagagactggcagcattttgctcctgctctagagatctgtggagctttgaaactgagagagatgatttaggttatgtggcagaagaaatttctaggccacaaaccatccaagaggaagcaaagcataaaagtttgaaaaatttgaggcccgataatgtgatagaaaaggaaaactcattttccggggataaattcaagcttgctgcagaaatttgcataagtaacaagaagccaaatgaacgttaatcaccaagacaatgggaaaaatgtctccagggcatgtcatagaccttcagggtatcccctcccttcacaggcatggaggcctgtgggagggaaaaatggttttgtgggcttggcccagggcctctctgctctgtgcagcctcaggacatggtgccctgcgtcccagatgctttggctccagccatggctaataggggccaaggtacagctcaggccattgcttcagagggtgtgagccccaagccttggtggcttccatgttgtgttgagtccgtgggtgcacaaaagtcaagaattgaggtttgagaacctctgcctagatttcacaggatgtgtggaaacaccctgaatgtccaggcagaggtttgttgcaggggtggagccctcatagagaacctctgctagtgcagtgaggaagagaaacaaggggttggagcccccacacagagtccccactggggcactgcctagtggagctgtgagaagagggtcaccatcctccaggacccagaatggtagatccactgacagcttgcaccatgtgcctggaaaagctgcagacactcaacatcagactgtgaaagcagctgggagtggggctgtaccctgcaaagccatagggcagagctgctcaaggccatgggagcccatctcttgcatcagcgtgacctgcgagtgagacatgaagtcaaaggagatcattttggaactttaaggattaatgattgccctattggatttcgagcttgcatggggcctgtagcccccttgttttggccaatttctcccacttggaaaagatgtatttacccaatgcctgtaccccattgtatcttggaaggaactaacttgtgtttgattttacaggcttataggtagaagagacttgccttgtctcagatgagactttggacttggacttttgggttaatgctgaaatgagttaagactttggggattgttgggaaagcatgattgcgttttaaaatgtcaggacatgagacttgggagggaccaggcatggaatgatatcgtttggctctgtgtccccacccaaatctcattttgaattgtaataatccccagatgtcaagggtaggaccaggtggaggtaattggatcatgtgggcggttccccctactgctgttctcatgatagtgagtgagttctcacaagatctgatggttttataagtgtctggcatttcccctgcttgtactcaatctctcttttgtagaaggtacctgaagaggtaccttctgccatgattataagtttcctgaggcctccccagccatgcagaaccgtgagtccattaaacctctcttctttataaactgctcagtcttgggtatttcttcatagcagcatgagaatggactaatacagaggggaactgaggagatggtcttaaatccaagttcactagagcagcaggaaaagccagggatgaggattttatctgctgacttacggaagcaaattctcaaaattgcacatataagatctggtatcattttgaaaaaaaattgatgttcttggctttattatatgaaaaccgtacaaatcacaggaataaggaacaagaaaggcatgatttatgaccctctgcatatagaagatgtagttctgcccttcgttcaatggcctacccattgtgtgagcaaagtcaatatgaatgatgaaatgtagactgaagggctaaatcagttcaataaaatgcagtagaaagactagaggactgagtaaatttggaaaggctagtgcctgcaaaattagtatttggacaacaggtaattacaaaattcaatgtctgtgtatgaaaacacgacaggcagccatctgtcacaaaggtagaaccaattactaacagtttgatcttggagtgaggatgagagaacaaaatagatctgtgtagaatccttattagagtttacgtgtctgtgtgtgtgtgtgtgtgtgtgtgtgtgtgtatgtgtatatgcacatatgcacgcctccctatgtgactgaatgggagaaagaaagggaaactctggaagcttcctctgtgttttatttaagccttttgcacttcccatgttcctttggctaacacttactaacttcaatctcattttgtcaactcaggatcagggtgcgcactcagtcatataccacccttcccttccttctcatcccagcctcccaggtcccctgggaacattatcatggggcctggaagtgtttgcagcctttagaaggtagcatggagggctgccatcaataacatgaactgctgctaggagtgccagctgctgggggccaccccaaacagtgagaagtgatacaggcaaccttgatggcacccacagcaaaattaaaaaataaacagaagcacacatatgtacacacacgcagagacagacacacacacatatgcacacagagacacaggcacacacacagacacatgtacacacagagacacatatatacacactgacacttagaaatatacataaaataaaacaataactttagtgtcttaaccgttcctggccaaaaagaaggtggatgaatgcacatttcgctactaagcagtttgtatatgttaagtcatttaattcttgcaaagattctacagagaaggtatcagtatcttcattttaaagattagaaaagaggccccaggataatcaggtagttcaaggtgactgagctggtaagcaggaaagccagcccgggaagctcatccatctgccatgactcatgtgctggttgccccttcactggaaggcctgtgttcaccacagtgcactgggggtcattctgatgtagccggaaacaagtctacagctgctgtcactacagctcttatcaggtggcattgccactgagaggccccaaggctggcccatggatcacgtttacagagccagttagaccatgacttcagacttccctgggccatgaagcctgcattgcctggccgggtgactccttgtaatagagtctgactctatctcttgatgtttgacttctgacagctttgaagcctcacccttccttcctctgccccacatctgagcaagctgataaaactcaagagcttccttttttggtatccgcaggagtttcaacccgtacaaggcccagtctgcatgtgagaacccacttcccacaaccataaaaactccacgacagtttcctttccataagctttctcaagacaattttggacatgcctgggagccactgtgcttggcctggaaagcctcactgtgtaagtgacaccttttcaggccctcttggtgtgtgagtcatgccagcaaccttggcatcagaacaaccaaattttgggtgggagtccatcccacttcggcggggcactacaacactcttgaatcaattcatgctaacgatgaaatgaaatgctttcatgaccttcagagaaaccctcaaagttatagtcttcaaaaaagaagactgaaagaaaagttatagtcttcaaaaaagagaaaagttatggtcttcaaaaaaagacaacatatgatgatggtatgtgatcccccagtcagaaatctgtcctttattttgcatggccattgttttttctattaaaaatagagaatgactaagttaacatatgtttgggacaggagtcacgtaactttaatgcatttttaggtcactttaacagttggtattttttcacatttaaaatttttcttagatggacaatatttctctatatctaaactttggcactgctgacatttggggctgggtgattctcttgagggggctgccctgcactttctgggatgtttggcagtatccctgatctctacaagggatacccacagcctcctccagctgtgacaaccaaagatgtctccagatatcaaatgtaccttgggacaaaatcacacctggttgagaaccattgctctatattcattccacaaagaaacaggactttcctgataagaacaaacatggaccatgttctttgcagtcccaggggaagagagatggaaaaaataaaaagccatgaggctatgtatatcccaatgcaagcaagcaaaatctataataaattgcaattttatcttcaaatctctctttccactcttaaactaatttagactcatcctcagaattgcttacacgccataaagatgactcgttatagtttataaaatctttttgaaaaaaatgactactcagttccttatacgcaaatgcttgtcccttgtctaaaaaacttagatttggctgcagtgaccactgtgattttccaaaaatatcacacagcataatatatgcacttcatgtatcccaaaaacacagagcatgttaacagttgtttacatgatggacatggacaatagtctccttaatggaacacatatccacatttaatccattattcgtttgtaaatagcaccaaacacttggttataacacaaagccaatttagtgcctagagtccttatcctgtcaatgagttcttcaggaaggacaggtcatagcttatactgactataacaattttattgtaatttggagataacaattgatgtttagtatgtctttaggatttaggggcagagaaaactcccagagtcggaattgggaagagaaagacaaatcacgttccaagtatggcatttgacaatccagcctctattaataactagcatacactattggtcctctgttcctcggtattcaaatactaaaaaacgaagaatgcatgaacaggcatgctaatcaattagatgaaacatgctatgttctagtcataaatatagatctaaattttaaaagcataacttcagttctcctaattcttttccccatcaacattaagaagatctaagtgcttatgaatctgacaccaatcatttcagaatccaaggagcactgacctcggctttaattttgttgtctccaaaacagaggtgttgcaagtaggctgccgcgttagactggaccgagggaaactggtgctgcaacatctgaatcacttccggcagttccgggtctctccatccaaattctctgaacaaaaggaaagaagcggggagaatatgagagagaaatcctaccacactgttaacacatggttagctcgtgtatgaaatgtacctgactctaaaagaaaatatttcataaatgactgttctggttttcttacatgcagacccatttaaggggatttggaagagattcccttgagtaaatagttttctttcttttcttttttttttttttttagacagaatctcactctgtcgcccaggctggagtgcagtggagcgatctcagctcactgcaagctccgcctcccgggttcacgccattctcctgccacagcctcccaagtagctgggactacaggcacccaccaccacgcctggccaattttttgtatttttagtagagatgcagtttcactgtgttagccaggatgatctcgatctcctgacctcgtgatccgcccacctcggcctcccaaagtgctgggattacaggcgtgagccagcgcgcccagcctagtaaatagttttcaagtgcaaacgtgtatactacatatattggttttatagattatatatacagatcaatctatcaactgaagttacatgttaataaagattatgaaaaaataacctaaaatagcatatgattttaatatacacattttcatttaagcttgagtggattattcatttatttatttttaacttttttaagagatggggtcttactgtgtcacccaggctggagtgcagtggcataattatagctcaccgcagcctcaaactcctgggctcaagcgatcctcccacctcagcctcccaaatagctggggttacaggcatgtgtcaccacgtccgtcttaaatggatcaggtatagaggtcatatctattctagtatattgtttcaatagtctgattcaggcacaggattaagctaaattatcagacaagagaaaacagaattggatgagtccaatccaaaatgttgtgatagcagccaatgtttatatcattattatttttattactgttgttattttcacaatctcttctttaaaaatagacaggggcctacatgattctctggggataaaaatgtaataacataatgactttataataggaaattatttatttaagaagctagaattatttgcagaatgttaatacattttatgcattgcactttctttttcctgtctcctcctttttacatctgagctactccaagaagctggttgtcatcttaagcaatatggtttaaaatatttaagtccattctaaaacattatcttgattgtactgtcatacaaagaaatattcttttattaaatctctccactcaaccagttagaccatgctgctaacaggacgaactgtatgaattctatccctgcagcagggaaccaatttttaacagagaaataaaatagcaacctccaagaccacaggtaaaaacttgaccccacaagccaccaaagggcactatttatccaaagaacaggctggaagagaaatgagtcagttctgcaaccacctctattcctcatgaaacaactcaaaagcatacatcctatcaatgccaggtcgatgctgtcatctgggaagagaagacatgaaaaatgggacagagaaggaacagacaaaggttaaaagtgtcctcaaagattttaacctcttctctttatctttcctttatcacagttggtagaggttgtcaagtaaaccttgaaacatgttggtgcttcctttacagcaagtgaataaaatatgaaatagaatacctcttgaaatggcttcgtttttattggaaagataaagcattctatttaatgtgcactgagcattttataaatttacatacagtcagacagattatatatacacacacagatatatatacacattatatatatacacacagatatacatacacactatatatatacacacacacacatactcagaaagacatacagtataataatatacttgtgaagaaacctactcaagtgattgctgataatgaacaaactattgaatccttcttggctatgtgatcacagtagaaaacaatcatagaattaaaaatgtaaagcctgtttttctctcaaatttaatttcttttgttttataattctaaaccacgtctgcaaggctcagatagcacagtccttcttataaaagtagccctctagaattatattctttatgcaaattaattcgaaatctactaaatacctgtaaattaaaattaggagtgtggagacactggatggctaagatgaattcaggtaaacctatgcttttggaaagtgattaataaaggattcattttaatctgttttattaaccagtcaggaattgctctattaggtgatggcttacacggcatatgccaagtgcaccttttgaacaagaaccctagggaacaggtttaggggctctttgcacacatgcgtgcacctgtgcacatgtgcttgcacacaccctcaaactcagacaggaaggatggacattccaaagactcatgagtgcagaagggatccacgtccctcacactaggtcaaaagaaaggctgctgccagctctgccctgtccccaagcccaaaacctctggaatcccaagcatcccttccctccccacttctgttctcccagacctcaccttcactctgctgatctgcaaatctcctcccacctcccaatcaccactcttcccacctgaggcatttaaatacatttaaatacgcagatacgcacacgtgattgtgctactttcctgctccacaccctactatggctcccaccatccttgagagtctaagacactcccatgaccttggaggccctgctgggctcgcccactcctgcctcacaggcttctgcctggccctggcctgcctctgctcctgtcctcctgtcccctggcctgcctggcccagtggcctcccactcaaatgcggggcctcaggctctttacaacttcctcggggaatcccgtcccaactcctacccacgcaatgcccagtggaggatgacaccgtcatgctgtgggccatgaggtgaccatctctcgcttcactctggtaggctctgaggccagggccccaactctgttggtcatctttgtcagctggctcctacagttctccctgacaccagatggactccacataaacgtgttttgaaagaatgaaggtgctaacgaatgaagaaagggcttggacatggacagtgtttccacagttctaccagtgactctcagaagagcaagagtcattcctagattagccacacaacacacacacacacacccccaacacacacacccaacacacacacacattcacacacacaccaacacacacactcacacacccaacacacacacacacacccccaacacacacacccaacacacacacaccaacacacacactcacacacccaacacacacacacccaacacacacacactcaaacacacacccaacacacatacacccaacacacacacacccaacacacatacacccaacacacacacattcacacacacccaacacacacatacactcacacacccaacacacacacccacaacacacactgacacacactcacacacacccaacatacacacaccccccaacacacacactcacatacactcaaacacacacccaacacacacacccaacacacacacacccaacacacacacccaacacacacacccaacacacacactcaaaacacacacccaacacacacatactcagcacacacacccaacacacacaccccaacacagacgtacatacacaccaaacatacccaacacccaacacactcacccaatacacacatccaacatgcacacagacacccaacacacacacacccaaaacacacactcagcacacacacacccaacacacacacatccaacagacaaatacattcagcacacacacccccaacccccacacacccaacacacacatacactcagcacacacaccccccaacacacacccaacacatacactcagcacacacaccccaacccacacacacccaaaacacatacactcagcacacacatccccaacacacacccaacacacacactgagcacacacacccaatacatatacacccacatcatgcacacacacccaacacacacaccaaacacacacacccaacacacacacccaccccaacacacatgcacacacaccacacacacctaacacccaacacacacacacccaatacacacacccaacatgtacacacacacatccaacacgctcaaacacacccaacatacactcacacacccaacacacacagacacacacagaggagtccttctccatgctgctaacctgagcagccttctctatgcctccatcgcatctcacaactctgtggcttaagattctccagtggcttcccactgcacttagacaacaatctgtgagggtgacgtgaaggtgcaacatttatggggagcaactctggggcacagtgaaagggagtgaaggagaaaaagccccgatcattaagccagacaagactggaaggtgaacgtaagttagcattcagatcctctggccttaaaccagcttcccagaaattgggttggagttgattgtgtctccaggcagttgacttctggtttattctaattggcagtccctcaggactcagtcactgcagcagttacccactaagaaaagactaatcttttcaaatgttctcctcaatttcacaaaatagatgctaaaagagcaccctccagcagaaagtctgggggaatgatttatctccaaggctctttttctataacagttttgtttcgcttagatgagattccgtttggttttctttttgctgatcatggagatataccccagagaaatagcagcaggcctgcagaaaatagtctgtctggatcatttcggccagaattcagtgtatagtatggtttcttcacataaggtcttaatccttaaggacaaagaggatcctgtaagacaaaaaagttctggaaagaacaaataccagaggagggaacagcacctgccaaggtgtggagtcaccgggggtggggggtcggttatttgggaaaggggagccattcagcatgtctggggcatggctctgaaggggatgggggcctccagagaggacggctgtctgggaacagggggagttggagcaggggctggaaagcaagtttgagatgagatcatgaaagatcattcattcaaatacaaaaaaatctgaacctggtctgtggatactgttgtgaaaaagaaatcgagtaagatttgtttagaattacacaacaggaagataataatctccagtaataacgtgagcgcatactaaaagtcagttgccaaggttctctggtcacacactttaatgttctaaaccttaacgaacattgtgtggtttattttcatcttacagaagaggcaacttaaggtgttattgaacttaagtgatgaagctggaataaaattctagttgtctcctctcgaatccataaatatagccataaaactatgttgcctgctataatcattctcttgaaataatgtctaaaacagtgatttttaaaagacaatgtctaaagaataaatagcgtctaaaacagtgcccctccgaggacatttagcaaagcctgaagacagttttggatggcacccgtggaaggcgctgctggcatccagtgggtagaggccagggaagcagccaaccttatgcagtgcacaggacagtccccacaacaaagaattattggtccccaaatgccaccagagcccgagttgagaagctctggtctcaacatgtactgtatttgattagttttgttgagcaaggatgttgtaaatctttccctccttgactgttgtactagaatgagcacaggatttggcatcagaatacctgtcaagaagttcagaatttgaacatctggctctgtcccttttatcccataaatacaggacagtcccttagatcttgctggccttggtttccatggatcaatatataaagaataataccacctattttactgcatttctcttaaaatgccaaaataaaataatatatatgaaagtgcttgatcaactactaagagctagatattttctagtaatttttactttaagactgccaaaagggatacatttctcttaaaatctatgtaataccgctgaaggttttataaaccttataacctttcactgatacgtattcatttagacattatacttatttgaagaactcttagtgtaaagggagacactgcttcagctagcagtacaatttgccctttcaaaataatttcctttcttcctaactccccttgggaggcagtgtgctagagtgggaaatggtctttggatgcaaccagacttggttcgaatcctgctccaccattaactgtctctgcagccttgggcttgggtctgagtcttgctggctggcagggaggtgctcactgtgtagatgaacatcgagtccatctgtcccactgagataaaaattcctacctgggagtattattgggatgattagaaataatatatgtgaaccccttagagcagtggctggcacccagcatgggctctctagaaatgtcaggtattgtatataactaagaagaggagaaatgagaaccctctacaatttcccacagtagccaaactcgtaactctcatttgtgactgggcttcactttagaaatgttaatggaaatggggatatgcaaatgtaaccttttctccattaaaacttgtcacacaggcccacaatattgtgagtaaatcctcactcttacatgggctatctgagttgttaaaatcaaaacgctcagcacagctaaacagccaacagttcatgactatgttcaacagttcatgactgttctgctggtacggaaaccaaaaagttgatgcattgtcacaatatcttatcaagcttccccattgaaaagagtcccaggacaactagaatcctcacaatttcacactattttcagcaaagctttatggtggcagacatggctcactttgattgcaatctaaactatttctattgagggcagggctgtgtggacattattaaaatgtatgataattttaatcctttagaaactctaaactcaaaatgttttaaagactgtaccgattttgactttcatatttagagtcaagaggaagtaggtgattttgtttttcatttgggcttattgatgtagttaggaagggtgcaggggtgatggtcataagttagatagatttttttaaagaacaaaatggagatatttacattcttgttgaccaaagagaacttattcaacaattaacatataaaagtattaatatcttaatcctcattcctggatagtttgtaactaaaaacaaaaagctgtcctatacaattttttttttttttttttttttttgagacagtcttactctgttgcccaggctggagtgcagtggcgcaatctcggctcactgcaacctccacctcccaagttcaagtgattctcctgcctcagcctcctgagtagcttggattacaggcacccaccaccacacctggctaatttttgtatttttagtagagacaaggttttgccatattggccaggctggtcttgaactcctgacctcaagtgatccacccaccttggcctcgcaaagtgctgcgattacaggcatgaaccacggcgcccggcctgtcctataaaattaatcacattttttcaaaacaccaacatggcttttatataaacaatagcactagaattatgactatctggaaagtaagctcaacggttataccatttttaaggaagaaatggccttctccaagcatatgctaaggaaaattaattccccaaactgtatcataaacattaattcattcaaccatgatttctggtcctggcctcatgatggagcagccacagatctccctggagaagtgctcagctcatgggggactagaaggtgctccacccagccagcagctcctccttccaatcagatattcccttctcatataaaatttgtattattaattatacccaagttttcacaaaagattgaggcaactcagacaaattatatatgagataagatgacaaaacggaaatgaaaaatcaagtacacaaaagagagagaattcaaatgttataaacacagggtcagcattcatgcctgatttgcatcaaatttgattatttccttacaagtagccctgacaacaggagagaaatgaacaaaggcgaaaaggggctattcttgttcgttcagtgaaaggacagaatccccactgggaatttagggggcagggatctgagaccttttctacctgtccctatatttgtgataaagactctggttaggacactgggaaagactgaagagtggcccccaacgttatccaggtcctagtccctagaatctgctaatgctgccttctatggccaaatggactttgcagatgtgattcagtatcctgagatgggagatgatcctcggttagccagtgggccctaaatgccatcataagtgtcctaagaagagggacgcagagggagactggacgcagaagagggcaatgtaacactgacgcacgaggccatgctgctgtgctgagcatggaggaggggtccacgagccaaggggtgcaaggaatgcagctctacaagctggaaaaggccaggacagtttcccctagaacctctaaagggagcctggcagtacagacaccttgactgcaacacaatgaatttctgttggatttctggcctccaaaactgtacgagaataaatgtgtgttgttttaagccaccagttttgtgttaatctgtattagcagcagcaggaatctaacacagaagcccatctgaccccaggacacggcccttttaagcctggaaagagaccaccccattagggcaagaaggtgagagaggccaagaagcaccacctctgattccaatttggagagtcttcgatgtgacttttgattatgaggccgactcttccattgatttactctgactttctgaccacctctcgttcatctaagagttggaaatgcaatttccctgagcttcggcttatttcagtagggcccagtagctttcacctcttgccatgttcctgcaggctgcctgcctgctttgtctaaggattcagtcaggaaccctctcactcctccaaacaatgtttaatggccactgcgtgtttgtccaatggaatacagtgttgaatggagcaaaggttcctattcttggggagctgactttcgattggtcactggtcattaaaattattaaaagagcagaatgtactatttgtcagatagtgatacatgtgtagtgggttgaagagtgtctcccagaattcatgtcctcctggaaccttagaacgtgaccttatttggaaataggatctttgcagatgtaattgaggtaaggatggaaatgagatcagactggattggggtggcccctgagtcaaaagagagtgccctcataagagacaaaggaagacacagacacagagagaggcaatgtgaagaggaaggcaggggctggagtgatgcagccacaagcccagggacaccgaggattccgggcaccaccagaagcgagaagaggggcaggactctccctcagcacctctggagagacgctacactgctcacaccatgattttggtctggcagaatcaatttctgttgttttgggccacccagttggtggtgctttgctatggccaccaccaggaaactcatacaagttggatgggaaagtaaagccaagtagagacagggacacgacagtctgtgtgtctgtaggtgggtgggggggtggggggtggttattataaatacagaggccaggggagactgctccgagaaggtgacaccggagctgagtggagggaacattccagaacaggaaaacggaagtaacaagcctctgaggcaggagtgtgcctggcatgtcagacaagaggtaagaaggtcacggggtgaagagaagtgagtcccgggccctactgggagaccaacagggggccctgatgtgtccgacatcgcaggcctctggcttctgctccaagacatagggaagccactggaacgctgggatctgactcacattcttaaaagatccctttgacggtggctgcctggatgtgtgcatctattgactctcataaactgcaggcctaaaatcttgcatttcttgggtatcaattacacctggatgatgctgagttctggaaaaggcccccgctggatgctaggttaagaacagattctgaggggtggggcaggagctgagagcagttgggggcagatggtggctcagccccagcagggacagagggtgttgagaagcacgggcagtctggatgccctttgaaggtagagcctgcaggaattcctggaggggtgcatttgagtgtgagaaaagaaagaggccctctgtgagaccctatgcaaagcctactccacgcctcccacccatatcactgggggcctgggcccactacgcaggttagtcaaggaaggccaccttgtggggactgtggggactgggatctcttgtttcacaattagaaggaacaatttcaactagcaagttttctcctggctggtaaagtgaagagagaaaacagtaaaatgatgagaaaattggctatttctgaactattatggacactaagtgccttacattaatcttagtcaagcaatgggcttcttctctgaattcaatttattagaagttaggggtgaggaatgatgtaaaatgattagccccaatttatgctaatagttatcaaatttaattacatgtagcttaaatattaacaaatttctgcttctatatagaatatttaggtcctttagaagacataaatattctcaaagaccattagattacaatggatatcatcaattatgtcataatacctatgcaatatccaattaactttaaaacagcatttattcattcattaatgcaactagactttttcaataaaaatatgctacaaaatggaaaaaataacctcaaacatgtaagaatttagttgccctggaaattctaacaggttctgtctggtggtaacagcccaagggaaaaaatacaaattagtgtccataaactttaccttgtaaagcatgatgactttatagaaaatgtttatgttcaccactatgtatctattttaaaattaacagcccgtgatgtttcttagaaaatcacctggagctgtgaacctggagtgtaaataagagggaagggatttgatgcccaaaatactcggatcaggagatttaagaacatttgagcagtgttttttactttgttgatatcagggtaagatcagaattttgcctcaggattagattaagaatttgagaaaaccacaaaggccttggtcaccctcaaaatgttttattatacatacatatatatatatatatgtgcatgtgggcacatgtgtatgtatatgtgcagatctgtgtgtataatatatagtgtgtagatattatatatgtataatacatatagtatgtgtgtgtttgtacttatgcacacatataatgcatatatacacatataatatacatgttacaggaaacttgatacatagacttaaaatacattgtgtataaaccatagactagagcacactttcttataaattaggtaaccataccacttgacaattgtccctgagaaaaatataaatggtgcacttgatgaatctctttatgaaaacttaacttctgatagaagccacaatgatacaggtagatgcattctaataacaagaacaccatctcttgagattccacactaagctctgtgtttctggaagtgagaacgtgtcctgaagtacctgtcacagtgtctttacaatgtgaaccatgaacacatactttggggctgacggtttaccggagtctagtcttggctagaacatgatttaacaatatccatttttggttttcatcatcatcaccttatcttagttcttcgaagaatgccaacttaatttatctcagataatattgagcagagatacttcctctaaagaaaatcttaatagaatctaacaaaatgtggtctaatttggcctaacatttggtcgctgtgctctccaaagctgtcagcctctagtaccaaacactggttcctgccctcagattgtagtgggcaacacagtgggagcagaattatctaccagaaaaagcctgttatctaagaaggaagagcgtactccttgttcttgttttatgggttcatttcctgataggccatgtggtgtggcattcaggaagagtgtacttcagaaacaagctgctagcaatgtcactgccatccaaccgagggcatcaggatcacacctgtgtttgaaccaagttgggcttattgctcgtaataagaaaggactcacaccatgggaaaccatgggacatatcagtaagagggcgttgaatagactgacaaaatttgacttgttttgtgtgtcttgggaagattcaaaggagcaaggctttgttctggattgggtgctacgaggatgtaggggaaatttcatggtcagggggcttgaataatcttatctagaaggagaaaaaacagagtaatgttcaacctgtgattggccaagaatgagcagtcattcatatcagccaggctactgtgagttgtgtggtcatttttgtggtttagggaccatcatattttctattcatatttaccattcgtattcatatttgacacttcagtataatttttgaggaatgacttcatggattacattagattgttttaacctgaaatacattaggaatgggaggaaagcttttgagtgtggttatttagccgctagaatagtacaaaaacaaacaaaaaaaaaaccaaaaatctaaagccatttaattagatctacagtcattagtgtccatgtcaaaaaaaaaaaccaaaacacactcatctatgtgtattgcttcactttgtccttaaagaaatcctaaagaacatatgaatatttgggcatattcttaatatgaggatataaagggctgcagtgtccaagtgtccattcataattatttctcattactagacattaaaagcaaagcaattccatagggattttctttgatcatatttcagagtactttgctataaaacttttaacttacctccatttccagagtctgcatttctttaaatataaaatgtggagaatattttcacccttcagtttgaataaaataaccaacagtggaccatgggtgaaaaggctgttgaaaggcccaactataggtcattgtcttggatgattctgtatctgtacaactgaatacataagcaagttttgttttcaagtgcaacaataataaaaaataacgttgatttcaatataatggtacccaattacctttcatttctacccattgataaagtcttagactagcctttttcttacttctgtgtctgctcaactctaagtagaatgtgtgtaattaatttgaaaattaattgaaagtttgcggtgaatttaaagggtgctctctctctctctctctctctctctctctctctctatatatatatatatatatatacatatatttttttttttttttagagacagggtcttgctctgttgcctaggttggggtgtggtggtggatcgtagctcactgtagccttgaattcctgagctcaagtgatcctcctgtctcagcctccaaagtagctagtactacaggcacgcaccaacacactcagctagtttttaaattttttctacagacagggtctcactaggttgctcaggctggtctccaactccaaggctcaagtgatccttctgcctcagcctcccaaagtgctgggattacaagcgtgagctaccgcacccagcccatagacctttataatttaaaatgaggtagaggggtacacagggcagatggaagacgtttgactacaccataaagactaagtggcagagacacatagttttgttcgtgcaaataataaatgcatctatgatctttttcactaattaagaacgatggtttctttattaagcattttaaaaggtctatttccatagcagcaaactgaagccactaggaaaaaaaagaacttgggtctttaagaatgttggtttattatttaagtgttgtacagatttattttttataaatcaaatattttttatttgtgagaagtgactgaacacaattattggccggagtgtttcggctgcttgactttatagaacttgagtttcctgaactttatgggttcacaaacctcttcatgtttcacagggtgccccccaggccaaaataaatgcctgacagttccatttagtaagttcttaggtctgaacagcttgaatcatctacatcctaacatgtccgtgctttggggcactgcacaacttctcaaaacttggaagcagacaatgccatcttcacatcctctcctatgctgattgtcactagcacttgcttcatatcacagaaacctctgaaaatcctggtatgcaaagtgatgacatcattgaaaggaatgtggcacagctggattttgaaactgaactaatgggagctcatgtttcaacctggtttcaagataccgtatttatcttgaaaatttaaaatatccctcggaatccctcgaatttcctatgttgccctgggacaccttggcatatagtttggaaacagagcaaacgaatcgtcctcacgacagctgtgacctaaccattaatgaaaaacttcagcaaaatgaacaattattgggagaagggcaaattatgtgtatatgaataggaagttcgtcttgtaaaagtttatactcagaatttcagaatttcaattaagtgacacagtagctaagtaaaataaataaaaacttgtagtttgggaaaatagacttacactcaatttctaaaaatttgcttatgtaaatgttttgaaatgtatcgttttatgactttgaaagtcctaaatcacagctttccttaacaattatttatatatttaaaaatactataaattttggggaaaacatcagcatttagaattgctttatctttttttacattagcaagagtacagtagaatgagatcttgcaatgttcatgacaaaaacaccattttagtggcagtagcattactgaaaatgctttattatattcagcttgttcttcactgcatcaaattgctcttaatgtcttcaaacttgtacgtgaacttaagggacctccttcacacccatttgttgccctttccccagatcctttgttgggctgatatggacttagactgcagaatgagaaatcaatgagagacttgacagccagagaaagcaaacaaactcagtgatgtgaaaactgctgtcaggtcagtgtaacaagcagctctttctagatttcactgcactgcagtgatcagaaactggggtgggggggagattataccttagttctatgtctatagacaactacagattcaataatcagagagattatctcctgtacataacaatattctacaataagcactggcataagttcatttcttacaagtagaagtcaacataatgtaagctcacatttaaggagcatgttctgtgttgctaagaactgctcttatgccttcctcacttaatgttcatcacattcccatcagggtggtgccataaatattccattttatagatgtaacatttgcagtatagagagcttcagccacttgctaggagtctcagagatgatcaggtgatggaggcagaattaaccacaggctctcttcagagcccacagtcttacccaggtggctcactctctcatcaaacactttttgttactatttttataagccactgcaagttgggcaccaaaatgaatgtgtactcctcagtaatttcatgaggataaagtaaaattcatctactgtaggactaacaccatgtttcttatggctctttcaattatgattgccttctcccctctaaatcaagagttgtgtaatctaaaaatagcagtatctcacacagagatattttatgttgctgacttttataaagcaatgaactgtttgcaaataaatatctctgctatgctttctccatttataatctcaggcaacctcagtctgaggttattccagggcccagggtcaggagatggaacagagaataaaaggtcatacctgaagaaaaaaatcatcagtgctctcaaccagttcttacacctctccttttcttttctttcatgatctgtctctaaattttacttggcttctcactgggccccatttgttcaaattcctcccagatttgtcatgtcctgcctttctctggcttttgtgagttacctgtgatttattcaattaaggactattgatatggtttggctgtgtcctcactcaaatcttatcttgaattgtagctcccataattcccaagtttgtgggatggatctggtggaagataattgaatcatggggctgtttcccccatactattttcatgctagtgaataagtctcacaagatctgatgattttgtagcagttttccccttttgcttggctctcattctctcttgcctgctgccatgtaagacatgcctttcaccttccaccatgattgtgaggcctccccagccacatggaactgtgagtccattaaacctctttttctttataaattacccagtcttgggtatgtctttatcagcagtgtgaaaacagaataatataacgatgatgtaaaaatacaatagaccatctagatatctatgtccataaagagttatgctatttgttgatgcaataaataaaaccttctggataaaatatttttcctaatctgtattattctgctcaccttagtgttctcctgccttaaatctcccaaaagggagttgctaagccaatcaaaatctactggtttgatttgaaacagatattttctttaaataaggtctgatacaaaacacctatctttctgtacactcagtatatttaattttttatgtttacttacttggtgtaatctattgccttgacccaaaactatttgttattttttattacaatccattatgactaaaaaaatgctttacatcaaacgggtatttagaaaatgatgaccttctagtcatcaaatttagttagttgaaacattggatttttaaaatttacataatttactgcaattttaacacactcagtttagcagagtgatgggatttactagttgctcaataaacattagtagtcaatccacttttcttcccagagcctgattttcagacatcttaaatgacttgtgcaaagttggtaaaagaagctcccatcacttcaagtttccctgaatacataccctctgctcaatgcataaagcaaagcccaccctatcctggctgtggttctcaggaaccacacatccaggtaaaggaagctggatatgatacctgaatgtgtctgggcacaaaagaataatttaatcataggtagagcaaagaacatggttcctaccttgcacaatagaactgggaactctcaaattttctggtgctctttagggaatgtttttgactccatttgaataggtatcagaggtgcaggctgtggtcagaggcaacatctccaagaaggctttcttctactaggtcagaggaaatgcccatttcctaggttctgagaacattcagattcaccatacaacagtgcatgtcaaaattacaaagtggaagacggtctagaaatgttttttacacttcaagaagtatgaaatgtataaaatacttttctgagctaggagaaacaggtgtcacccttacttttagacttgcaaattataatgcagggcagcctcccttcccaactaagaattatctggcccaaaatctcagtagtgctgaggctgagaaaccgtggtgtatactatattatgcacattttgatagcccagaacataaactgtaagaggcactacattaggtcaaaacactgtcagttcagaccaacatctttctctgaataggaccaaggatttgggttgctgttgtaatttaaaatttgtctttggagtcatgccagagctacaggtttagggatgcatttcaaaacattttccctccatcttctattatgtttgtgtcatctatgagtttttttcctaaatatcccttgacttgtttatgtttcaagtctttacaacacacgagactttaaatttactgcctattgtatgatttaatacttccttgtggtaaatagaagaagggaaaaaggactgaattaacaattcctggggaaaaaaaactcacttcatgaaaaatgtccatgcatctcagttgcagtgaggacttgtcacatcggcccatttctgcaacagttgggcctccagctgtctctacacatcatttctggagagcagactttgcgctggttttgcacagaggccgactagaactttcgacaggcaagtgtgtgacacagaagcatcttgaaatcctagcattttttcctgttcatttaacagctagggaggtttcaaacatctttcaaaaaatactttcttagaactaaaatcaccataatattgtgacataaagaaaaattcaatcttgtctcatgctctcattttctttgaaacacaaaatccatacttggctgcgaccacaaaggttacgcattctatctagtaggatgcagatgaaggaaggcacaggcacggttatcatggaggaacacaaatctttatcaggtctgtttcttcagtaactgttggggaaaaaatagtgggaataaaagtttggtttctaagctcctcccagcatcaatcagtcacgagagctggaaactcactttccataatactcccattgctggagccatggcccagggcctcattacgtcttgctttggaaactgtgatggtttcctaatgggctctgttgctccaggctgtagcctctccattttatcctgcacaactccgtccctgtgaggcttctaaaggcaaaccccagcattttactgaccttccagcaaccctccattgcactccatcacgggactttgttccagaacagccctgcgttccggccactgcctcctccctggctatactccttgtgcctgtgtgctctttggtgcatgccctgtgctcaggccgaactgtctgtagttccctactcatgccaaactgtgtcacttcctcctcggctaacttggccccatctcctacctggcaatgctggttctgctccagcattagcacctgtaaaactcctttcctaatgacaaaaaagttgataatatgcctaggtcatatttgtgtgttgacatagatacataaaacccatttgtgggtcacaccactctgaaaaaaatactgtctggtttttgaccccatgaaaatttccccagcctctctgtggcaaccaaggagaatgtgtagcacttgtcacgttgaaacttgacacttatttgtgtaattttgtaatgataatttcctctactcaacagtaaactccagagagcagggttcatgctaagtttaactcatcattatcttcgcagtacctggcatacttctttgcatatagtagatattcaatgaacaaatgaaactattccaagataaagtcatctcaaagataaaaataagaatgatgacagaaagagtatatatgcaatattacatatgtactaacttatcagtggcttgctctctggcttaccatagctcctccttaaccccattcattaattcagcaaacatttacgggataccaatgaggcatagtgaataatatccactggccccaggggctacggatgaggaggtcaaggtgggataaaagagtgggcaacatcagtgtacgccagggtttctcaacctcagcactactaagatttggggccaggtaattcttggttgggaagggaggctgccctgccttataacatatttatgcaacatgcctggcctctaccaattaaatgctaatagcacccttttcccccaagctgtgacaactaaaaaaagtccagacattgtcaaatgtcccctggggagcaaaattatctctggttgagaattactgatgtaaggtaatatttctgatacagcaagagaaaggtcacaggaaattaatctctgtatgacctctagtcatattacatagacctttgttggcttatttcttgctaataatattgccaaatggtgtagcagtaggttttctccactgaatctcagtgatttttggtccagaattgtgttgtgaaggaaagaaagaatgggaaagggtgtgcagcaattacctcttgtttccttggttcaagcacctaagtgaatgattagccattggcacatgtgataagactgcaggagtcatgggaatattctcagagttcatcaccatgcaccaatttactgtattagtccattctcatgctgctatgaagaaataaccaagactgggtaatttacaaagaaaagaggtttaagagccagttctgcatcgccggggaggcctcaggaaacgtacagtcatggcagaaggcaccccttcatagggcagcaggagagagaataagtgccagcaggagaaatgccagacgcttataaaaccatcagatctcctgagaactcactcattatcaatgagaacagcatgggagaaaccacccttatgattcaattacctcccactaggtttctcccaagacacatgaggaatatggggttacaattcgagatgagattcaggtgggaacacaaagccaaaccttatcacccaccctaacaggagcctgatggttgatgggctttctacagcatgtcctgcctctcagtgtcccatgaaccttgccaggcaaacgaatgactattttctgctggctcctcacttatagctctgcaatactgcacttatttagatggtaaggcacctgacagtctccatgctaagtaactctcctcatgcatttcaacatcgccatcattctcctattactcctccaagccctcttccatcggggaatagagctggtgcagcgctttcagttcattgtactcctgggggagaataatgctcttcaactgatctggtgtctcagtcaaacttagatccctctgaaagtcagatcctttcagcgtagcatccctgagtgccgtgttggcaggaagcgagactcgtaccttaggctgaatggatttcttctaaccaatcccagatatcagagtagtgcaaagtcctgcccatcagggaaccaacatatgctgcatcttcacaatgtccacaggccagggaggcagccgacatatggcccaaagagggaatggagagctgaccaggcccaaagcatttggaggggctggatgggcccctgctctcctttcttttctctccctggcagcatcatggcttccatctggtcatctaaaaatcttttaaaacactcactcatcaacattgctattactgttcacaagcttatgctcaggcaccaatccgttcagtgaatttttcagggtcacacagaaacaccttacaaaagctgaaaaagacttccatgcccctcaaaggcaagcgaacctggtcatcacttcatccttattagattaaaatgatctaatcttggtaagtttcgctttgtctactcttttcatttttgcacagaaaaggattatgtgtgcgtttttttcaatgtggcaggttatgaaaaacactcatgagcagtttcttcacctctgaagtggaagaaagtgagtttttctgagattgcagaatttaaaaaataatcaaaacctgaggattttaggtcattattaacagaactcctatgtttagatttcataaagtcttgtcagaggtgcatttcaacagaaaaattctgtacattctccatatcttttttctttcttacttctcatttccctctgcacagaaaagatcagctaattaggagattcttatgtctccttcctattcttcatctatccccaatacatgaatcagtgtatcctttttgtaggtcatgctctgtttggctaggctacagttcccgtgatttaatcaaacacaaatccacaagttgccctgaaggtattttgtagctaggattaccatctacaatcagttgacttcaagtctaggaggttacccttaataatatgggtgagccttgtaccatcagttgaaaaacgaaaactcaagacttcagtagtaactcctgcctgagtttccagcctgatggtctgccctgcagatttcagacttgctaactcccacaaatgcatgagccaattctttaaaatcaatctctctctttctccctctctgtgtgtatatgtgggtctcttgggatgtttattcctgggatatacccttttagatcccagccaccacgccaaaaaaaaagatggcaccatgtagagaagatgctaggtcaattgcccctgctgagctcccagttgacagcagtttcacctgcctgcaccagattgtgccatcctggacatccagccctgtgggaccattacatgatgcagcccactgacatctcactgcatgctcatgagactgcccaagtcagaactgtccagctaagcccagtctacacagagaatcatgagaggtgaagattcactgttcttttagacactacgggttggggtggttggttatgcagcaaatggcaatgacatataggaagagcttttgctatgttgttctcgagtcatgtttgtatttgaaaaagagcttcttcaaatgagtcaagaagataatgcaatgtgtccaaatagcacctggattttgctgaattctttctcttcagacaggaataaaagatctgaaaagaaccgctttgttgaggccatcagtttgttgttaacaaccctcaaagtcagcctggaatggatttagctcactgtatcaagactgtggacccagagagctgttcatctgctgtgctttttcactaatattttttaaagggataaacacgttttaagccactcagaaattgtcctaaaatggagatattgcaactactacttaatttttccaactcatttatgactttcctatgcagctctgcatatggtgagtgaaataatctatcagtctgtttcattacatccgagatggcccttccttgaatgatgtgttcatatctaatatttgctgctgtgaagtgatggagataggaaggaggagtagaacagaccataggaatgagaagaaacatagcaggcaggcaaatatattttaaatagacaaagactcatgctgagaggataaatggacagaatgttgtttcctggtgtttagacctctttggaagatcctgtctatatgatgctattaaattacaaattgccactgtaatgtataaaataacgacatattttaaatttgttgcttcttccgaagagctttatttacacactaagaaaaaaggcttaaaagcacaaggtctcacacgaaaacccaatgaaaaaaaaccagtaaaattatcttttacaatatcaaaatatttaaaaatttcatgtaatatatgtaaaaagaggacaatcaatgtcctaatctgttttatatggctataacagaaaattcatctgtgagggccttcttgctacctcatcccacagtcgaaggggaaaaggcaagagagcacacacaagtgagaacccactctcacaataatatacctgctcctgacataatgacattaatctataagccagtcaccactcaaaggtcccacctctcaacaagatagtactggggattaagtttccaacacaggaattttgagggacacattcaaaccttagcaatcaacaatttgaaaaaaattcaaggtgacaaggacaaccatcttattggcaatcattaagggggtaacataaaatttactattatagggaagtataatagatgagttggtgagtaaagactgaatccatacaaaggttattaaattaattctgacatatccgtaattatgacgggcctgagagcaggactctcaaggttttagctgtcgaattggctcacacatcttggagggatgggtctggctcggtgcatgcaggttgatcccaggcagggtgctaacattttcaagatgatacccagccacagtcacgcgaatgcttgtgtgaatttatacttcaccttggcccagaaaggacttggtgggggtttcctctactctaacaaaaactaaaaaattaaaattatggctcttcacacagaggcaaatgacacaggtagcattagtgacagtgatattgggctggccgtttgtcccagcctctcatcggtctaggccagatctcttggtcttgccccaagacaaggggcatgggcttgagcctctttatattctgggagttccttcctccagaactcgctgagagaatactttatttgttatttgttgcacactgacactgtgcttaggatctggcaagctacccaatgtcctcccgggtgctttgcaatcgagactgacaaatacccaattataaaatccaccagctgaaaaggcagttaactctccaaaggacagagtcacttagcatttttatttggcctccatctcagacactaaagcagcctctcagtatcctgctgaacaaaccaagggtcatgtgtttctctagctctggatggtgggatgccccgagggcaaaacatcctcgtgtctcacccaccccaagatggatataggggatcttccaccactgcaaaccttggtctttctaacctaagttagaatactatagtataaccaactagtattggtaaataggaaagaaagggagagcatgagaaataatggattttgcagcttttatttgtgagtgaatgggcccacaattttcccttcctgaaagtcaacttgaagttgaaataatggggtgatacaccgtgaaacaactcaatgactactcagcccagtggtgttagataaatatttaaagttaagtatctcgtgtagaaagtctaagttaatcataaaatcaaggtgagtcaaaacatatctacgccttagttatttatttcataatttatctattatagagatcaagagtttcataggcacctgttaaaaaagataggaggccccaggtggagtcactcatgctaaagttccacgttaccaatcgagacgtaagttgtttacgtgtaagatctgaccttcccagaagccaagagagaaatgatggccacatttccaagcaaacctttcaaaacaaaacccaggagatttcacagtaactgacccaccaaaagggcccagtcaacctgagcaacataatagggaagtcccctctgcttaaacccacaccatactgaaggtaaccaatgtgctttttgcactctgctgtctccttgttcctactaaagctgccttactgaagacaattgttctgagatacctggtggagctccatactattttctagactggatgttgcccagttcatgaatcattaataaaagccaatttgatctttgaaactaaatgtgttggccgggcgcagtggctcacgcctgtaattccagcactttgggaggccgaggcgggtggatcacgaggtcaggagatcaagaccatcctggctaacatggtgaaaccccgtctctactaaaaatacaaaaaattagctgggcgtggtggcgggcacctgtagtcccagctactcgggaggctgaagcaggagaatggcgtgaacccaggaggcagaggttgcagtgagtcgagaccgcaccactgcactccagcctgggtgacagagtaagactctgtctcaaaaaaaaaaaaaaaaaaaaaaaaaaagaaagaaagaaagaaacgaaatttgttgaaattgtgttctttgccacacattttccattcacaggctgaacttctgatttccctgatccccctaactcctttcaacaacataggcttttagaaacttcaaaaaagacttttcctgccgagaatcgtttaatttatttacatacagcctgacatgctctagaacgaatttccgatggctctcacaaaagcataacatttcagaggtgaaagaaaacttgatgcccacataagtgcaactttcacctgaaatgtgaccttggattgcagagccatcatctgtgtgtatgacaagagaacacctcttctagctggcccacctccattcaaagatgacttgattctaaattttctttttccattgacccagcatcgatatctcaacctgcttgactttattgctgacttctgaaacctttcaagataactaaaaatctcttttgtataatggcccatttcgtatttcaaatatgaaatgcatctcagtatttaatttaagtgtattttaaatagagcaaccaaggaaatgattaaagaataccataactctagagtagaatatttaaagccagtaaaaatgatgtgttgaaagtatacttaataacatgcaaaaatgctcatgaaatgatagtcaataaaaaaagatataaatccatattggaactatgattacaaatgtgtgtgtgcatgtatgtgtgtgtgtgagtgtgtgtgtgtgaggtggagaaagagtgaagacagaggaaaagaatgaataagaaaattaagagaatttaaaaagcctgggagagaataaacgtgaataatgttatcagtggtggcaccatgaaccacttgtaaaatatatctttgtattttccagtatgagccttgaattcatgcctttacagttactgtgtgtatctctgcacttacacccaccctaaactctttacagttaatttcatcaaatacccagtattcctcagctgatgattttgagtcttttgtcctctactctaaacacactccagtttgtgcatgtgtctgtttctggaactgccaataactagacacagcgtcccaggtgtggtgtgaatagctcagatgcagtggattagggtctcctttgccctggacaaggtctttctttccatgcatttgaaatcgtcttccctctggtggcacgtcatctgtaatctcacgttcaccttcgaatcaactaacatagatgttcttttaaaacatgttttgctaagagcattctgataagtctttattcttagttctggccatcagaatgaccaattaactgaaatacttatttcaattatttggtctatctaatatatagtttaaaatacaaggagaattgtcaattttccaaaggatagtcatttgatattatgggttgaattgtgtccttcaaaaagctatactgaactggcgaatccagaacctgtgaatgtgactttatttggaaacagggtctttgcagatgtaagtaagttatgaggtcatattggattagggtaggctgtggcagtgggcatggctatgttccaataaaactttattttcagaaacaaacagtgggccaaatttggcccatgggatacagtttgctgatgactgctgaaactgtttgaggaagataatggttttactgggttcacaggtgagggaagtgaggttgaaagtttacaatcttgtagaaaaatcacacagtgaatacagggtagccctggagtttcaactgacaccacatctccagaagccgccgttgtaatcactcggctacactatcttagaggcaagaacaattctgcacttttgttaaaagtgtattcattggctgggtgtggtggctcatgcctataataccagcactttgggagggcgaggcaggcggttggcctgagctcaggagttcaagaccagcctaggcaacatggggaaaccctgtctgtactaaaaatacaaaaaattagccaggcatgatggagtgtgcctgtggtcccaattacacaggaggctgaaatgggaggatcacttgagcctgggaggcggaggttgcagtgagccaagattgtgccactgcactccagcctgggtgacagagtaagaccccgtctcattaaaaaataaataaataaatagcaagcttttccaatacctatattatcttggcaaaagaactagatcaacaagttcaaagcaaaacaaagacaggctaaattttattaaatcaaaaaaactgccataaattatatattttagaactatattatcttggcaaaagaaagatatcaacaagttcgaagcaaaacaaacacaggctaaattgtattaaatcaaaaaaactgccataaatgttctaaagaagttacatatgttagaagattcaggaaattaaaattcagagttattgaacattagtgtctcaaacaatctgtgtataggactggaaaaaataatgtacatgagagaacagaggaaacaaaaatcttagggaatcagtgaaagcttgatgtacatctcaaagtttctggtggttttcctagctgaaaaaacaattaaagggatttctttcaagtttctggggcacacaggagaaaccatgagggtgatgtcccacaacacaagcccttcttttgcaggatggtcccaccctctgcaaagctcctctccacactgcagacgggccttttacttgcccccaaaccatactcctgtattactcagtagcgttttgctgaatcttttattcccttaatacaaaagtactccaaacactctaggagcgtttgactgagtgttaaactgttctgctcagaagacatatagcattaagttgtccaaaatcagttgcaaatcactcagcatcactgtatgtattctctatttttttttttttttttttttttttgagatggagtctcgctctgtagcccaggctggaatgcagtggtgcaatcttggctcactgcaacctccgcctcccaggtcccagttcaagcaatactcctgcctcagcctcccgagtagatgggattacaggatcgcaccaccatgctcaggtaatttttttatttttagtagagactgggtttcaccatgttagccaggctggtctggaactcctgaccttgtgatctgcccacctcagcctcccaaagtgctgggattagaggtgtgagccaccaggcctggtcatctctttctattttttaaagtacctttcatttactggttcaggtagttttgatccataaagacaaaaatccacattactaacagaatttagagatctttagttgacaaaataaaataactttttcgtcacctaactacagcatgatgttgatgcctctcagatccttcaaattaataactcagactcaaaaggtattgctaccacttgggctttgtttgaattctaagtaaaaataatttatttcccagaatacagctttagttgagcatggcaaaatcacactgggccaatggattctcgcctcatttccataattatcataaatacacacaaaagcataaataaagaataaggaattaacttcacaaatatacttggaacaagacataaagctgcagagtgtcaccacatttaactctctgctgtaataagtgccacagacaaatagagttaaatgggttaattagtcaccagtggccattttaattgcagtattgaaaatcaggcacaaatgctagaagaattctcattacagggttacctgggctttcatgggagggttcgcttgggagagcggcatctctaaaacattgtggaactgattacatctcttcctcccctttacctttcataattagctgtacactattaagttaatgcacatttatctacaacaattcaattcagactgcaagagagaatctttctagtctataattacactccagcttaattagcataatttccactgcacatattttaataaagaagctgccattatgggttggcttcagaagtggaaactcttccagggagatacaaatgcttcctactctcgaactgccacaaatgcaaagagacgacctaaagctgactttcttttttgagacggagtccaactctgttgcccaggctggagtgcaatggcgcgatctcagctcactgcaacctccatctccagggttcaagcaattctcctgcctcagcctcccgagtagctgggactacaggcgcccgccaccacgcccggctaatttttgtatttttagtagagatgggttttcgccatgttggccagtctggcctcgaacttctgacctcaggtaatccacccacctcggcctcccaaagtgctggaattacaggcgtgagccaccgtgcccgacctgaagctgactttccatgagacagtactgttgggaagggcatgcttctgcaggaggggacctgatggattctccccacgtggagctaacggctaatcctcagtgatggctgatggctggtgatgggtgatttggcaattgggctacgtggtgatggggtttgacctcatcagtctgtaaatgtctcatctgagaggcttgaaaaacatttctacagtttattttggatctgcctctccaggggaaagccatttgagtgcctgcaatccagccaccactagatgtcaccagtcattaactgggacacagataaatgagccctttaagatatttttattaacttgaaagacctaagcaactggttgtcttttctgcaactcccttgtgtgggggcctgttaacaacgagggaaccaatctatttgcccagccctgaaatggcaaatgcccaccgtgtgatttaaaaggactgcacacactttgcaaatgttagaaacctgtcctgataataaccagaattgtctgatataaaggaaaatcttcagttctagtagctcattatattttgcacaaacatctggctattcaaataaagttcgcaaaaaagattttgccagtggcattaatgttcttactagatcccttagagagaagaatgagaggcattttgcctcctctgaatttcctgatgttgaacgtgaagtcatagtatgatgcacaagaagatgggctttgaaaaagagtaggaaatcatcgctgtcatccagaaaaactttaatgagaaaactagaaaggaggcagatggaacaaaccaatgattgttgcgaagtcccaaaaaactgtttcaaatccaaaagtggcaatggtagaaggtgtgattctaccaatggttgaagagaccttgaaagaagtaggggtttttagagatgctagacaccagcatcatttctggaaaatccaggtaggtgccatgaggcacggaacatgtgtcaaacatttccttttccacatggatatttaaaaatgtaaacatttttaaaaacctattttgagtgagtttaaatagtaatttcagtaaggtatcttctcagtcaccaaagattcgatttaaaaataatgcaacagcccaggcacggtagctcatgcctgcaatcccagcactttgggaggctgaggtgggcagatcacttgaggccaagagttcaagatcagcctagacaacatggtgaaacctcatctctactaaaaagtacaaaaaattagctgggcgtggtggcatgcacctgcagtctcagctactcagtgttgggggctgaggcacgagaattgcttgaacttgacctgagaggtggaggttgcagtgagccaagatcatgccactgcactccagcctgggtagcctgggtgatggagtaagactctgatacacacaaaagaaaaaataacataaaaataacatagcaaatatatatataaagtactatcacactataatggtgtaatggattaaaaaatgatgtaatgaagactcatttatgccatcacaatctgcatttttttaccacaacactaaccatttagagctcatgtgcctgcagacagttacttaaatttgtacttatgtcttcaaaattacgggtaattttttttcttttaaaacaagatgttcattgcagggagcaatgtgcacactgacccttttaaactctgccactgttgcaaaggttttcagtaggattctcatagcggtctgaagagatagggaatgttagttaacaaaactgaactgtcctcatttcaaccatgcataaatgctcactctgttccttttaccgaaacttttcctttagaaatacaacaacacagctaagagcatggcctctggaggctacctgccttggcttgagtccagcttctctgcttactgactgtgagactgtgggcaagctacattagctccccgggatttagtttgctcagctgtaaaatggaaaaataacagcagccagcttatagaagtgaagaggaatgaatgggggaaagcgaggcagtgcgctttgaacagcgcttaccccaagctagtgatactgaatcactcatctttatttgctccttagccttcaaaaatgtaagaaaacagctttataacactttggggcccttgatctgcaaaacttctctttgaaatctattctcgtttattataatagaaatgctagaaaatagtttcctctgatttattgatcttaccaaaatagatacagtctttaaaaacagcacactgtctcttcacttcagaaggatctagatttcaggctacatttgcattgtattcatacctaatattcaactggaccacagcacgtatttaactcattgtactgtaatggggttgaatgaactgacatagattgctatgtttaatataaagaaatcagtgcttctggctccacaaagaccacatgaataggaagttcacaatagatggttggcataaatgtcaatattcacaaaaaaggtgcctctctttgaaactgctgccagagttcctctccagacttgtactttggacccctgcagaatgatttttacaggagtaaaatccctcccccctcagaatatgcaggacatcatctgtatttacttcaatataacataaaccaaaaggcagacctggtcagaaagttagatgcttctctagaaaaattatgctagtgattgaaaacgaaaaaaacacggagccttgaattgcaggattatgtcaaccctggaaatattaatcacatgacaattatttttcaaaaatttacacatgtataaaacaacattcacaaacattgtatttcaccaattcttaacttcaaatgggaaacaaaactttgtggcaaacttcagttaaatttgtgtctaaatcctcaatgttgagtccacttcccatgaatactgaaatttactagaattagttccttgtagaagaacttccccaaagtggggctgtttttatttttatttcactcacaaaatgtgtgagcatgttaggatttttccctttacattatttcttaagttctaacacgtaacacacacacacatatataatatatgtatagttatatagttatatagtttatataaccagagacagacacattaagcaatgcatttatatgtaattaatatacattggctaataagtattggtgaaataccacacataacaactatgtaacttgtcaggaacatgattgtgtttctataagcctattaggatacattcaaaggaaaacaatgtggtaaaaaaaaaaaaaaaatccattcactgtaatatttagcctgtgggaattttcatgcttttgcagtgtcagatttctgtctgaattaatttttattcaacagggagacaatagattatgaaatgctcataaaaaatacaggatccctgcttcaacacatggtaccatgagaagcagcattagaaaggatcaagctcttttctccctaaatcagtgttcagcattatacttctaggctatgtctcttaatacttcctttggttggcattattggattactgcaacccaatctttagccttattattgcaagaaagcttaaaatagcagataaaaaaccttcaataaccagcagatagaaaaagctaaccaaataatagttagttcatgtgaatgccacgtggaaccaaacatgaaagtatttattgaaattagattgtatgaagaaacatactaattagcatcctttagcatttggcaataaaatacaaactaggaaaataaaaggaacatgttaatcattaatgtcactatgactttagttctattttaaaaaatgtttaaataatgagccacaatataaaataattacatgtcaagtcaattcacatacacccaacacacacctatgtatatgcataattaagtgaagaacaagttatcctcgcaaaggtagatgcatttgaataggtcctattcttttctagtctgttctgttctattccattacattattattctacaaacactgttcatgaccaataaacgtattttaccacccactaatggatcacaacctgtagttaaaaaatgactatcaaacatatgtgcatttataaattaatgtatgagaactagataatcatgcatactcatatcacataaagtattgcatatacaatattaacagtttggcaatttgggtaacacttagctttaaaagctaaaactaaaccaagggaaaaaagagctttctttcatgattttaattttatttaaattcctggtttattgggtatttcctttcttcccttcctccaaatatatggtccgcttttcaaagatgtgtgcatgtgatgaggatgatagcaatgttgagaatatcgccccctgccacctggacagtaatctcaattgtcagaatgggtcccactgccattatgacatacttcatattcagataaagagggaatgatgggcttagatgatacgctgcaaaggattatgttgtacctttaaatatctcatatcatctgcaaatttggctccaattaccaagtgggtcctcaccaaggactggctgaatgagaaatgagtgggaggttgaaatggggatgtctgggagcgggtgtgggggaaggtttcattctaagatatgcttcatctcacttaacataaggagaaaacaacttttactgggtaggatacaaattgtgcatcttaagctacaattcccaaactgttttgggaattgtacaaatgaaaatataaatgaagtataatataaatatagataagctgttttgggaataatacaaataaaaatataaaaatgttttataaaatgttataaaaatatttccttttacaagtataatttccatgtttctaaaaaaatacagtccattatttcttaaaataccaattcctgacaaataaacagagagtttagataatttttacaccaaaatttgtggattaattcagaaaacaattatagcaacgtgagattatttttgtgatagaattctgtcctttcttcatctgatcgctcaccatctactgtgaaacacaccactctatagccactcagattattttatatccatcaattatgatatattcattagtcttaaacagctagaggcatttgacaacattcttcctgtgtcagagtctaggaaattttttttgaatatattattttaggaaagataaatgtttctaaatcagtgtttgacatgtattttgaatcaagacccacaataaaaaccttagatccacccatgccacactcacaagtctgactctttcctaaaatgccaaacaaaacccaatttttccttactatggttattataatttattccatcctattcaatcccctaaatactggtgaaaacgctctgaactgattttacaactccatcgtaggtggtccccaggtggaaaacaaaattgtgctaatccaatcaggtcatggactcctgaactgcagtacaactatgccataaaaatatcatcatcaaattctcatttgcactacttagactcaaggggcaaagggcgactttactaaaatatattagggcaaagtatctacttttataattcagagaaagacattagaattttatccacgagtatataaaattaatgatatattagagtaggggtcaaaatctggcccatgggacaaatctggaccacctccttttattgtacaacctgtaagctaaaaggtttctacagttgcacatttataatctgtctgatgacagggaacactaactttgaagaccagctaggcattctcacaaaaaataatcccattcttactggcagacctgtattacaaaacattattaatattgatattatgaattgtttttgaatttcattaataatagttttgtgaaaatgtgttttctctcctgttatataattatctacatataatattttcaattttgcctcttggcccacgaagcctagaatatttgccatctggcccttcacagaacatttgctgacccaagtatttgagctgcatgaaaaataattgttataattattattatatgtacctgtcaaatcagagagtgatctggttctcaacctcaacacaccctgagtctcaagtggacacatggggaatacgcacatcaggtgtgtaactggctaagtgtatgagtcacgctgccttcagtgagccagatgcaaaaccgtccccttggttatagggagaagtgtctcgctgaagagcagtccctctcttcagtcaaggaaactcagatgccttcattaaaaataactttgcatttattttattaagtgccataagcttgaaggaaaattgggcttttcggtcactgaaatttcttttcacttaattccttccatatcatgggaccgtgtgcagctctgcagcgggagacattgtacttaataagcattgcagggagatgagctgttcccgtctccttgcaacagcaactgcattttgcataactgacacttatcgcccagataaatggtattattgggcaacctcatgtttattgcacttgggaaattcacatttgtttctaggttgacatgaagcagcgtaggttagctccctctgtgtatattttccactagaagaaaaaagttgtgcgccatcctgatacacagtaagttttcctaaaaagatgttttgctctttgagatattaagattttaaagtttagcactggaaaaacacaatttgaatgaatatatagatttcctggggcggccagggaggggacgggtatttatgccttcgcttttcatttttcccatgttttatttcgactgctcctgcttcatgctctccttgtctcctgctctcataaagacttctcttcagaacacgctgaactgaaaaccttaaacaacagtccacgccgccaacattcatcacttgttctcattctaactaggggctgagccaaggtactttctattggcgtaatccctgacagttgtactcatcctagaagtaatattttacaactttatgaaaatcttacttttcatgacatgtgttcatcaaagcctcatttcttaaagactttgggcttaagaatgcatagaggtttctatgactgctttgggtgctgatgaaatatctttggccatatgcctatttcagcaataactaataactttttcatatgaaaggaccatcttattaaatcctcatttcacatgaacacagaatggtaaacaacctgtctcagcaaaaatgtgagacaagcccaagatagaaaaaaaatgttcaatatcacattgaaaacacatttgggagagtaattagaaaataaaacaaataaaacaattttcacagaaagttgattttgctttcgttttttttttttttaaaaaggcaacaccaaaacacaaaacacttaaaaattttcctggagcaagatttaatctattggaaatagattataaaacaatcaagtctaacaattaattatcttctccgtgcataagatattatagtttatttttgcttgctaaccgctaatgaaaacaatgtttttaatctaagcaaaggtttattgttgttattgttgttgttggaacaaagaactgttttccaaggaaaaagagtgaggcaggtctagaactaccgatctacaagaaagttctaaaaatatattaaatatttctttgtcattaatgaacattctaaaaatctttctgttgcaagaaaaacagtaaatctgggacttaactggtacttggtcttcctagggtgtttcaccaatgttactaacataattacgggtatagagttggtaggaagctggaggagatgattcaaattctctccatagataaacttatgcaggttaatgcgtgggtgggaacaagtgtcctcaataggccttgcaaagtgccaggcaccattacaagcgatttatgtataaatcactttatttaattctcacacaatgctatggggtagcggctactaatgccagcactttacagatggggaaactgagtcacaaagacacaagtaagtggtccaaggtcacatagctaacaagcagcagaggcaggattcaaacccagagcatctggtgcctcctaatccctgctcagaatcaacaactggtaagcagtgatgtcatgactggaagccagctctcccagcttttgctccaactgtcctgatagcagccagtgaggtgagcactgagagagaaggatggaacagaagacatctgggttcaaattctgccccgtggattcccagctggcccactgatgtacacatctgcttcttagtctcttccacaataagaggggtaagatcctatccaccactctgagttgctctgttaatgaatgaggtccccattgcaagagcaattttaattaaggagatgcttagtaaacatcacttctctctcttacactacacatattctctcccttaaacctttctcagttccctgcttatttataaactcctacagccttatattcaagggaagcaagactttgaaacagctagaattaaagtttgacatgacttcaaattaatcaggattctattttgtgccaatccatgggggaaggtactgagtagaatgtgtttcttcaaaagacattttactaattgtgttttctagatgatttaatgccagccagagaaacatacaatttgtagattgctgaatacctgattttaattcccaagtcattcaatacttgcacatgatctaaaaaatacaattaaaacatggtcttagttgtttcttagaaattcaaaacaaccttatttctttatataattaagtgatgtgacttttccagaacacaaataatgatgtattgatttaaaacaaataaatcatacatctcaaattacaaaactatagtttttgtagacctcagtgaggacgtgacattcgagaaaatgtctccctggcttctgacatgagaggagacaggagcaggggatgtggcttgaagatggtggccacttagtaagctcaggatatacatatgtgtgcatcattgcaatacagatgataatcaaagccttgagtctggatgaaggagggaaatagatgaagatgggcagagaacagatgtgagcactgtgtctggggcatccccaaatcagccactcctccttgaagcactctcttctgaaaacccaactctcctggtttcctcctacttcccaggccccttcttgatctctttccacaattctccctcattgcttgatttctaagtgatggcagccctggggctcatcctggtcctcttctcttctttaccttcactcactcccatggtattcccatccagtctcacgactttaactagactagggtatagtgcatagtgggttgcaaagtggcccccaaaaagatacatccaagtgctaatacccagtatctgttaatgtgaccttatttgaaagcagtgcgtttgcaaatgtaattgagtttaaggatctcaagaggaaatcatcctggattcagggtgggcacaaaatccaatgactggtgtccttataagaagagaaaggagaaagagattcgtgacatgagcacacacagagaggaaggccacgtgaagatggaggtggagattggagtggtgaggccacaaaccaaggaaagccaggggccactggaaactaaaagaacccagaaaggattatcccctagagctttccaagggcgtgggcctgctgatttctcgattttagacctctggcctccagaactgtgaaagaatacatttctgttgttttaaaccacatatttagtagtaattggtcacagcaaagcccaaggaaactaatccactatatttttgaagagaaaaagaaacgcatctaatgaaaattctcccttactatgtagaacagcttgaaaatcattcccccttgcctttttttttctttcctagagcagtgagagaaaatatttttaaaataatcttcacagaatagaggatacaactcaatagaagttttggttcttaaatattatctaagaaaatgtaagcttttgaaactctcccttttactgagaacaacagaaattacagatttttcaaattttataattcacatcatcaatgaagatggaataattctttagaaaaaacattttgaactcacttgttaattaaaaaaataaaataactgcagaacagcttaagtcccagaaagaaacttcaatggccagtctttaagagctgcttttgaatagtatgggctgctctggtgctttaagctttttaaaaatatttatttatttatttatttatttatttatttatttatttatttatttttgagatggagtctctctcttacccaggctggagtgcagtggtacgatctgaactcactgcagcctcaacctccgaggttcaagagatcctcccacctcagcctcccgagcagctggaattacagatgtgtgccaccacacttggctaatttttgtatttttagtcgagtcaggatttcaccatgttggccaggctggtctcaaactgccgacctcaagtcatctgcccgcctcggcctcccaagtgctgggattacaggtgtgagccaccgcatccagcctgctttaggcttttatgctgtctgacttgggaaacaacaatacccaagtgcacttccctttccagacacccaaccaccccatagctccggtctctctctcagaaagccagcatatctacaacattgctgcaaagcctcttgtctccacttttctgtaccgcacagtagttacttcttttcttagggactttatcttggctccaacacctctgtcctgctccaacacattctctaaaaatcccaatatccctccaactaggatgttcttcttaatttcttataaactctgttctcctcgtccctccccaccagctatctccatcaagggtctcaagggacgcgccaatccaatgcttctctacagtcgccattctactcaacctctacccactacagataagctttccctcttgcatgtctggccttgcccttgaactatgtttatctctctcctgcctctgcttcctcactgggcttcttttacaggtcctatttccttgtctttcatttatttattcaacaaatattcatggagcacctcttatgtgccagacactggaaagcatgaagaacaattttgtcctccacagtgcttgcatgccacggaggaggaaaacaggagggaagacatcaaagcatgttgggcagctccaggtgctagaggggacaagcacaaaaatgacataggaaaagggggagtgggaaaagctagtggccaggaaagacctcagtgaggatgtgacatttgagaaaatgtctccctggcttctgacatgagaggagacagggggaggggatgtggcttgaagatggtggccacttagtaagctcaggatacacatatgtgtgcatcattgcaatacagatgataatcaaagccttgagtctggatgaaggagggaaatagatgaagatgggcagagaacagatgtgagcactgtgtctggggcatccccaaatcagccactcctccttgaagcactctcttctgggacccacctctcctggtttcctcctacttcccaggccccttctttgtctctttccacaattctccctcgttgcttgacttctaagtgatggcagccctggggctcatcctggtcgtcttctcttctttaccttcactaactcccccacggtgttcccatccagtctcacgactttaagtagactagcgtatagactggggtaataatataatttgctgtcaaaacctgatgcttctgggactgaaatggggtgatgtaaatatttacactgaggaaaaaggcatccatgggactgtcttgggcagatgagaatacatgattgctcggttctatagacaaatacctgttgattttataacaccaatccagaaccgtccctgtcttccagactgtgatgtccattcaaatacttaagagacatttgaaaccaaatatgaccaaaattatgacaccccctccaaaactgtccctctcaccatttccagcagctcaattaatggcaacccatccctgcctaaagcctatattcaacccatcaacactttctgtcatctttaccttgaaaatatgcctgtaatctgactacttctcattctcatccctgcacccctctggtgccccatcatctctgttccatattacttcaacagcctcccaattggtcttcctgcttctgatcttaccccctggagtatactttcaagagagcaggaatagccaatccacttcaaagctaaggaaattcatgttacccctcttaagaggttgaatccctctggtgccttgcattagattagacgattcatccattgctataaagaaatacctgagactgggtaatttataagaaaagaggtttaactggctcgtggttctgcaggctgtacaggaagcatggtggcatctgcttctggggaggcctcaggaagcttccaatcatggtggaaggtgaagtgggagcagacacatcacatggtgaaagcaggagcaagagagagagagcatggtatgggggtgggatgccacatagttttaaatgtccagatcttgcaagaactcactcactattgcgagcccagcaccaagaggatggtgctaaaccattcatgagaaatttacccccatgatccagtcacctcccaccaggccccatctctaatacaggggattacaaattcaacctgaaatttggttgagggcagatacacaaactatatcatgcctgttcaccttacttgcaataagagtcaaagcccataccccagccacactgaattttaaaagtctaaggtcttaaattgtgtaatttgtttttgctttccccaacccatctctataagcagcatttattgtaaagctcagaacatttaaaatccagcaacattttaactcaaatgaacagagacacaggacagaaagtgttaataccaacctactaaaagaagatcaaatattaatgtggtggaataataaaggaataataataatagtgttttagactgctctgctgccacacaaaataccagactgggtggatttaacaacagaaatgcattttctcatagttccggagggtggttaagtccacagtcaaggttccagcaggttttgatttctgatgagggctctcttcctgggttgcaggtggcaaccttcctgctgtgccctcacatgatggagagagatcaaactctatttcctcctcttttgcaaggacattagttctgcgatatcagagctccacctttgtgacttcatttaatcttaatcgcctcttcaaaggacctacctccaatacactcatagaggggagttagggcttcgacatatacattttttggaagggaaacacaattcagtccacagaaacagagggaagcatttacaggcatgtttctctcttacacacacacttggcaatccctgagcactttcagttttgtcctgtgggcctcttccttcccctagtttttccctgaaagttgcatgctactccagccctgaagactattatccagccctgtctcttcttcccacagacccctcctcagctgtgtgtccttcaactccctggatcaaggagcaaacagagtaaggagtgtgggtggtgtacgaaatgatggccctgggttgggagaaagcctcatttcagatcaaggtggggaagaaaaaagcgaaagaaaaaaagatcagacttcaccttctttgaatcagcatgtaacatgttcaccacacatgaaatcctccagacaaattaacgaccatgtagctagtgtattgcaaaaaatattatatcaaacattttatgttttcggccttttaatggcagacgtttgctccttgggtaaatggtttcttcacctttaggaaataattgcagaagcccagtaaatcccagagaggataaggtcactgagggaaaggaaaggctaagcatgtttacattattgactaaaatggcttgggggagctacgtttctggaaatgttcacgaactccatcaatttttctaaaatgttccttttggtgactaaagctgttacctcacgagaggtgttagtgctactgaaagcaaacagttataggaaatagaatttcatgaagcaacagcaaatagccacagaattccacgaagcaatggccaatggcaaaaacttgaaagagtatgcaaaataaagtcaacatttgtggactgaatctgttttcctatcatgtatattagtttgctagggctaccataacaaaatatcacagactaggtggcataaacaacatagatttgtttcctcacatttctggaagcttgagatcacagtgtcaacagattggtttatctgaggcctctccccttggcttgcagctgactgcctcctccccacccactcacatggtcgttcttctgtgtatgcgcacccttgacatctctttcatgtctaaatttcctcttcttataaggacaccaggcagattgggtgacggccaattttcactgcctcatcttaacttaatcacctctttaaatggcccatctctaattacagtcatattctgaggtactgggggttaaggctttaacatatgaattttagcataacacaggtcagcccataacatagtgctgaataaactatcccaaaacttagtagcttaaaacaacagtcatttattttgctcagaaatctaatttgggcagggctcagcagggacggcttatctctgttccaggcagtataacatgaagagactgaactggcattggagaatccactctcacggtggttcgctaccatggctggcaagtcagtgctggttggttgtcaacggggcattcagggacagggccatgggctgaaaacctcagaatatcagcacgatcagtcaatgctgttgggtattggaaaaaaagcaattcatgcttctcgtctgacatttctaagcttcctaccacagcactcaggagagtgactggcatgaagtaggtgctaaataattacgagtttttaagtgcccagagaagatgtactcaacagggagagttaagaggttccggacttgataccctctctctcctagcatgcagcatcagcaactgatttcaaacatgatgtcgggaagataatcacgtgttgttttgaaaatcactccaaggtggttctgataagctccaagcccccataaagatgaacgctacagcctcgatttacaaaaggccagcagctcctgctagaaatccaggagatcctcctctgatgcatacactgttagggaacgactgttttgtcttcctgtagatgctaggcaaccaacattacttagattatcctaggagggtatgatttacatatcttttttgaatcaattaattctgataaaaagtgggctttcatatgtaaacttaaatcttgcattgaatatttatagaacaataagccatgagtaagtgcaatgcttttaaattattcctttttatcttcaattgtttatacaggtttaacggcaacaatcttaactaacaacaagtaatgccctggctatttattgtaccatcgcatactgatatatctttgccagataatgtttactcaaaactcaggaaactcatgttaaaacttgcctcgttctagcactccctcttcctcagatctttttaagacaaaagatttacaaattaagacccttcagctgactcaagctcagcctgatttaatcctcaatagccagtcttacaaaattctcctaaaatgctttgacacccttaccaatgttatttgcttgcttttaccccagcccctatgctttaccatgtttactgaagaaattctgagtagtttttaaccagactgcttaatccatgagttaactctcaggaaaatcctgtggttttagtcagacaaaattaagatttttttcccatcctgtatgggaattgaaatcacttgcccatgcccagtgtacaagtaaagaccactgtttttggtattttctatggtataaggagtgtcatgataccaaagagatatgtcaacttcctcgctactgttaacatgggaggaaaaaaagaggagggaatcggctgggcgcagtggctcacacctgtaatctcagcactttgggaggccaaggcgggcagatcatgaagtcaggagtttgagaccagcctggccaacatagtgaaaccccgtctctactaaaaatacaaaaattagcggggtgtggtggcacctgcctgtagtcccagctacacgggaggctgaggtgggagaatcacttgaacctgggaggcggaggttgcagtaagccaagactatgccattgcactccagcctgggtgaaagagtgagactccgtctcaaaaaaaaaaaaaaaaaaaaaaaaaaaaaaaaagagagagacatgggaatctgtatatttggaattcaaaatgaagaagctaatttaaacaaatacatgttagattattcatacatttttagaaaataagtaaatcacacgttaaatttttcagaattgaggaaattcatgtaaaccttagaaaaagtaattccttaagttaaacagtagcagccatgcaatgcggaccttgtggttctgttcacgtcgtctgacgtgtattgtgtttttcccttgtccagtgtgtctctaatacagtcttcaacatgtgggctattagcaaccaccaccataaaactgtttctcaatactgagatggtccctttactgaggaaagcccagcacattcccactgctgcctggtgtgggcttcacgctcctctctattaggagaatgtggttctgagccgcatcaggtgttctggtcatgtgaattcttcagccacatggagagcgtgaggcaccatctgacagcactccagggttgtgcagggctgtcagtaccgggctcctgttgtggggaggtgaaggttatgcagggcctatctcattatttttttattttatttttttaagttccagggtacagatgcaggtttgttacatatgtaaatgtgtgccatggtggtttgcttcacctatcaacctatcacctaggtattaggctcaacatgcattagctctttatcctaatgctctcccagcctgccccctggacaggacccagtgtgtgttgttcccctccctgtgtccatgtgttctcattgttcagttcccacttagaggagagaacatgaggtgtttggttttctgttcctgtgttaatttgctgaggataatgacttccagcttcactcaagtccctgcaaaggacatgatcttgttcctttttatggctgcgtagtattctatggtgtatatgtaccacattttctttatccagtttatcattgatgggcatttgggttgattccatgtctttgctactgtgaatagtgctgcaatgaacatacatgtacatgtgtctttataacagaatgatttatattcttttgggtatgcacccaataataggattgcagggtcaaatcgatctcaccattaactttggcttctaagcatgtatgtgttccaggctggaactttgcctctctcactgtctggactgagaatggaggctgagtgatagcagaaaccagaaatctgcttcttttgtgtcacaggggtctggtggcctgacagagcccccctccttgacaaagctttagtcaggttcctataagccttcttctcaatgagagctcaatcttgactctgtccttgctaagaccagttttggcaagaatactgataatttagtttagagagaactcccacctttgatatctgattccccttaatgtctgatcaagttcctcatccttcacaatactccaggttatatctgctgccccagcaagaatcctgttagattagcaaagaaccatctccccttgaggccccctcttggtaatttttcatccactgaccccacccaccactgccttcctccttagctttaagtccccacttttccttgttgtattcagaatgaagcccagttctatagtgaaatctctcttcccctattgcaatagtttctgaataaaatctggttttgctgctttaactactgtccagctctggttctttcacaagccccagtctaaaagtgttcctgaaacagagcagaagatcaaagacaagggagaagagttctggaaaagactagaggataaacacaaaagtgtatgaatactagtgacaggtgctgatcaatatctactaccccttaaatttggagacccaaaagccagaatgagggggatttttcccacttccctccagaaaatagacagctggcccctctgcaacaacctcttatgactgcagtagaatgaaacgaaagaatggcaggtttgggtacagggagcctgagataccgctccttccttttgctccaattcttacctccgcttccctctcaaccagaatcctctttagctcctataagcccaggaggcctttcctgctacccataggaactaaggaggtggttgagagttaaaagccagggggtttatttccaggaactgagggagagtgcacacatatatgttaaatccaaagtgatttttaaatacattaacaatacacagtgtaatataagtgttaataagagagcataggtggatgcagatcaataatgatgccacagcataaatgtaggagtaatattacaaattagaggacaaagatactggaaaaataagtgcttttccagcaattgatatccacatgaaaaaaaaaacagatccctacctcacactacacacaagaagttgaagacatatttgggaacaaatgtgaaaggttaaacttaaatatttaaataagaaaataaaggagcatgatactatgaacttcatataaggaagacttttagacatataaagaacaaaatttaaatgctttaaaatttataagtaaaaaaaaagagacatgccaccagttggaagaatttataagaatctagataccatcaataatttataaatgcctcctatatagttaataatggttttcacttatgaacaaatcccactgaaatacttcacatgtcttaagttattaaaaactcagaaaagctcaacaaggtaggtgcttgtattagactcttaagcataaaaagactacagatattaaagataaaaattgcccaagatcacatgaatagccgatatgggacctgcacccaagtgccttagttctagcactctcactcgaagccaacagtaaaatggggacaggactgaggaaaaagcaagtcacagaccactaacaatgctgaacacgtgctaaacttcagggataactggggtaatgcagagggaaacaaccaacccatcaaactggcaaagatttaaaaggctaacaggagttggcacatacagggtgaaatagaaactgtcataaactgacagtgggagtataaaatgggcccaagcattttagacaacaaatggagagtaattcttaaatttgaagatacacgttcctctggtttagcaacgttcatgctctgaaaatactcttccacatttgcccaggacacatgcacaagaacagtccttgcttgctgtctaccaataagagcatggaaaccatgtaagcatccatcaatcagagaacagatgaatgcactgtagtctatccatgcaatggaacactaccaagtaggaaaagaggaatgaaatctacatatacacacccacatggataaatctcaataacaccgttgagaaaaaaagcatatttccggtatctctgtatctctgcaaatgtagtatgacgctgtgacaaataattttatgtgtcaatttgactaggccacagtacacagatacagtatttggtcaaacattattacagatgtttttgtgaaggtattctcttagatgagattaacatttaaatcagtcaactttaagtaaggcagataacccaaaatgcgcatgggcctcatccaatcagttgaagcccttaagagaaaaagactgcccaccttagaagtaaaggggattctggctgcagacttgaactctcccttgagtctccagccctgctgacctaccctgcagattttggacttgccaagcctccactattgcagaggccaattccttaaaataaatctctctctttttatatagacatatttttgttggttgtgtttctttggagaacactgagtaatacagatgccaaaggtgccaatgtttaaaacacataaagcagttcatgggcaaacacatatatgaatggcatccttagaagtgttcaaggtagtgtcctgcttaattctcaatatgcaggaataacagtccatatacgacctttacagtactataaagggatgatttgaaaagttttattaacatgcaagaagtgcaggggacaggcttagacaattctgagagctgcatttagagtacatttcgtttttctagaaagtgaatatgcctccttttctagcataagaagataagttgattttcctcaattataatttgaatcactggaccagttccaaaaaactacacaaaaatgctacaccaaaataaaaactccgcatcagtcagttgatacaataaatgcgaattaccaattttcctcagctgtagtttttttatttttattttgtaacagcaaataatttattttcttatgtgtattataatttacaatgtgtttttctattatgaattaggggaaaatttctggaccatgtcagacatcattcaggtatgacacttatataattcaatgcattctaagttattaaactactgtaggcagatgcattgcggcaggttatttgtttttgcataaaacatgccaatattttaaggtgaggtggcatgggagacgcctgctatatatttaaagtcctatgagattaggattccaaaagtaacacaaacattaaatgacactgatgtactgacaatcatctacattcatgttcttctttttgtgcagaaactgcttctaaaatgttttctagtgtgccttcaagtattttttttttttaaatacgacttgggaaaaacaactgctaactaattttaacaccatgtcaattatgctaacaaaattctaattgaattacttgtaatgtaaatcagtctttctttgtgttgtgtgagcgcttgcatgggtgtaattattatacaggctgtcaggtatcagacactaactgtatcataaacctataccgtgggcttgcttgtccacagatcttttgatatatctagctctgtcttccatagctttggacaaactaatgggggaagcacaattttcaaggtaccacagaggtaaaccaatggattctcattatggaaatgcagcagtctagaaagaaggaagagactgagtgttcagaattgacttttttaaagaaataagagatcagtggatgggatttatgtcacaaggaattcaattagttattttatttcaggctgattatatgagatcctatgatgagaaaaaaaaagaaaaccaaaaaagaaaaaaaagaaaaccaaaaaggaaaaaaaaaaagaaaaccaaaagagattctgtactgcaagatataagaggaggcacctttaggggtgccaaggatgttgtaacttcaaatgctgtcaaatgtggaaaccccggcagagcacatgtggacatttcagcccctcagcatatagaatccccatgtggcctttaccactgacatgatcagtctcagctctgatgtggccatctccctgtaagccttttgcagcctgccatcccccccgcctgtgctcccaggccactatctgcacaccttagcacaggtctcatgagatcctcgtgctgttctctgtgtgcatgcctctgagtgcctcaagaagtgcctgttttctcttcccagtgtccagagcatctaacacagtgtgtgacacaatgcaggtgaccatggaaacaaaataattctgtcttgcaaactttcactcagatgctcttaagcactcctagtctgacctcaggctcagattccatatcccagtggaggaacagctaccgagtagcacaggggaaaacattctatgctttttaactagactgcgtatggcatcttctcttatcaaattggatttggccaaaagaacaacagctgagcactgggaaagttattcttagtatgctcacaaaagagcaactcctcgccttcaaaatagtcctctgcatcatgagtacagatgcactctcctgcagagccaactgctcagacatccctatggtatcagtcagacgcctttggatccaagtgacaacaacccaaaagattaaaccatcaaacagacaacaacagcaactgctctctgggcccaggggaccttaatcattgggcttctgtaacctctaaaagagaggctcagaatgagtctcagagatcctctttccacggttcccatctaagcttctcttttaatgtcacctctcatctcttctaaggccacctgtggctccagttcctcactattaaccaccagagataaatgcagatcattctttttggttccaagcccaaaagttccagggaagggctcccatgagctcggctggggcaaggtgctgaattctggagtagttactgtcaccagaaggtggggcactatggttggtgacctctggaaaaatcaccaggatcacgcagcatcagaaaatggttccctttgcaactacaaggatcgagtatagagcaacacattttccggaagacaaggaggtagcattctggacacataaactaaggaatgtttacttcatactcctaaagagtggagaatagcagcatttttacatggttttacaataacgatgtgtagcaatttccactcccctccctcaccattagcaaagacccactctcttgctacataagtctctaagtaatttaaaagcctttgcattctctcttgaactaggttataaaccctgtgagaacaaaacaggtttttaattatgcttataactacctatgaggtacctgacgggatgctcatcgcataagaagagctaaacctagcacacatatgattgtgtttctatttgtagctcacacaatgatagtgcattttgtacccactttcagttccaacaaaaaaagcctttgaccatttctacctctaccatgacttttcctcccttaaataccacttttatattgagaattacatttcatccataaatgagtgacctcatatgaataaacacccatcatttcatggaatctgctgaacaaatgatcctgaatgcaactataatttaccttcagagagagcttttaaaaagctataaaagaattatatgaaaaggtacgtttcatagagaacatctgttttacccatgatcggtccttttaaatgatctctgaagtcaacttggtgctttggtctaagtcttgtgctcagatccctctatcacattaaaagagatgaagcaaaatctgagtctttttaaaaaactctgatggttttaacataaagtaaccttcgttgtttatttaacttcatatagtcaagcaggacacactgagcccctaagaagggacacgtgctggcagctggctttgtgaagtttaattaaaccgttgattttagcagagtcctagggagttaacacgtcacctatattggagtcttcatagaggaaatcatgctactggggagagagggaaatcagatacatgaagagaagtgaagagaagtgatcatggattaaccatcttcaaggaattgcgggtctcctggttactgcttggtgctgtcctgccactcccacactcctgactgcggtccatatctaccctggggattcgtccacccattggtgctgtcaactaaaggcaacagcctaacctgggagccacttcttcccacaaatccattttccttcgaatgtctcttttcttttcttttttttcaataatattaaatatattttcccatcattctaggctagaaaacttgaagtaaatctgaatttccttctcactgtttaggttgagtctccaaatgccattggatttttctctgcagtttttctcctattcattggtcccaagtttgatcctgttccttcagttcacatgaagtaaatcattttcccagtttactgtgtcaatgtctgccacttccaattccttacacaattattctcagatgagtctccctcatacacacacttgcacatgacactctcctgctcaaagctctcagtggtttcctgttgctttttaggggcagggaactaaacttaaagaaaagaaactctggtcctttctctctggtaccgccctatctccccagattctcctgccacacttgccaaactagcctattcagttttctccaaacgtatctctagctttatgacttagctccccaaatctccccagtacctgataacatggaacagaaaatgcctgaaacctggtacaaaataggcaggcaataaatgtctgtggaattaatgaaaacatacagacaaaacatttatttcctgatgtcttgcaaaactgtatcatagccacatttctcttcagatttgcatttaccataaatttttgcttgctatacaaaccagctatacaaagtttccctaaatttaaaaaaaaaaattccacatcctgacctatccaccccatagaccctgctcctccttttgagtttctagctcaactcatggtagcactatgttcgaatctgcttgtgaaaactagagacctcagaataatcctcagttccaagttctcctgcttatgattgaagagttatctgcattgccatgtaataacgacaataaaacaacaataacaaaccttacatctattgaggatctactaaattatgagttgtgttgtatctttgcccaactaaaattcataaattgaagttctagtgcccaataccttagaatgtggccctttttggacacagggccgtagtagatgtatttagttaagatgaggtcatactggagtagggtgggcccccaatccaatattactggctggagtccttctaaaaggagggaatttgggcccagatattgatatggtttggctttgtgtccccaccaaaatcttgtctcaaattgtaatccccataatccccatgtgtggagggcgggatgtggtgggaggtaattggatcatgggggtggtttctcccgtgctgttctcatgatagtgagtgaattctcacaagatttgatggttttataagtgtttgacagttcctccttcacacactctctcttgcctgccgccatgtaagacgtactggcttccctttctgccatgattgtaagtttcctgaagcctccccagccatgcagaactgtgagtccattaaacctcttttctttataaattacccagtttggggcagttctttatagcagtgtgagaacagactaatacacacatactcagggagaataccatgtgaaggctgggtgatattgccacagcccaggaactgccataagccagcagaggcctggaagagaccctttcctagagctttcagagggaatctggccctgccaacaccttgatctcagacttccagcatccagagctgtgagacaatcaatttctattgtttaaatcctttggaagcccttagaaactcatacaccaagcatcagccaatgtgctaaaatccttcgcaaacttagagttatttaatgctcacaatgactctgaagtcatctagagttagagattcatataattattatgccattatacagctgtgcaaacaaaggctggcttagaagttaagcacctagttcaaggtcactcagataagctcagctatttatcaatagcagagcaaaccaaaacatctgtgattagaaagcccaagttcatacacactaaactccaggcctctcctgatacatttccaagcagggacaatgttatacaggtgaccctcatacaattccagggcataatactgtagaatttccacttaagatattcccttaaggtgctctttggaaatagaaacttgaacataattcatttcattttaggtgagattgtgttcacaaaaagatatccaaggggaacttatttttatctaatttatcagatgtgacatttaaaataaaataactcataaacaaagctaacatgctccactgcacatttttactgtttcttttataatgcaaacatggtattacccttgttaaaagaaattaaaattgtagcatcacacagtgcacaaataacaaaaattacattctaaaaacatttcgttcacagtttatatttattcttaatatgtgtagagcaactgaatgaaaaaagcattcaacagccccgacattcctttgctatttcaaacagtggacttatgtaaactaataaacacagaatacaaccaccttttgtttaagcattaaccacaggcaaaaaagactccaagaaatgtgcccacatttcttggagtcttttttgcctgtggttaatgcttaaatatatatgtatatatatttcctaaggcaaagttgtgagttgtgagttttactaaattatgcctgtgtattggaagcaataatagaaccagcccagcccagagctggtctagagcaacagttctcagagtctcaaagtttggttcaggaaccccaggactgccttccaggaacccacaagatgaggacattttgcgtaattatagtaagccatgatctgccctttcaattttcttgacatttgcactgaagctgcaggagcactggtgggtaaaactggtgcttgagcatgaatccagccagtgacatcaactcgtacatatagtttcactgtcacaatctcaaaaaaaaaaaaaaaacaaagccagttccaattaagaatgtccttgatgtcgcagtaaaaatgattaattttatgaaatcttgatcctcaaatgcatgcctttttagtatttgggtgataaaatggaatacacataaagcccatctgtttccaatggttctctcccagaaaaacactaatgtgctgagttgtgaaatgaactagccactttttcatgggacatggttattcagtcttgggtatttgcaagtgtttttcttgaaaagggaaaaagcaagctcctcgctttatggaaatcaactaaccatatttgttaccaataacaaatatgataaagttcaagctttcatgcaaatatagaatgttggaaaacttacatccaacactttaagcttgacagtttcaataaaatactggcaaactgaatccagcagcacatcaaaaagcttatccaccatgatcaagtcggcttcatccctgggatgcaaggctggttcaacatacgcaaatcaataaacgtaatccagcatataaacagaaccagtgacaaaaaccacatgattatctcaatagatgcagaaaaggcctttgacaaaattcaacaacccttcatgctaaaaactctcaataaagtaggtactgatggacgtatctcaaaataataagagctatctatgacaaacccgcagccaatatcatactgaatgggcaaaaactggaagcattccctttgaaaactggcacaagacaaggatgccctctctcaccactcctattcaacatagtgttggaagttctggccagggcaatcaggcaggagaaggaaataaagggtattcaagtaggaaaagacgaagtcaaattgtccctgtttgcagatgacatgactatatatctagaaaaccccactgtctccgcccaaaatctccttaagctgataggcaacttcagcaaagtctcaggatacaaaatcaatgtgcaaaaatcacaagcattcttatacaccaataaaagacaaacaaagagccaaatcatgagtgaactcccattcacaattgcttcaaagagaataaaatacctacgaatccaccttacaagggacgtgaaggacctcttcaaggagaactacaaaccactgctcgatgaaataaaagaggatacaaacaaatggaagaacattccgtgttcatgggtaggaagaatcaatatcgtgaaaatggccatactgcccaaggtaatttatagattcaatgccatccccatcaagctaccaatgactttcttcacagaattggaaaaaactactttaaagtttgtatggaaccaaaaaagagcccgcattgccaagtcaatcctaagctaaaagaacaaagctggaggcatcacgctacctgacttcaaaatatactacaaggctacagtaaccaaaacagcatggtactggtaccaaaacagagatatagacaaatggaacagaacagagccctcagaaatactgctgcatatctacaactatctgatctttgacaaacctgacaaaaacaagaaatggggaaaggattccctatttaataaactgtgctgggaaaactgcctagccatatgtagaaagctgaaactggatcccttccttacactttatacaaaaattaattcaagatgcattaaagacttacgtgttagacctaaagccataaaaaccctagaagaaaacctaggcaataccattcaggacataggcatgggcaaggacttcatgtctgaaacaccaaaagcaatggcaacaaaagccaaaattgacaaatgggaactaattaaactaaagagcttctgcacagcaaaagaaactaccatcagagtgaacaggcaacctacagaatgggagaaaatttttgcaatctactcatctgacaagtactaatatccagaatctacaatgaactcaaacaaatttacaagaaaaaaacaagcaaccccatcaacaagtggttgaaggatatgaacagacacttctcaaaagaagacatttatgcagccaaaaaacacatgaaaaaatgctcaccatcactggccatcagagaaatgcaaatcaaaaccacaatgagataccatctcacaccagttagaatggtgatcattaaaaagtcaggaaacaacaggtgctggagaggatgtggagaaaaaggaacacttttacactgttggtgggactgtaaactagttcaaccattgtggaagtcagtgcggcaattcctcagtgatctagaactagaaataccatttgacccagccatcccattactgggtatatacccaaaagattataaaacatgctgctataaagacacatgcacacgtatgtttactgcggcactattcacaatagcaaagacttggaaccaacccaaatgtccaacaatgatagactggattaagaaaatgtggcacatatacaccatggaatactatgcagccataaaaaatgatgagttcatgtcctttgtagggacaaggatgaggctggaaaccatcattctcagcaaactatcgcaaggacaaaaaagcaaactctgcatgttctcactcataggtgggaattgaacaatgagaacacatggacacaggaaggggaacatcacacatgggggcctgttgtggcatggggggagtggggagggatagcattaggagatatacctaatgttaaatgacgagttaatgggcgcagcacaccaacatggcacgtgtatacatatgtaacaaacctgcacgttgtgcacatgtaccctaaaacttaaagtataataaaaaaaagaaagtttctcagtacttaaagactttctgatgtgatcattaataatattaatgaatatgactttaaaatacattgtataatgaactgtgtcaacatttagaagatctgcaagaaagtcagcccagtatgtgccaacatcacagatgttcataaaagacaaatttacaacattcaaggtccattcaaggatttgaagttacacagtacaaaaaagttcattgctatatttttaaattccatatttcaactaacctttaaggaactaaaacttgtagagttttggtatagtatcaaataataaccacaattgtctaaaaagctttgaaaatatttctcccttttccaactttgcatctgtgtgtagccagatcttcttgatatacttctaacaaaacgtattaccacagacagaatacagagacagatatgagaatgcagctgtcttccacagagctggtcattaaagacatttgcaaaattataaaataatgttattcttcttatattggaaaacatagtcattttaaataaaatatttacatcaatacataaatggtttatgatcataactctaaatgaatacttaaaggagatattaaattaagcatttaaacatttttaaattttaatattaaatacagtaaatattaagagatgtaactcatagtaaaaagctctttgagggcttccataatttttaagagtgtaagggaggtcaggaggcaaaaaaggtcaagaacctctatcttagagagtttggacaggaggagtggggtgactaagctatgaaccaacatattcacgagttcggattttatcctaggatgcaaaaatctattccacccaccattgtctaacaaatttccatatctttagttattttcacctcaaaaaagtgacaagacaaaatgaaaataccatcatcctaatgttaaagtaaaaattagcaccttcaatattgggctaatagagtacaacaggggtgagcacagccctgaaatgtcctatgtcctgtttctctgctttctcttaatgacatcacatttcaaagttagtaaattgtacataaggaaccatgccagtgtaactgcacctagacattaaaactttacgccctatgaaaacgatgacaatttttaagtgacaacaaaatcctcaggaaataaatggctgtcttttatttagttgtttcttttttcttttgagacagggtcttgctctgtcacccaggctggaggcacaatcacagctcactgcaacctcagactccagggttcaagtgttcctcccacctcagccccctgagtaactgggactacaggtatgcaccaccatgctgggccattttatgtattttttgtagagatggggacttgctatgttgctcaggctggtcttgaactcctggcctcaagtgatcctcccaccttggcctcccaaagttctggaattacaggtgtgagccactgctcccagccatcttttgttttataacaatgctaaagcttaggagtgaatgtattaatctgaagagtaaaattccttttctcccaaaccctttctattttgcttttaaaatgcctaaatcattggattttctctcatttagttatgtctctcattgagctagttctattacttctatgatcttggtttctgatgactgcatctacaaacatgtttcctaagaatttaaatggttcatgcactgcctgtatagaaatgcacagtcagtatagaaatgtggcgtgtagcacgggctatagctacaatcccagactccaccattcacagtcttgggatgctgagcaagttacatatgtcggtttgccccagtttccttagatacaaaatgggagtagtgatagtacctcagagggtttttgtaagaattaaaatgatttatacttggtaaacactttagaacaatgcgtaatgattggtggtgaattattattattataatatagctggtaaatatatttacttgggtcacctttttattccactgtatagaaacccttgtggtacaaacacataaatgctcactctggatatgagttacacagaagctatttggagaactattttattagataataaaatgatagtgacgcatatcagtcacctctttaggctaccttcccactcacctctcttcttaactttagtgaggatctgttttgttttcctagctgttctttggttttggactggcttttcttcacggtttggtctaaatttaccacttcgatgtcccacttgtggaggtttagctaccatttgtgtatctgtcataggcaagcatatgtcaaactctttggtatatactctctcaacaagctgagacctcgttactgccatcgccttttaccagaagaaacaaactcttagaagagtctcacccaaggttacaaagctcaaagtagcagagtcaagagaggagtggagctcttgactcccaatttcacatgcatcaaggaggcaggcttgcatgaggtacacccaaggagcagcagcctctcccgttcccacctctcacaggccctctgagggtgtttctattctatcgctcatcaccttgacagaaacctctggagaagctatggtcatctactagcaggatctgtgggtcgtctaaggtagaaacatgtagaatggccatgttattcctcccctccgtgaaactttcctgccaaggtgtgtctgatttttgctgagtgtgttcccaggctaaggatgctgagaacaagtgcaaaaccataacaggatgctgggagcctgggccagccacaaagaaggccttgacatttgcagatctgaagtcttggaccttcagactgctcggatccttaaataaccaggggctggtaagggagatctggcaaaggcaggtagcaccagtgtgcctcagtgctctgatatgccatgtagaaacacggccacttatgtgtgctaattgatgggcatgaaacatacatgtgaatacattacacatgatcctctcaaaagaaatgggcagctttcagggctattgtattcatttatatacatttaggtttgaagatcataagagcctctgggggtgcagggactccatttcaggagagacttctaagttgcccacatccatgacaccatcaatcctgtggttaaccctcagatcccttccatggggaacggataggatttcctgctcttaggaaaagagaccaggtttggtctccagcagaaacagctaggagagtggcctggagaagggaatgaggataagaaccaacccctcctccactgaaaaacagggtaggcagaggacacccaagggaacttcacagcctggaaggtccaagcaaaggaaactattctggtggccctctggtcctcaatgggcctggtcaccccagaaatgcctatcactcaggcctttgcaatccctcaagtcgggtccagcttccttgtcagggctccttgtcccccagatgttctgccatctccacctcctagtgtgaataacaggcctggggccccagtgactacagatccgaagtccttcccaccctccccacacacagttcccagatttagcaagtaatacaggacacccagttaaatttgcattttagacaaacaacttttttttttttttaagtgaaagtatgttccaggcaatatttggaacttatatacttatactaaaaatttacccgttgtttatctgaagttcaaatgtggctggacatcttgtattttatctggctaccttagaccctctccatgacgagctaagccactactcttttgagcacccccagcctccactcccatcccctcaagggtgccgccttttggaaacaggaagtagaaagggaagatgtcttcagaacacgggcctgcagcacaaccttctcctgggatcagagggcacaatctgacactgatggggaagatactgatggggaagaaaacaaaacagaatgaaacaagaactggtatctcagtgtgtggtctccccttctgctttcttttttgagacggagtctgggctgttgcatgggctgggctgggctgggctggagtgcagtggccctatctcggctcattgcaacctccacctctggggttcaagcaattctcctatgtcagcctcccaagtagctgggattacaggcacctgccaccatgcccagctaatttttttgtatttttagtagagatagggtttcactatgttggccaggctggtctcggactcctgacctcgtgagttgcccgcctctgcctcccaaagtgctgggattacagtcatgagccaccgcgcccggcccccatctgctttcttactctagggtccagcagacaggaaacatctggaatgccctcagctggagtcactgaaatgaactagggaaaaaacaaaggagattccaacgtgtgtgtgtgattccaacactatgtggcagggtgtgccatgaaggaactgtatcatgttttagacttaagacgaacaaccacacatagtgcgtttttggagaacttcatcaagctttacaatctttcttgttgtttctctccaatgacccccaaaatatcaaacattattttcttcccctgaagtttcattgttgagagagaagaaattacattttaaaattcgtattcttcactcagcattgcaatataaggacggtttgcaagcagacagggaatgggtgaaaacatattttgtgttttaatcttaagacatacatttttatactaaagtcacatactacatttcgatcacaagcacagaaattctgttcttttttgccccctcccaccctgggggaaaaatagattcaaatttttggagacttaattgccctaaactttcatctttatgatggaaatgacatttttcctggaagatggaacttggcccttcactgctccatgactttctcggactgagttgtgtccttgaggaagagggagtgggtaaactggaggagggtgggggtcctgagaaggaatgtgggcaactgggagttggatccttggcacaccatgagctggagctgagaggtaactgtcgaatcagaaacctgtaccaaatttgctttccttgacttgtgcttctggctttttcttcgtaattaattgatatctgccctctttgcttttgaatacaattcttcccctaaggttggctcttcccatcagtactgagaggaaggaaagaagggaagcgggcttgtgtttttcagagtaagtggtgctctctgggcagctgagaatgacagccactcccaatcaggaagaccgcggggacagggagagatccagggaatcagaggggatgttcctccagagtcttgcacacctggagacagctcttaccggggagtcctcttagctgaagtctcggagggatgtgtcatctttcaacataggaagttattctcctttatcccccagtctgttccttgtgctacttccttacaaggggccacagaagagagaaaaggggtgatgccaaaggaacgcaacaaacccggtaaatgccgcatgtgggattaagaattgagcacctcagtttaggtgtggtttagagaaaggcagtgaagagaaaaagatgccttccccaggtctccagtgatgcttcacctgctctccactgtcaggtaatggagaagaaaccatgctgaggagtcacaggacaatttcaagatgtgaccatggcttcccagctctgagaagctgcctctgactgatgatagcagctggcaggaaaatgatctcctgggcaaatagaggatgtaaataaatgttcagcatatgccactttggttatgaggcaatgcctggtaggtttcacaatgtagagggaagttaggaggaggaggaccatttcagataccctttctcctccaagaaacctcgcgtccttcctcctttttgcctactgccccagagttatcccagagtgttcagacccacaggcatagccagactttgagccctgggttaacttgctgtcttaatcagtcactcctcagcacatggtgcctcctatatgtaatgtaatgttccaagtatgtcttttctccttaagactgtgaacataatcaagccacgggttgcctcagaaacttcctttctcttccactcaacacttagtccagtacctggcatttggcagcttctcgaaaatacagctaaactgaattctagcttggtgtttgagatataaattcagtctctgatgagaaaaagacaatgctcttgaccttaggaaaaagttaattcctaattattcatttctgtcagtacaggttgctcatggaactcacaaggggcagcctaacacggtagttatgctatggtttctgcacgcagatggccttgttgaattcagacctcctcacactttctctatggccctgggtaagtcacccattggctttggcctcagtttcctccttctataaaacatagatgatactattactcctttcactgggttgctgaggccttagtgatgtaatggatgcaaactgctgaagcggatgcctggcacagacttcaccttcaatgaatgtaggccatcagtatttatctgctgaccataatgacctgatcactattccttcttcattcaggaagagctccaagacatagatttctcctggtgctttttgattccatgaggaggaagtatgtggtaatgggaaaccaacccagctgtttccactttgttcagtagccttgattagttactgagggtatcttgaatctcagtcttcattctaaaatgaagataacgttgatatggtttggctgtgtccccacccaaatctcatcttgaattgtagctcccataattcccacatgttgtgggagggacctggtgggagataactgaatcatgggggcggtttcccccatactgttctcatgatagtgaataagtctcaggagatctgatggttttataaggaaaaacccctttcgcttggttctcattctctctcttgcctgccgccatgtaagaggtggctttcaccttccaccgtgattgtgaggcctccccagccacgtggaactgtgagtccattaaatctctttttctttataaattacccagtcttgagtatgtctttatcagcagcatgaagggtatgtctttatcagcagcatgaaaacagactaatacaaatgctatctgacttattggttgttgaggattaatactgtattaaaatactttgtgaaatgttgcacaaaccgtttcattattttttatttggccttttgtatacataaatgcattacacacggacacaccacacacacacacacacacactctttctctctctcttttgtatacattaatgtattacacacaggcacaccacacacacttacacacacacacaaactctctctcccccatgcataacactacttcctccctcaatggtgctcagcaatgcatttcattcctagatgtatccaggtttttgcagacctgaaacttgtataataatttttggtccctctaaaaaatataaaactacaaatataaaatcaggttttgttttttattaaactgagatcagggacaaggaacagtggtgggagggattttgttccttgcaagaaaggggccaggggtttccactctcagtctagccacgtggcagcccacttggttataccacccttttcttccaaccaccttgtcctgacacaactgtgctctcggcagagagtctgtttcttcctggccactgtgctcagagttcagtcagcttcttttcctccttttccaacatgttttgtgcatccacctgttctctccatctgctgggaatctccacgtgtttcccactagtctaagctcaatgcggaaaagaaccgagtttaagaagcacgttatcccaagttccttgcagcatggagggtttatgtgcttccttgcttgcttgcttgcttgctgaatgaatgcatctcggcattgcatccactgagccaccaggcagcagtctgagaaatgcctgtggtcactgcgcttgcatctcccagtcaccactctcactgccttgctcccttcagaggtggtgtcttaccaggtgctaatgtagctcttactacacacaaaacattgttctgagcgcctttcaaatacaaactcctttcatcttaagcaccacccgacagggcaggtactattaccatctccgtttgacagatgaggaacctggcacaggaagcatttaagtggattccccaggatcgccccactgtcaggagcagagtcagaatgggcctcagcatcaggctcccaatcctggcttctaactgctgcgctctgcccttctctctccccacctccccactccagtgcctttggtcatgccactgcagctttcaggccaatactggattagcctcttagtgttcttgtccctgcagccatttccccaggcagcaattccatgtgccctcactgatgtaggtggctcttgtgtcatttgtcacatcctattgaattgtttatgcatcttgttcacactcacagcaccctccctctcacacgtcctccttataaaaatgtccctcagtgtctgctatgagccaggtgcagacttaagtgacagggctgctacgggaaataaaaaattaacaaggagcacctgcctcttaatgcacagtaacaaactatgttaagtgtcaggaaggaaaggttaaggatgccaggaaggcttttaataaataacctgacttagatgggcaggtggtgctgaggattcagaacgtgttcttctcgagcgcatctgagagatgagtagggttggccaagtgagaaacatgggagaatgtcctaggcagagggatggcccccgaggaaggccttgcagtggaaacaagtttggcccattaaaaggtattgcacggaggtctatacaaatggcttaccatatgcaagagaaacagtgatgggacatgagggtaggcactagacccatcccaggtcttaagagagtttttgaagactttatacttgttcttaaatgtaacaggaagacagtgaagaatgtgagcaggggagtagcactctgatttccataaatgaaggatttatattctctttgctgtgagaagaactgattagaagaaagcaagactgaaagtgcggagaagccagttaggaggctctgacaatagaagaggcaagagatgatgctggcttaggatgtgcgtgtggaggtgcaggctgaagataaacagattcatgatatattttggggggatgtttgaaaatacagttgttcttaagtatttgccatgtgaattaaagattggtctatttgcttcacttatcccttctttctttgcaacaaattaaaagttgcaagctgcttccatcaaggctgttagaacatcttttgggacaacttaggaaaacaggctccaggagctatcatggggtggatccgaggatgtctgcttttctatagccattttcagttgaaaagatactgaaatcatcttatcatccattcaactaagagtcaagttatttgtcattctgttgccttggaaacaaaaagacttttgctttcttgatctgctgttttttcaaaacttacaggttgaccttggggactgttatgcaaggcccaactatctttaaactttatggatgtgcttttatccacacatatgcataggaatgtctgatgctttgatctttcaccatgttgttgagtcaagatgccaaaatgcctcaaaggtttggcttgcactgcgtccaaatgaaaaggcagagagaatgaagtgtgatcttaaattcatacaattcagtgtgctgtccttagtgacaactccctcattctgcctcaaaacagaggactgacacctctgctcgcactgtgcttcctttttgtgtgtccctgcgggagcatgctcatggtctcagtgcagggttcctctccacaacctggggttgttaccaacatcctaggggtgcaggttgaagggacctctgtctttcagagtggccccctgaggtggccatgggcttagttaaatgaggctactttgctcaaagtgtgatcccaaagcctttttttttttctgaattaccttcagagtcatttatcagtctctaagaacaagttagttttactgctatagtaattctttccacatcccatacccagaaatgtttccatcccttctttctctgctcctgaatcagtgatcaagtgagggtagatcaggctatgcctgtgagataatatccaaaccacaaaggtagagtagtgtgtgtgtgtgtgtgtgtgtgtgtgtgtgtgtgtgtgtacacaagggaatcgtcacagggcgcaatacacaggggcactaggggaagcaacctggtaggaggaagccttctattctcagcaggagacagcaaggcaaggcctgctttggagacttcttgtaaaaatatgacaggggccaaggggctgaagaaagtttcgcttgctgaacaatgcctatattttaaaataacctctcactagtaataatttgtatcatattatctcagtatctaaagggatcatcttatgctcattttaactggggctcatgaaacaattttctataagaaaaacttggtttcataagaaaatattagtctaatgatgaaaaaagtatcaattatagaagattttcaagacaaacgaaacttattacttttaagggcaaacatgcattatattagactcatagtgctgcctgttaaaagtcctgctttagttactgcataattattgattgttatgggctgaatgttggtgtccctgctcaaattcattgttgaaatcctaattcctaaggggatggtgtgagaagatgaggactttgggaggtgattaggttatgagagtagaccactcatgaaggtagacagtgcccttataaaacagatccgagagagttagccattctctttccaccatgtgaggacacagcaaagactgctgtccctgagccagtacactggccctcaccacacaacgaacgtgctgctgtcttgctctcagacttcccagcctccagaactgtgaaaaataaatttatcttgtttgtaaggcacccagtttgtggcattttgttacagcagcccaactgggctgggacagtgttttaaattgtatgcctaagtatggtcagcctctgcttagattataattacttttttttttttttaaagcaagctatctattcaatttgcaaacaggctcttaatgtatcacatagtgatttagaaacaaggccagcaaactttctctgtaaataactggatagtaaatattttaggctttggaaacagtctctcacaactagccagctctgctgttacagtgctgcaaaagcagccatagaataacaaatagcatggcaataaaactttatttacaaaaaaaacaacaacaaccaaaaacacaggttgtgggccagatttgtccagcagtctgtagcttgccaatcctgatttggggaaagtagtgggttcacttcccctaacgttccactaatcacaaactcaaaattagtgatgaactacacaaaacttgaagtctattaattgtttaaatgtgttttggtttgattttttatttttaaacataaacttaccttcgttcagggcaaaagtaatcagaagcaatgaatactgatgcaaatccagacaacatttttaatggcttggacctttccattcagatgtaccacagtctatctgtattagtcctttctcatactgctataaagaactacctgagactgggtaatttataaaaaagaggtttactcagctcacagttccacagagtatacagaaagcatggctggggaggcctcggcagaaggcgaaggggaagcaggcacgtcttacatggtaggagcacgaggaagagggcaaaggggaacgtggcacacacttttaaacaaccaggtcttgtgaaaactcactcactgtcatgagaacagcaagggggaaatcaaacttcgtgatccaatcacctctcaccagtcctgtcttccaacattggggattcgaatttgacatgagatttgggcagggacacaaattgaaaccatatcatcagcacccgcacagagttctcaatggggcactgcctagtggagctgtgaaaagagggccactgtcctccagaccccagaatggtagatccactgatagcttgcactgtgcacctggaaaagtcacaggcactcaacgccagcccatgaaagcagctgagggggctgtaccctgcagagccacaggggcagagctccccaaggctttgggagcccaccccttgtatcagtgtggcctgcatgtgagacatggagtcaaaggagattattttggagttttaagatttaatgcctcccctgctgggttgtaaacttgaatggagcctgtagcccttttgtttagactgatttctcccttttgaaacaggtgtatttacccaacagctgtacctgcactggatcttggaagtaactaacttggttctgatttttcaggctcatccatggaaaggacttgcattgtctcagatgagactctggactgaggacttttgcgtaaatactgaaatgagttaagacttgggggactgttgagaagggatgattgtattttgctatgtgagaaggacatgagatttgggaggggtcggggcagaatgatatcgtttggatttgtgtcgttgctcaaaatcttgtgtcaaattgtaattcacagtgttggaggaggggcttgctgggaggtgattggatcatgggggcagatttcccccctgcttctctagtgataatcattgagttctcatgtgtggcaccttcccctttgccctcttccttcttttcctgccatgtaagatgtgcctgcttcccctctgccttctgccattattgtaagtttcctggggcctccccagccctgcttcctatacagcctgcagaactgtgagccaattaaacctctttgctttataagttactctatctcaggtagtttttttttgtttgtttgttttagcaatgacagaatggactaatatactatctacatatgtctttattatttaacaagtatttggtcccttccaatgggctaggtcctgggctaggcagtggctagggagaaataaataaaaacagcctctcacagagttcctgctcatggggtctgacagcttttagtgtgttgttcattacatcctcagtgctgtgcacaggcctggcacctagtaggtgttccaaaaaatccttgttgactgagagaactgccatatcctatttgacacaattaaagtgagcccttatcttcccctcaaacttagtttctccctctgccttcatcacttctatttataactctgttctctaaggtctaaaaccccaaagtcatcttttgcgacagctcacagatctatcccttcactccatcctacacgttaaaatcactgtaatcttcctgcaactcagctctgattctgtcaatcctcattcataacacctggggagttgtcctttaccttcaaaaacaaaggccatgctgtttctcaacatggaaacaccccgaggacccggatttaccgacctctcctctttctctgcctttccccagcggcatctcagtagatgcctctctcatgttcctcctccctgtgagacattcaccctcacacactccccaagcactctcacctcacacacacatacactctcacatacacactccccatacaccctcaccccacatgcactcacagtcccatgtgcccttaacccacacgtacttacactcatacactcactctccatgcaccctcacctcacacgcaatacactcacacacactccccatacaccctcaccccacatgcactcacactccctatgcaccctcaacccacacatacacacactctcacactctctccatgcaccctcaccccacacacacaatacactcacacacacactcttaccccacaggcactcacgctccccatgcaccctcaacccacacatacatacactctcacactctctccatgcaccctcacctcacatgcacatacactgtcacactctctccatgaacccttacctcacaggcacactctcacacactccccatacaccctcaccccacatgccctcacacttcccatgcaccctcaacccacacatacataaactctcacactcactccatgcaccctcacctcacatgcacatacactctcatacccactcaccctcaccccacatgccctcacactccccatacaccctcaacccacatgtacatatactctaacattctctccatgcaccctcacctcacatgcacatacactctcatacccactcaccctcaccccacattccctcacactccccatacaccctcaacccacatgtacatatgctctcacactctctccatgcaccctcatcccacacatacactcacacacacactctcaccccacaggcactcacactccccatgcaccctcaacccacacatacatactctcacacactccctccccatgcaccctcaccccacatgcactcacactcccgatataccctcaactcatgtacatatgctctcacacactcactctccatgcaccctcaccacacactccccatgcaccctcacctcacatgcccatatgctcacacactcactctccatgcaccctcacctcacacacacacacacacacacactccccatacaccctcagcccacactcacacacactccccatacaccctcaccccacacactcccccttcccactcacacactccccatacacacgcccacacacactccacatacatcctcgccccccacacacactcacacacactccctatatacacctcccacacacacccacacactacccatatatgcaccccacacacacactcaccatacaccttcaccccacacacacactcacacacacttgccatacacccttaccccatacattcataaacactccccatacacacaccccacacgcacacacacaaactccccatacatcctctcccccaccacacacacactccccatacaccgtcatcccccacactccccatactcaccccacatacacactcacacactccccatacagcctcaccccacactcacacacactcctcatacatcctctccccctacccccccaacacacatactccctgtattagtctgttttcatgctgctgataaagacatacccaagactgggaagaaaaaggggtttaatcggacttacagttccacatggctggggaggcctcagaatcatggcgggaggcgaaaggcagttcttacatggcagcggcaagagaaaatgaagaagcaaaagcagaaacccctgataagcccattagatctcatgagacttattcactatcacgagaataggatgggaaagaccggcccccatgattcaattaccttcccctgggtccctctcacaacatgtgggaattctgggagatacaattcaagctgagatttgggtggggacacagccaaaccatatcactccccatacaccaccatcccacatgcacactcacacacactccccatataccctcaccctcacctcccacagccttaaacattcacacccaccccgtgctctcacagaaacatgctcttacacagtctttcacacacactcaaagccagccatacgtccctggacaacttgtccttttcacatatctgtatattttctaaatgagattttgcttgtggcattttacccttccagaatacttttatctccatttcaaaacaccattaaaatcaattcaaactgcacttcctccgtggagaattaggggcctggagaatgcctgtggtttgcagctcctttggccctgagcacatccattggagcaggtcagaatctgaacattactcctctttggtgcagaaaggtgactttgtttttctctctaaactcctgtttgttccagagcttctgtgtgtttggactgacactttccctcaaccccttcagaacccagtgacattccagttagagttgacttgtacagataggtctgcttttcaactccgtcacaagaagagttgttgttcagatttcttcctgtccctcctcctcctccctgagcaggatttggggcagcagcaggaaacagggctaggatcttacaggcctgtgcaggctccccagcctcagtacggctgctcagggtgctcagggacaaggtttttccaaggctcagtgacaagctttgcactttctctgacttccagtcccgagatcctcttccaagtccccgacactctgggcccttcttcagagacctgtgggaacaactggaattcctgcctgtgaggtgcagtggaagggaagtggaggcattcctgagccccatttcacctgctgcctttctcctcaaccgtgttggtgttggtgacctggcaggatgggtcttcccggaatcctgggcatagagcagccatgtattagtatgttctcacactgcacttcctccgtggagaattaggggcctggagaatcctgtggtttgcagctgaaatagctgcaactgggtaattgcaaactgggtaatttgcaaccggtaattgcaaagaaatagctgaaactgggtaatttataaagaaaagaggtttaattggcttatggttccgcaggctgtacaggaagcatggctaagaggcctcaggaaacttacactcatggcagaacgttaaggggaagcaggaacgtcttacatggcaggagcaagaggaagagcgagcaaatggggaagtgccacacacgattaaacaaccagatctcgtgagaactcactcactatcactagaacagcaagggggaaatccacccccaagatccaatcatctcccaccaagcccctcctccaacattgggaattacaatttgacatgagatttaggtggggacacagagtcaaaccatatcaagccaccagcccctttctgggacctctgatagcttggtacctatccaacctggctcaatcttaggaggtagggtctgcggataccttcctagggtctcacacagcagctcaactgtggactagtcccctatgaatttcctgactttctgattcctgcttgatcatttctcgttctttcctaaagtctggaaatgtgctctgtgttatatctggattcctgtctgctcccaagtcagactcaaagctatgttttggggaccctaaaagtcttcttcccctagagacagggtctcactctgtcacccaggctggagtgcagcggcatgatcagagctcactgcagcctctacctccagggatcaggcaatcctatccccctgcctcagtctcctaagtagctgggaccacaagcatgcacaccacgatgcctagctaatttattattattactactatttgtagagatgggggtctctctttattgcccaggctggtcttgaactcctaggctcaagggatccttctgcctcagcctccaagattgctgggattactggcataggccactgcacctggcccagactggctttttaaaatcaaagaatcttgcattcctaccaaaatttggctaaccatttaaaaatttctgtttgaacctcaaagctgagcaatgagctctgactcctggctcccactacccctgaagaaatgaatgtcttagctgcaatggggacatgatttggggaggtatggggtagccaggggtggctggtagggtggccagggaaaatagagagtgcccagttattgttgaatttcagctaaataatgcataaagtttttttagaataagtatgttccaaatattgcaagaaacatactatactaaaaacttttaattgtttatttaaaattcaattataactgggtatcaagtcttttaatttgctatcaaaaataatcattaattataaattcccagtttttttaaattaagctatgctagcaatgagaactttaaagaaaaacaggaaaccctagtagcagagggttcaccaggaatgaaatccatcagtttagagttttcaaaactatgatcctctccatactaccttgtactagaaagagtggagcagttaaaggggtaatttaatatggcaactgatgtaatgctgagcacagtttttgccatcattttattagtttaaaggtgatacagtcttagagagagtgaagatctcaaattcttttatactccacatctgaacaatattgaaataatgtataaacaattctgtactgttgattccattgttttgtcccatttctctaacttttgccagtaaaaactgacttcacagcactttttattttagagttttatttgttcacacaacctagtacaataactgggaaattgtaaatgatgtcatttaatttaaggtaaattaacatataaatatatgtggatagatgtttatgttaaacacaaaactgagggatcaatttggtttttgtagctgggtaatgaaaatatacaacttttcaacttttcctgttaataattctgagagctaattaactttgtagaacatgttagacttttgttatgaaaaactccatttttcagtgtttcatttcagtgccatagtcatgggtctgcaggctttaccctacctatggaagtggatggctacaattctttatcttctttggttggtcctacatagtaagcttgataaagagtttgacttttatgaaaatataaataacattgttttggaatactctgatgtcttatcaccagtagatagaaatcaatttcatataataccctgagcagtgactaaaaaggacaacttttggccattaccaacctggattaaaatgcctgttgagaccaagaggaaaagagcatttatcctgttaattatgatttctttcacaatacattttattaacaaggtttctaaatgttaatctgattccagacctaaataaaaggctacagctaagaaaaaacaaaaacaaaaaatctaaactatcactggagcttataattagggtaaatcaggactaacacacaccatttattgaacaattactagccgccaggtatattctaaacactttgttatttatttgtttgttttttgagacagagtctccctctgttccccaggctggagtgtagtggtgtgatcttggctcactgcaacctctgcctcccaggttcaaacaattctcgtgcctcagcctcccgagtagctgggactataggcgcctgccaccacacctggctaatctaagcactttagatgtatcatctcttttaatcttttgggggctccgtgaggtaggtactcttatccactattttttattattattattattattattattattattattattatactttaagttttagggtacatgtgcacaatgtgcaggtttgttacatatgtatacatgtgccatgttggtgtgctgcacccattaactcgtcatttagcattaggtatatcttccaatgctatccctcccccttccccccaccccacaacagtccccggagtgtgatgttccccttcctgtgtccatgtgttcccattgttcaattcccgcctatgagtgagaacatgcagtgtttggttttttgtccttgcgatgtttactaagaatgatgatttccagtttcatccatgtccctacaaaggacatgaactcatcattttttatggctgcatagtattccatggtgtatatgtgccacattttcttaatccagtctatcgttgttggacatttgggttggttccaagtctttgctattgtgaatagtgccagaatctacaatgaactcaaacaaatttacaagaaaaaaacaaacaaccccatcaaaaagtgggccaaggatatgaacagacacttctcaaaagaagacatttatgcagccaaaaaacacttgaaaaaatgctcatcatcactggccatcagagaaatgcaaatcaaaaccacaatgaggtaccatctcacaccagttagaatggcgatcattaatatccactattattttatccgcatcttacaggttaagaaactgaggctcaatgagatttgttaccgagcccagggtcacacagctagttagtggaaaactaggatttgaactcagtcttaccctagataccatcattttaactgccatacaccatatactatgtcctctcctcactgataacagcattttggtggctatggcagcatagttagctgaacaaataatactttaatgcccagaaaacacactgaggtcagtgcattcttgcatgatttctaaatatcacttcttcccattttgctttttctctataataaactcccaattatccactgttttgaatgctgaatatcttataaacctttaggtgtcccactatggtactttgtccactgaaagtatatttcttgtgttaattataagtacttttcaatgatttttatattttgattggttcctttgagtaaagagagtatctttcagggaaagtattttccagttacaaacatgattatttctttaattcaaatactatttttttttataattgatataggtaatgcagtctttgaaagccttgatccttaacctgaggttcgtaggtccacagacaggattctctcatgctcaagtaaccctaaaattaaatgcagaattctacaagtatggatctatgcaaagatggaaatgtgaagatgcccagagcttccatcagatgtctgaaagggtgcagggcttcaaatgtagcaccacatggatcacggtactaaaatagtatctggatttttatgcttctttgtagtggagcccctgccatgctgagcagagttccagagttaggtgttgaaccatgtccttgccctcctgccaatgagcatgtgtggcatgctcagaggtgctcagggaaccctcagtccctctggtgaagtacaggactgagctgcattctactgactttggtagactcaaggaatctgaattctttctttatgaacccaaaagaaactccagtacacggaaccaccaccttccctctgtccatcactccctcattctctggctctccccaccaggctagacccaaagtcccctgctatcatcccttcttcctgtccctccatggtgttcaccaggcaacctcagaggaggcctgactcactgcctcctttgtcccaggtcctgaacgtgaccaaagacaaacatcaagccatgctgaaggttgtcctctgaatttacaaccactcccttcaagtgggcactcagccctgtgtggcaggcagttccacctccctctccagtccatgccccctcccacgtacaggatgggcaccccaatcctaaccctcaatccttagctcttaggcccctcctcatgctcaagcaagaacctgatttcttttctcagtgagaaaacaaaaagtcaccctctcctcaccagatccttcaacccaactggatttgttctcatctactgtgcctttgcttttgtgaaaatgtagacaaatcgtcccctttccctttgacaccactaaatccattccttttcccataggtaagatccttccttacaacgatgccctctttcttccgccccaccaagttttatccttcttcggtggcattcccacctgcataaaaacatgctgtaaaagctcttatctgaaatagaacaaagcaaacagtcacaacacatgcaaccactctaggtgctgccccatttttctctctctaacccacccctagaaaaaacatatagaaatgtctataataataataatatatatattaataatgagagaacatacttatataatgtcaggcactgttttaagcatgctgtatatttaactcaaattactctacacagcaattgttaacagagggctgttattatcctcattttactcttgagcaaactgagccacaaactcacttctatggctttccctgaccacctcatgtaaagtggcacacctctcattcccaatctccttaccttgcctcattttctgtagaaccttctatctacttaagattgtgtttatttgttgcatgtctctttcttctgactactagataagcttcaacagaacagaaactgtgcctgttttccaatacctggaacagagccaagcccatggtttatactcaataagtatttgttgaataaagaaggttaaagacctacacaataattttgtgtaaaattagagagttttaagaatatgtaaaataaatatttataaattaaaatgtctattcaacggatatcctatttaaaatcatcctgtgaagtcatttgcaaagtttttgtgtgtgacaaaccacagaagtctatagtgtctttatttatttattcgtttatttttatttatttatttttgagacagagtctcactctgtcgcccaggctagagtgcaatggcacaatctcagatcaccacaacttctgcctcttctgttcaagcgatcctcctgccttagcctcccaagcagctgggattacaggctcctgccaccacacctggctaatttttaaatttttagtagagacagggtttcaccatgttggccacgctggtctcgaactcctgaccttaggtgatccaccagcctcggcctcccaaagtgctgggattacaggcgtgagccactgtgcatggcctgaagaagtctacagttatctgtattttttcatgtatttgtttttttggattttcttcagctgatgatcagaatattttagcctgtcatattttagtgtgaaatgcataacgtgtttcctgtttccatgaagttgtcaggcccgctttggcaggctcacaaatggacactgcatatacacaggcactgagctgaactctgagaacactaatcacatttgaaatggaaacgacacccagcggttctgaccattctgcacggagtttacattccagttcattagtcataggcactgctcaattgcattcaactggcatagttcacttacaacacaggtaaatatcaaaaggaaattaaatcgatgctcaaatacaatattttgtgtaactctcttttttctttagtttctgtaaatgtggttggcaggttttgacaggaaaaaagttgttcttcataaacattaatatatttcactttcactcacataagtaaagttgcttcagttttttttctccactaggtttcttgtttatctaaacactggtgtcctcagacaaaccagctactatgtcatggtttaaaaaatcctctgtgggtgagaaaatagtacagcataccaaacacccaatcagctgaagaactgaaaaggaaaaagtattgtattagtccattttcatgctgctgataaagacatacccgagactaggaaatttacaagagaaagagattaattggacttacagttccacatggctgggtgggggcctcacaaccatggtggaaggcaaggaagagcaagtcacatcttacgtggatggcaagaggcaaagagggagcttgtgcgtagaaactcccattttaaaaaccatcagatcccattcactatcatgagaacagcatgggaaagacccgcccccatgattcaatcatctcccaccggatccctcccacaacacgtgggaggtatgtgagctataagatgagatttaggtggggacacaaagccaaacatatcaagtatcttaaagcaaatttctaaaataggccctggttaatcttagaaaattaggaaagtgacaccaattcctacgattaaagaaacagaatttaacatagctttacacaatctattttttgaatttgataaacatcaagatgtttttaaaatgttatgcaataaataatattttctaagttgaaaatgtatgcatatgaccttttttctcaaataaatgcagagctaaataacacattctaaagaccagttttatcatctttctactgttcgtaacataaaactgaaatggtaatggatctaccaccaagcaaaagagaattaaaacagtttaagtgatcgggaaaattgacataaaaatggataatgttttatacaacagtgagtttctacatatgtgtgttgcaacattaaaaaggaatttgattttccatttttgtcacttgcagatattgtgttgataataagattattacgtcaaatcaacattatactgtgttctccaccatgcatgctgggccctgctctgggatcacctccatgatttgcttggttgatggtggtaactggacaaggttggaaggtttaaacagtagccaccaagccagggacaaatagctgtgacttactgccaaccttacaaccttctccatcatgcctgcacatattgctatttaagaaagccctgtaatagctgcaaaagtcatccttatcaacccaaggcatcttgagaatgatgtattaaaaatgtgaagtagggattgtgagaagttcataaaagatggaaagtaatacagctgcaagagaaagatgggaaacttgtgagggacagtccctgtttcagagactggagaaataaataaccccccaatgcacatatgcaccacacacacacatgcatgcacacacatcacacacacacaaacacactaacgtaatgaacatggttcttggtgattctttcctagagattttcagcatgaagcttggcttatagtactgtcctcccatgtctgattctaaagcagaggtgagcttcctaaagcttaaccctatctccccactccttatggccatgattccaagcacaatgaatacatctggttatgttacctcccaggtccaagcccccagaaaaatggaaagccctggggagctctgttggaaactgggcctgccacacaacgcctctggtggtgtcctgttctatccctccctccacacgactgcaactcccatgatcagtaacttttgcttctctatacgcatcatactctttcttttgcagaaacccatcatgaacctcacttaagtagcctattcttcaattgcctcatgcagcttgctgtagaaagcctctctcttcctgcccatgctaactgctcctgctcagcctcccatgatatcagtgcccagcattttcacttcatgtgttgcagtactgaaactgcaggtctgtcattttcccgcagaggtcccaaagtttcttgaagatgcagacgtatcttactcatcttggtaattttaatgttaccacagtgcttgccacagagaatctctgttgacataatgaaagcatagttgcataataatattatgcaataagcatttatgaattgcctccaaaaaagactggtgatataaatgcactatcccacacaagagttccactgaagtgtcatttcactctatatataaaagcaacaaagctacactgggttgattcatttttcaatattttatgaaattgttctataatatatattttgagtggcttcttggatacatttgttatgtaagctttttttcattttgacagctataggataaaaagtgccctattacaagtgagatactataaaatgtgcacagtatagaacaaaatatatttgtcaaagtcaaaataaatttttacaaaagtatgggcattctccttcggcaggtaacaaagcacatgcatgtatttttttaaataaatacatttaaagagattgtatgtatacttgctctgtgtacggagatacctgctctaaaggggaggctacagggcaatttgttgaaagaaacagatgtaaatttagagatcagaggcaaaaagtaacatggtctttagttctgtgggcagatgtggttatctgacaaattatgtctgtgacatggcttatttcatgaatatgtgaggcacaagtttaccacacatttgtttgtttgtttgtttgtctgagtcaggatcttgctgtcttgccccggcttgagtactatggcacagtcacatctcactgcagccttgaactcctggggttaagtgattctcctatctcagcttcccgagcagccaggactacagtgtgcaccaccactgcccagcaaattaaaaaacaaaaacatttagagattgggggggggggtctcactatattgcccaggctggtcttgaactcccagcctcaaataatcttcctgccttagcctcctgagtagctgagaatacaggcatgaaacactgcatccagggtatttctgacttttttcccacatactctggctcttaaattcaaagcatcccaaaagtcaatgagtcacatgatctatgatgatgaactaagttgggacacagtgaggagcaggcaactgagcaagtcattggggtcttatccttccctccaagcaacaccattctgaaagggaggacttgaagatgatgctagtgtttttagcttaggaaacagacagccatgacagggtacaggatcctgggagcagaacagattcaggggtctctgttgatgggatataatgagttctcttttagacatgttgggtttgagatgtctgaaacaaatattaagttgaggcaattgcaattatggtttttgccattgaaagcaatggcaagactgcaattacatttgcaccaacctaatatctactaggtgtaaatatgacactctggagagaggcctggcattggggacataaagctgagcaggtgagcaataggtaattaagcagatgccatcagaaaattctgagtagcaaagagtgaggtcctagccaggaacaggattccccagcgaggaatggggaatcacccttgctttaaggaagctgaggtgcttggtgtcagggtggggcccaggctgatggaagcacgtcaccatctggtcattagcaggagggaactcgatggacactcaatccagaaaaggcagaagcctaggtcctaggtgacaggtggaacagtgtgaggttgatgttcagtccttggatcgctaagctactctgtcttaggtattttctgactatggtctggcttgactccaaacatgcagaggttgaacctcatggtgagggcagcagggacccagagtaggccctggttacccttttctcatgtttatatgccaagcagcaaaacgagccaaaacaattagaaataataatgcccacaccattttacaggtaatcttccccatcagattgaagcctgctgaaatgtccactccctgtacacagaacattttctaagtcacagctttgcatatcattctctaaatgttaccacttgaaacagcagagaaaactttaaagggtgcattttagtaagccatcatatactcgttttttgttgaaagttaccaaagaaactttccctatcaattccaacgaccatctaaagaaagtatgccttcacttgtattcacaatctgggaagtatttgagactatttcccttggcttctctttgtctaataataacgatgaaactgaatggtgtctatcctaacaaggtcgggggcacatcaggttattggcagagcagaattctggctttctggaaaagatgaaatgcctgtcttctcagccgagggcagcctgccacctccaccacagtgtgccattgaacgtggagagggtaacaggatgggaaagtgtatagttggcccattgtttaaaagcaactccagacatccttatttgctgtgtattaattgaaagaaaccatttgtttggtggctaagtttgcttctgaaatttactaagaactgagtgctgatttctcagaaaactgaaggccaagtttaatttttccagctttcaacttaatgcattatcctttttttttttttgtctaaagagtgaaagccttaaatggaaatcaaagtctgtagtgcaagaatgaaccctctttgcctgaactggtgtttaaggagagctgaaactcttcatttcctttcttgtttctgagaaactggttcaaaggtcaagcctaatggaatgtttcagaagttttattttcctttgcaggcttacgaaaggcttggagctgacccagtaaaattgagattatgaagcattcagttgttaaaggaatttccatggtttttccctttaaaataaatcctatatagatcaaaagacagtgccttgatatttcattaaaccaacacacatatatatataacatatatatatcccttttttcctctggccataaagctgtaactgttaatttttcttttggattgagttatcatcatgtgggcatcattagtacacaactgatcaagacatatataattataatatacaattattaaagcatacaaattgtgatatgcaattatgaatcttaaacattattttattgaaaaatacatctcttaatgagtggagacagggttttaaaaattaatttatgtatccatgaatgaatgctatttattgctagactaagacaggtccatatcaatctctaaacctaagataaaattctaagccctccaaccgactgaactgacctcctcttggtcaaggggaccctacaggagccttgaaaattgaattcctggcctcattataccccctccctagctaaccaccattaggctttctttcccaagggctaaatagaaaccagtactttgcaaagactcactccaccactctatcaaccagccacccgatgctgcccttcccttttgtgcttttgacaaagcaactggccagcattccttcaacataggagaccactggccatggagtggttctcgccagtctatgaggactgcacccaaatggcttttgtgtcctgtttcacattctgatgttcagagcctaactgtagtacatttaaatgttgagtctccaccacaaagtgaacatgggatgtgtgctgcatatatgttagcctattacacacacatgcgccacctcttcgtgaattttcatagcttcaactgaaacctgctgaatatgtacaccaagccaccctcccagcatcaattcctgttccttttacccctcccttgaagtgcttgctttttggtttcaacaggatgctctgcttctggcctgcaggttgtggtaccctctttcacaaataaagccttccttaccaagtgtatagatgtgtgacttctttggtcaacgaatctatttctatctttggtttttatagatgcaagagttgagaaggtttgtccatagtaatatgtagtgaggttcctggggagtcagaggctggcctttatttgagaagagggtgggattactgtgagagggacatggaaaagagagtcagggaagggccagtagacattggccaagtgagtgtcttgaaactgattggcaggacccctcacccctgggacacaccatctcagcctgaaagccactgatctacaatgtaaagggtacaattcctatctctaaccctgtgaaaccatcctgaacagagtttgcagtactgctgccttctaggtgtacatttctctcttctccctcacgaggcctgtaatgagctgtgtgcctccacatcctcatccctttgctccctgacagctcaaccccaggtaagggtgccaaactgcatgacaatgtgtaacaaatgggaaggcctttttcaatgaggcagaaggaaaagagctgggcaacaccgaccttcagatcagggcatctttaacattgatgtcaatgaatcacaactggggggtcttgctaatgcagattcagatcagtaggtgggtgggggcacagctgggattctgcatttcgaacagtgaactctaagtttcaaggtgatgcagaggcatctcctgggacgcatgctcgctgtagagaatggtcttacatctgtctgtgcattggtgacttctgatgattgtcctcctaattggtaaggagcacacacaaggcaccatccgattccttgatgacaaccacacagcatgaagtgcctatgtccagggtccacgttgaggcatctcaagctagagggtatgctacaggctgaagttaaccagagaagacagccgggatgtggctactgcattgggtcaggtggaggtcaagggccagtgggaaaggacaaagaagggtgagtcaagcaagggaaagaataaagctttcagcaagtataagtgattctgggatgaacagtccagatccccaaaggcaaagtgggacaaaggctcagtgggagaaaaaagagaacttagggggatttggcacgggctggaaaaggggtaagcattgtttgaaacctatgaaaggcaagttgaaacttttgactttttaaagggaatagttcctgtgagaaaaatctaaaaggtaaattgtcttcacaaactctattacaaccttctaaaaagtgagtgtaaattttgttgatcacattgtcaactatattaaacacctggattctcaaatccagacttctgatcaaataaacgaaaactctaagactgttaaggtcaagtgatcctggggccttattatgccactgatgttataattacaagcagatttacaaggtcaaacaggagtaacatcataacgtcatagcttggtttctaacttctgcaataaactaaatgtggttgttaagagatgtttctgatgataaaattggtgattcagacattaatgcgtgcagaaatcacccagggatcttgataaaatgcagattctgatgtagtaaatgtgaggcagggtctgggattctgcatttctaaccagcacccaggtcttagaaccttatttcagatagcaaggatccagaaaaggtgttaacaagtttaagttttggtcagtctagtgtttgtaattttttaagtacaataatatattttatggaaaaattcaagatgtggtaggctagatttcatttctgtgattttaaaaccaaaggaataaaatggaaatgacagtgattcttattctgtagaaaccatttcattcccataagtgagtacgttcactttatcaaagcgctagtgatttattacattaggttgatttatacatatgtttaatgacttatatggaaaactagaaaaatgactcttttttccaaatctcattttctacatcttacacaaacctttcaaatttagagcagataaatgtatatgtgttgaactgcatgttaaattttaaacactacacaaaattctttttttttttttttttcctcaagacagtatctcattctgttgcccaagctggagtgcagtggtgccatcacggctcactgctgccttgacctccccaggttcaggtgatcctcctacctcggcctctggagtagctgggactacaggtgcttgtcaccagacctttttttttgttgttgttttttgtattttttgtagagatggggtttgtcatgttgcccaggctggtctcaaaattcctgggctcaagcaatctgcccttcttggcctaccaaagtgctaggattttacaggcatgagccattgcgtccaatccaaaattcatcttcagaaaagatacatctatatgagcagaatgaatggccacttaatatgcctccttctgggctttctctcaggggctaccatactcccaacagcccctctttgaagatctacacgtgcagattattgcgaagtcccacttcagctgaatgctatgggaattcccactgacccacagacagctctgccaagagcaggtgagctgtgtccagtgtgtttcatactggacacccactcatggctccagactgagcctcttgtattagtttactgggcctgccctgcaaaatatcccagatttggtgcttaaacaggaatttattttctcccagttctggaggctggaagtccaagatccaagtcctggcagcttacatgtttcctgaggcctctttccttggcttgtagatgaacaaattcccactgtcctcatgaggtctttctgtataaccacatctctgacacctcttcctcttcttataaggacaccagtcctattgaattggggctcaccctaatggcctcattttaagttaatcatccttctttaaaattttttgagacagagtcttgctctgtcacccaggctggagtatagtggtgcaatcttggctcactgcaacctctacctcctgggttcaagcgattctcctgcctcagcctctgagtagctgggactacaggcatgcgccaccacacgcggctaatatttatatttttagtagagatggcgtttcatcatggtggccaggctggtctcaaactcctgacctcaagtgatccccatccctcggcctcccaaagtgctgggattataggtggaagccaccatgcctggccaaagttaatcatctctttaaagccttatctccaaatacagtcacattctgaggtactggggggttgggatttcaacatatacatttggggacagaattcagcccataacacctctcttaagccagtctgaattcagagtgctacagttacccacactggagagatgcagatctctgcagaagtcctgtgcaatagcagcccaggaagtcagagattggagaccaggagagaagaaggtggtcagagggaagcgtcagggtggcagggtcatgagtgcagaggcagagacccacactgccaggctctgcaaaggggctcagcaaatgcccgattctcagcgccatccccaaggctcctgccatggtcccaaagcagctttggtatccagcaccgtgatctgtttttcaatgagactcgtctggctaaggttgctgaaacagcttcctgtctctttcatacccctctggaaacttacaacaagctcctattgactgagataaccagagcttatttcattccttgtagtctgtaagtgattactgcagtgaatgagctaatgtagcatgttacatacaggaacttcagcagacagtatgggcctgaatgatacacacatcacatgtggatgtacataaaggtcctgttgtacgttgcctgtgttgccttgatttttattaaagcaatagtgtaggataatcagacagaaacttgtttcctttttaaacatgaaaatctggctgggcacggtggctcacacctgtaatcccagcactttgggaggctgaggcgggcggatcacgaggtcaggagatcgagaccttcctggctaacatggtgaaaccccgtctctactaaaaatacaaaaaaaaaaaaaaaaaaattagccgggcgtggtggcgggcacctgtagtctcagctactcaggaggctgaagcaggagaatggcatgaacctgggaggtggagcttgcagtgagccgagatcacgccactgcactccagcctgggtgacagagagagactccgtctcaaaaaaaaaaaaaaaaaaaaaaaaaagaaaggaaaacttatggttacagagttcaggctgggtgtggtggctcatgcctgtaaccccaggattgcagaagggcgaggcgggtggtggatcacttgaggtcaggagttccagtccagcctgaccaacatgatgaacccccaccccctgtctctactaaaaatgcaaaatttagctgggcatgctcacttgaactgaggaggcagaggttgcagtaggccaagatagcaccactgaactcccacctgggcaacagagcaaaactctgtatcaaaaaaaaaaaaaaaaaatagaaagagttcagctaacttatacagagcaagtccagcctgtgtgtgtctgtgtgtgagcctaagtgtatggacactgtttagcaaacatacgcagtgtttgagttcctagaggcccattttacaatattagcaatattgtctgttactttcaagctgatttatagtaaatttaagtctgttaatacttcagtcatcttcaaaacaaagaacagcaaatacatagcaaggcaccctacagaaacgtttccgtttatctaaaaaatcccatgctttgtattttcttctttaatgtcgaaagcacttttactgcagcatagatgttaattgccacttatcttaatgagttcttttctaatataactgagcctggcttgaaatatagcagacttctttgtcaagaagagatagggacaagagtactgttggttcctggaagaaagggtatgcttattttttatctgctttctttgtgttggttgaaagccttctgatttagcatttttgaggtatgagttactgctttcctcctcagtatgaggggaaattaacccctgtagaagtcaggaaacagaactttggttctaaaggcaaaaggcacagtaggaactcctgaggttgttaaaatattaatagaattatgtggtagctcatataatcagttactaagggtaatttttaataaaattttggcaggtcgctttcatttaaatgtgatctatttttaagtttatgtaattttaaacatgattattttttatttatttcctagttaacattcctacctcatcttccctatggaaaagttttcagggtccagaacatacctgactatttgtacttagaacatatttgttgagtgaatgaatgaatgaaaatatctaaaaccccaaggcgagatttcccaaatagcatacacaactatttttattttatagaataatattatgtcatttaatttaaaagctactttagtggggaggagggatgggcagagattggtcaatgagtacaaaattacagataagaggaataggttctggtgttctattgcacactggggtggctacagttaacaatattatatggtatatttcaaaataactagaagattttgaatattttcactacaaagaaatcataagtgcttgaggtgataggtaagctaagtaccctgatttaagaataatgtaggccgggcatggtggctcatgcctgtaatcccagcactttgggaggctgaggtgggcggatcacctgaggtcgggagttcgagagcagcctgaccaacatggagaaaccccgtccctactaaaaatacaaaattagctgggtgtggtggcgggtacctgtaatcccagctacttgggaggctgaggcaggagaatcgcttgaacctgggaggcggaggtttcggtgagtggagatcgcgccattgcactccaccctgggcaacaagagctaaactccgtctcaaaaaaaaaaaaaaaaaggtgggctttcgagcttcctacatggtagtgggaggcactgttttgaaaggatcaggatccatgaggcctgggtgctgcctccctggggattcatctcctgctcgtccatgcagccttggtttctgtctataggaggcagtgcctggccagcctgtagttgtctccttccttctatttatgatggtaaaatatacataacataaaatttacaattttaactatttttaagtgtacagttccatggcattaagtacattcatactgttatacagccatcatcactaaccatctccaaaacttcttcatcatccaaattgaaattctatacccattacacacttctcatttccccttcccacatccccaggaaaccactattctacttttggtctcttagatttgactattctaggtacttcatgtaattggagcatacagtgatataattaaactgtgtccccacacaaatctcatcttgaattgtagctcccataattcccacgtgtcatgggagggacgtggtgggagataattgaattccctatactgctcttgtggtagtgaataagtctcatgagatctgatggttttataaggggaaacccctttcgttcattctgtcttacctgccgccacgtaggacatgcctttcacgttctgtcacgattgtgaggcctccccagccacgtggaactgagtccattaaacttgtttgtctttataaatcacccagtcctgggtatgcctttatcagcagtgtgaaaatggactaatacatattcatccttttctatctactttattttacttagcatgatgtcttcatgattcatccctcttgtagtatgtatcagaatttcctcccttcttacagctgaataaaactccatcatatgtatactgtatactacattttgcaatggacatttagattgtttcaaccttttgacttttttcttttctattcttttcttttttttgtttttttgaggcagggtctcactctgttgcccaggctggagtgcagtggtgcaatcacaactcattgctgcctcgacttcctgggctcaaatgatcctcctgccttagtcttcacagtagataggaccacaggcatgtgccaccacacccagctaatttttgtattattctgtagagacagggttttgccatattgcccaggttgctcttttttatttcgataagcaaaggtaaagggaattccccagatgatattagagggaaagatggatagttttgtgagatgatcagtcagatcagacataacaaatcatcatcccacaaacttaaaggctggaaacaacaatcttcacttatgacacctcacaggttcataggaacaccagatagggaagagtagggatgaccttctctgcttcaccacgtctgggagctgacctggaagatccaaaggctctactgaccctggcggatttgcttgaaagggtttgctcacttggcaggcaggttgactcctcaccatgggctgtttggacgtccttaggacgtcagcctggctcccttaccttcagaagccacacactgccacccctatggcatcctactggtcatacgggccagctctgcttcatttcgggcgggaagacagaaaggtgtgaaccccaggagaccggggtcattgcggccatcctaccacacactttattactttaattctatgctggatgctaggtattgggagatttttcagaaattattaagatttaaatattattgctactttgaaaaacttgaaaatattgaggagatattataattctagtcactcattcatttagcaaacacattcaaaatggtaaacataggtaaggtaaagaagataaatggccaggatttctttttcacactcactgggacacaaattttgaatgttttcactgcaaagaaatcatacacgtttgaggtgatggataagctaagtaacctaatttaataatgatgtactatatatgtatagaaacatcacactgtaacccataaatatatacaactattctatggcacgtgagtatcttaaggtaattttacattactcgttcagaaaaataaaggctccatcattgtgggtttctaagtcagtgttccaaccacctgtctgtaaaccaactttcatttttttcataaggcctcttttattcagttgaaaagactacatcccaggctgatttcatatctgtctttccagtatattaggaagtgctggaggaaatcctttgtcaagtgaaagactggacgccctctgccggcatctcacctatcccttcatatgtaactaacttgtgtctgaattccgaaaatgttgggaaccactgggctgcatttcaaagatgggggagccaccctagggtctcactgtagcatccttcaagagcagatagatagggtagatggaggccctcactttgggggtttcttgcaaatgtctcagttaacaaacacattccaaactccttcatgtggagcttcatctctaaagaggcccccaaactaaggaccctccggtatggaattttaaacaataaacacattcaaagaacaaagcatatattgaagtgtccctagaatactgaaaaggtacaataatgaaaaagtgaggatacttctgtcatcttactcttcaatgcactttagtacataaagcactgtgtgtgtcagagtatagcctgctgaatttcccactggtatcttcttctctttcttacctttcctcctttcctcctccttcttgtcttcttagtagaattaagtgcctgctaaagcacacttggttcagcaacccagttatagtcgctgaacatgttcttcagtagattcagtaatttaagttactaggattgtcaaacttgaaatgcaccatgagcaatgggatttctgtttaaaatatattttttactataaaatgctaatcttctccttatcaaggtcagtatctccaaattaatgagcactattagctgcaaaacatctcaagaagcaatggaaattaattttcattagttaaacactgacagtcaactacaacctgctttgtaagacaataaatattttgaatgctccatttttgtcctcaaatgttcaaagtcagatggtgaaggaaaatgacttaggacatcaagccaaatatcaaaactggtttgcacatgaaataaccaaaggagatttcagaattccacttgtggtagaataaataaggactttgaggatggattaattgagatatgctaaaaataaaacacgtttcccatagtagtacacattgaagaataagggaaggaagctcttttaggaactgaggcaggagaatagggtctggcggcggggaacctaaggccaattcacactgacttcctaggactaaatcaaaagaaaaacctcaacttttcacacctaagtaacaaaaggaccagagcctactccctttgcaaattcccactcccttttctgtgtgccagatggaaaattgaaaatacctctgattggttgctttccacaaccaatcagactgattgtgggccaagtctttgtttgcacagaggtgtaactttggaaattcactttagcctctgattggttgctttctacaaccaatcagacatttgcataggatgtaacctttgtaacttcagcctctgattggttgctttccacaaccaatcagaggctgaagtggagtgacaaaggttacaatcagatttttggccactatttcatttgcattgggtgtacaccaagtggctgatgggaaacctctagagggtatttaaccccagaaaattctggaactgggctcttgagcccctatgctcagccctgctctcaccctgtggagttatactttcattttcaaaaatctctgcttttgttgcttcattctttccttgctttgtgagttttgtccaattctttgttcaacatgccaataacctggacgctctccactggttaacagaactggccaaggtctctgaaaggcatagtgtactttgaacagaacatgagttcgaaaggttgaacgtgggtatgtggatgcctattaaatacataaacacacaaccagaatgggcttttcaaaaattttatagctactatgacttatccatacttctataaggaaaacaagtcttgtgtctaagtctgtgaatttatacttttagttttcaacaccctatcaacactgataaatagagaagacagaaaatcaacactttgttactgtgtgccctttgtagcattaacaaacatgtgcttatgcaaggtttgtatatcttatctttggataaatgcatgcagagccaataaacagatggattacatgtatatataaatacatgtgtttatacacatgtgtacacatactacatagatacatatacacacattatttatcatctgtatgccacatagacaaattatgtgtgtatatgtatgtatacaaatagtatatctacatataatttatgtgtacatacaaatgctcatatcacacaaatacactcataatctatatggcacaaacacacacacacacacacataactttctttaataaaagtctaaggctgtcaagattatccctagaggaagacagtccctgaggaatgattgacccagtgagccaattttgtcacctgaatttttttggtttccctctctctggtgagggttccacaacgtgggaaccaactttgggtagcaggggtgctgtcctccatgttcacaatcttgttcaagactagacccacaaaatcttcctttgataccttttgaagcacagaaccttctttgcattccttcgaaaccacttcccagaactctaaaagatatcaagcaggaaataaatgggaagcacacggattttaaatacaatctgtgcatccaactggagtgtttagatttcacaacttcctctctggaattacaagccactctaattctccatgagattccagggaaagaggctcccttgtttttggttctcagctgacttccaagaggtgccatttttaatattcactctccttttgtgctcttaaacattctgaccatttttttcaaatgcagatgaagagagagatttacttcccccacctaccaaggacctttcttctcatttgcagtctttgatatctgtttcatcacaaaatggtacaaggaacaattccacctgcaagaccccattctccttccagtatgagaatatctaaatcccatagataacacatgcatatcacacatacatcatatacaatatcatcagtaaaatgacagagattaaccacgaaagaggaagtaatacaaattactgataaagctataaacttaaagcataatgacaacattgcggataattatttgagaattcagtagattactcctttaaagcactacctgcttttttttaatgtgttatcactgtacttagcattattggggaccttaaaattcattaagttctgacttctactgatccaagatacccttgatactggacattatcatcagatttagtgtctccaataagcttattttgtaaaaatttcatgctactttaattattgcatggtacttctcagttgctttaaattagaggaaagataatatatctgttcctggaacaggggatatagtggacttcaggtagaaaggttaaaaaagaaagttctggaaagatggaataagcaaatatgatggatccacttgtaattcatcagagacacaagctaagtgacccaggacatcttagttcctggctttttaatggagaccaaatataagaaacacaaccacaggtagggagtgaacaaggtgtgtagcaggggtgttagggagggtgaactacactgagaaggaggcgaacatgtgaaagtcgctttagctgctatatgttggctctagctagcttggatttggctttttgcccccaagtgatgtagggaagcccagaatgcctggagcccactttagagaactggaacatgggtctcacagacctctctgcagtcctcgaggccctggctaggagtggggaccccatgggttgtcagctcttgggccaagtatgagatccacactcaccttctgaacttggggtacagtctgttttactgatagcacatggatttggaagagaagaggctcgttccctagaggaaggtctgtatacgagagcacaaaacggatttccaccatcgcaaaggatggggtatttgctaacgaggaattaagtaactagtactttgggtaggactatgcatcaggcatgattgcctgtctctcattactcttgaccacatgatatcatggaggcccctatgccagaacctgccttagtataaattaggtgggtatatttaggtagcattagaaatgagttgttattttggaatgcaattgtttattataagtactgaaaaaaatcaatattatcacagacaaatactgtgtgtgaacattactttcttttaaactgataaaagaactcttgaaaaggaagttttataaaacaaaaaggtctttttgccttggagtcttctctcccttcttcctatcttccctcttggctatgagggctgagtacacagttccttcatttttttttttttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacggggtttcaccgtgttagccaggatggtctcgaactcctgacctcgtgatccacccgcctcggcctcccaaagtgctgggattacaggcgtgagccaccgcgcccggcccagttccttcattttttaatgagctttcattaaacagcctcattttttaaacagcctcattttttaatgagctttcaaagttgtgtgagagggaaagggacatctacaaatgaccatcatgctatggggaaataaggcagatgtgacaaaagcagtaccgcgggaggaggtgagggctggtacatggtgaggaacagatggtattgccacaggaaaaactgaatttgaagggaaatggtcctgctgacaccttgatttcagacttccagcctccagaactgtgagatgataagtttctcctggtttatgccacccactttgtggtaatctattatggcagccactatggtctgaatgtttgtgaccccctagatttgtaggctgaaacctaatcacaaatgtgatgcattaggaggtggagatgttgggaggtgactaggttatgggggtatagctctcattgatgggattagtgcccttttaaaagagaccccactttgtgaggacacagagagaaggcaccatctctgcagaaagagccctcactagacacacagtctgttggcaccttgatcttggacttcccagactctggaagtgtaagaaataaattcttttcatatcaagctacccagagatatttttcttatggtagccctaatgggctaagacagcagccctaagaaattaatacactatggttataatttataagttaaacaaatccacatattggaagtgcaagctttcaagttaccactttgtcctgatttgggtgggtggacagggcattcagagacagctgccctctgtagcccaatatcccaactgagccaggcctgagtgttcccactggctaccctcctccatttccagacctcttttctttttaactgtcctctttacctggaaagctttatctcagttcttcctgtggcaataccatctgttcctcaccatgtaccagccctcacctcctcccgcggtaccgcttttgtcacatctgccttatttccccatagcatgatggtcatttgtagatgtccctttccctctcacacaactttgaaagctcattaaaaaatgaggctgttttcaggctcttagatctgcagcacccactctggaatcttccatggaaaagccatctagaagatagtaatgccttcagatggattcagagggagaggtcctgaggagtgagggctgcaggctccatcctggggccaggatgtacctggatacaacctcgctgaggacacatatgtctgattttcccatttcaaaggatgtggagcagtgtttataattatactggataacaaaattgggacccaaaaaagatttctatagtatcaaataatggaatcactctacaagaagtgaatgtaaagttcttcatttatgttaaaaagaaaattccagataagatcagtgattcatagttttgcagaagttgcctgtgaaaagacttggcattttgtttgattctacagctcaaataggtatgaatgtccattacaattagaaacacgagactgaaagtcagatttgggttctgtttccacctctctgagcctcagtttccccacatgtaaaataggtattataaaaagtcatgtgatagagattttgggatgattaaattagataacgaatataaaatattcaacactgagcatggaacttaataattaactttcatcatcattgttatcatcaacactgttataaacattgttgtcatcttactgtcaagaaaccctaaagtgaacccaggtttgcccaaagtaacacttactctctttctatacttgctggtgatgtgtgaagcataatttggagggacatcagccactgttgggcccagaagtgacagctcatggaacaatggcagctagcacaggggcaggagccttgggcctgggagtgaggtgcaggaactgtctcccaaggccactctttgaaaaagggataggtgtattctcaaacgatttcaaaggtcagaaacaagatcagtgaaggaacttacaaaagatgcagatttctgtatcaatataaactagtgcataaggcttggattactcaaagaaaaataaaatggttcaagagatggtgaggggcctgttgctcaaggcattcaagcaggggctgaatggcaaggttttgggattgctattagctcaactgataaacgacctccggcactcttcaaactccagaagtctttaagttgtgaatccagtatttctccccttggatatttcctcagttaaataaataattagtgagcatttgaagttaaaagcaaactacccagagattcatcacctgagagaattggaccctgaaaaatatgatatgtggtttactgcaaacatttcagccatgttatttgagttacatggtaacaagttacataatactgtttaaactttaatatttaaaaaatattcttcaagtcttcatctttttaaaagcatttttatgccaggcactgtagctcatgcttgcaactccaaccctatgggaggccaaggcaggaggatcacttgagtcagggagttcaagaccagcctgggcagcacagcaagaccccttctctaaaaaaaataataaaaacaatttaaccaggcttgtggccagcctgtagtcccacctacttgggaggctgaggtgggaggatcatttgagcctggaagtttgagcctgcaatgagctaggatcacaccactgcactccagcctgggtgacagggcaaaaccttgtctcaaaaaataaaagcatttttatagtatattttgtttcctgagctttcaattcactatatatgcatgcgcgtgggtgtgtgtgtgtgtgtccacatgtgcacatgcgtcgtgaacagttaaaaaaagaaaaagcagcatttggaaaacattctttaccaaggtttacctagtagtaaaatatttataagtaatattcattaatgagatttaacaataaagtgtccaacaataagataaatgttgttactatttcgaaacagcacacaaaatatagtggaaatgtatacataattccttaaaagtgcatattgtcatactcttagtcaaattttgcggtttgaaacggaacaaatccatggagtgagtttgatagagccgactgaaagtgcagctgctataatttgggcccagcatcagcattaaaaatgtgccattgtatgtattcctgttatgatgaataacaaaatagaagatagtgttctattgcaaatcacattcataaaaagtgagattctttaagcatgtttgaaaaactgctttcgagatagtgtacaccaaggattacaacatctcaaaaagggattaatcaaacacgattaaaagttgctattactgctacaatttacacattatgtcagtaatatatcttaaccatgacttttattatttgatagacaagacagttataatacccttagtatatctgggtatatcagtcttgctgtgtttttttccatttgtttcatcatcaaattttcaaaatgagaatgcttttgtgacttatcactaccaacatgactgacacttctttcatataatttaagagttatatttgactttcatgtttaaaaacaacagtatatagaactcaatagctggtgtagtacctacaaatatattagctatgataacaatccttaagagattcacattttatggaaaataacatacaattacaaataaaatcttcttagcaaatggggctgtaaagggaattttacaggtttaaaaatgatctcagtgactgctggctttacaaagaaaattggataagacatttctgtgggttttctgttggcatataggatgactagtcaaaagagaaaagaccaaagctttgccacaatccaaatgactgagccaaccatcaacaagaaaatcccaacccctcagaaccaatccttttgtatcctatgacttagagtcacagaaagtcaatatggcttctctggtttcaagtctaatgatgaagtggaactgccatgacttcaaattattatttcaaaatgcagtatttgcttaaacacttctcactgaataatactaaaactctctaacagagaagagatactggtctacaataagaaaaataaggtagatgccggaaatgaaaaatataacaaagaccacacatccaataagcaatcgatcagggatgccagaactacttagacaatttccttcattcttcccaactcctacacagatactggtactgccattcatcctctgaaaaaaaatcataaatatactctttctttttcctttttcttttttgtaaagaaataaaaatgttcgtgccaacatgtgctgcagtatggattcaatatgtgctaacaatgtagatgtaggtccgcacactcacctggcaccaatgcattttcaagaagtcatttaacattctgattctgcatttatttaaggcattaaatatgggatatcagtttctgctcacaaaggaggattacatcaaagatgtaagtaagcctactttgaagattgtaatgtgctataaacatatgtttataatgataaagaggcttacatagcctggtgtttggcagtaaataaaatgttaacaaattctcttaaatatatgtaaatatatttcaaaagcttgaaaacattgaaaagatttaaataataagccataacgccaaaataaataagtgtgagccctagaagttaaacatattagttctggtaatattcacctatgaggaatcaaattataatatttaagggaaaatgcaaaaatcttgtcttaaaagaattactatattttggacctgaagtttaaatttggcacgtctctccattaaataaaaacatgttgccgggcgcggtggctcacgcctgtaatcccagcactttgggaggccgaggcgggtggatcacgaggtcaggagatcgagaccacggtgaaaccccgtctctactaaaaatacaaaaaattagccgggcgcggtggcgggcgcctgtagtcccagctactcgggaggctgaggcaggagaatggtgtgaacccggaaggcggagcttgcagtgagcggagatcgcgccacagcactccagcctgggcgacaaaacgagactccgtctcaaaaaaaaaaaaaacatgttgagacattccttaattttaagaaaacccgacaagaaaggtattatattactacactttatgctccatacattttgcatgatgccagataatgaatcccttttataataaaccacaatagtccagttctggttctagatttgttttttcttttcttttcttttttttggggggtctgtgggtctgagctcaggatgaacttataattcatatagcactaatctgcatacaaatttgacgcatacaaaagcttagtggtcaatattctcttattcattctaacccttcttattggtgtttttcttttttggtttatagcaggcactcaataaatataagtgacataatccataacttgaaaaggtaagagctgtgtcaatatattgagagaagaaaaaaggctgtaaaaatgacagtaacataaaatggaaaggatacgccatttaataaaataaaatgcatttaatacacagtattaaatacagaagctatgctacagctagagaaatataatttggtttcttattaagctaaattcctaatatgaaaatttaaagtatttccatcagagataaaatgtttattgtcaatttaaacctcctatgttaaatataaacaatgtcaaatcacatatttttgtcttttagcatttcttaagggttcactattacgctatttctacacattttcagtagcatatcaagaaagattattttaaaatagggaatatgttgaggtattttctgatgaatacgcttgccatacatgccaagaatacttaaggatctggggcaggtttcaggaccaagactataaagagtgctgttgagactgaaaatctagataaccagtacactgaacatagtaaacaaaagaatgcttccgatttctggtagataacagtaagcacttattacaattcactttttcaatggtgttataccaaatacaatatttaacatggaccttccaagcaggtttgaattgtgctaaagtagctatctcaacgtaaaccataaaatgatcccattctgccttttatatttgcagaagtgatttctttttgcaaaaaaatctattccaacccctcaatacagtacacaggaacttgcgtgctccatcagtgaaaattccttgagatgaattttaagtacaagaccagagtcaagccacctgccctgccataaagaaatatcagcaatctgacatatcaacagtattcacagatgcagatatatatatttatgggactctatcagcataaatccaatggctatgaataaaacatcctttaactctacagggactcaaatccaactttacaagcagagcattgctaaaccccttgccactgatggaaaaaagaaagaaagaaagaaaaaacagcaacaacaaccacaaaaaaaaacctccataacaacaatttctctaatatattatgctcacatttttatcagtctttaaacaacttcatcctaatgtttattttcagacatagagaaatgaaggccatgtaaaatttctaaattttcaattttactatagcttggaaggtgtacccctttgcaatctgataaatagaaatacgcatgatgacaaagcatacttccactgagacaataaaatatgtaggccatgatatctgaagtcaaatgacatagcctccagtccccagtttcccctgtattaaagacggctgtttacatctcatcaagtagctaaacatcaagcacatatagatactctgatcaaaagatcatctctgtttttggtgatgaaccaccaaagatactagggatccattgcaagcacacacattccaagtcaaacaaaagaaaacccaagaaaagccaaccctttaatagtcagtgacataaatgcaacatgacgtgaaataaattacagtaccaggttacaaaacctctttagacatcatagggaaagaaaaaggtttttacccacctgggatctttctgaatgctatcaatggacggggacctggccaaggtgccttcaggcgggagagcagggccggatttgctgtatggagactcaacagagggacaatactgcagctgtcggtaggggtccgcgtaattggaggctgggccggcggcatagctggccctctggaaggtggccgcggcggcattctgtgggccgtgctggctgcctgtgcgctgcaaggggacggagtcgacaccaggggaagatggggctacgacaggaaagtagggacaaagtaaaaaattgaggacctgctcacagaaatggttaaccaggtctaggcaggggcaggggaagttacacacataaaaaatagggggttcaaaagaataaaaaaaattaatccatcatatttgaaccaatacattcaatgttatccagtcaaatgataattagcatgcctaagagacaaacctttcaggtatggggggaatgcatctgttgtgtgtatatcgcttacctacatccaacagaaggtgtgttcagctgcaatataaactttgtgcataagaagaaatatagagaatactttctaaggaggcatgggaagttaattcttcattttcaagttgagaagattcagaatgtgttccggtaatgttatattaactttattaaagatgtaaaatgaattcagtaatgtaattagtaatgtagttaattttcttgaatcaaagaaaataagaagaaatgagagggagtgtatgcatgggggtggaggtgagaagaggtggggttcacatctccataattagcaccagaacattcaatccatgactgctctagtttttgtaaagtaactcccgaaagatttttatatgcctctttttcaagtgaagctgtcacagaaacaaacacatttggtgaagggagaataaggccaaaaccaacccaactgcaaggcagacaaaataaggagctgacttagcttttctgaaagtatttgcatcttctcaatgtgtctaaattgttttgagaagattttacactagttactaaaatcagtttgactattttgaaactgaatttcaattttttgtttccctcttggattctttttagatcctttcatgtcattatttttatctggttctcaaaatatatttgacatctaaggtttggttgatagatacaatgaaaatagcatctttcatttcagtagaatatgaccagttattaactgctttagactgctagtcatgatcaacagcagacagcccacttgctttctggtgctgtagaacagacttcatatccaaaatacagccagtggctagataggaccatttatgacatgggtgctctatgggaattaggttctaattatcaattatacatctctgacttcctaaccatttcttagtgaacaatgatagagcttattttatcctcttttacattaggggacatataccaaatcagacacaaaggacattatgtcatgctgagaaaataattattaaaagaggtaaggaaattgtgtcgaaatgatgaaaatctgcaaagtgaatgggaggaatacactctaataccgaggattgacttaagagttcagggctcttctttcccagtgaactttcaagacttcatcttagaattacaaaaatttaggaaattaggttccgtgacatgacaaaaatgacaaaaatatttaagagaaactttataaacaaaaagtgcatatattcccagagggacaatattttgaaataacgaaggttgtcctgatgtgttaagtctcaaaataatcagattaggctaataaacattaactgcacaatcagaaaatccgctttatgtccttatgcaagtccttgaggatttatcgtttctccaaagtattaccagcatgtgtaattaaaatccacattttaaaatttatgcataatgtgccttatattatgctgaaaggggtttaaaacaggcaagtcataaacttgctcttggatgaacaaatgtacagaggtaaacaaaatttcattttctacaagttgtgataagctagccagaaaatcaagggcaaaaaaaaaaaaaaaaaaagaaaaaagaaaactaagtacatctggcatttttcatagatgtgcatttttttccattcagaaaactaagtatcaacatttaatcttgctgaaaatggttttcaggaaagaaatagttttctatgcaaaatcatttgctattaatgtattcaatacaatgattaaagtgtcagagatcaggaaataatattgaaatctaaagaagtctttttgttaagaaaacaacagagtaggtaaggagaacaatttgactacccacacaaaaaactctcaaaggaccatgaattaaaagaaaatataacaagaaagagtttaagaaaaactctgccaagcagcagacaataaattataaatcatgtaagagggactggttcaaaatgtgaaaatagggtgggaaattcaattaattaagcagaaacaggaaggcaacatcttggtatgtatgcaggaagaaaaggtagaaaaaagtttatgaatgttattgggttcctatttatatttcactttagaccctttcagggaaatgtcctggagctcttttagagcttggtttctaaaggtggagaactggttcctgtcctggccttttggtcagttcttggcactggacagatttaccgagctctccaagctccagtttcagtgttattgaagagaaaaaatggcttcatgggatcattgtttaatttcaacccaggaaaagtgttaaataactcatatggagaaaatattaaacaaataaattattaatattattaccattaatgatgttgaaatcaaccgacagtaggaaaggggattgtacacttggcattggggagaaaggccctttcactgggtgtcagactatatagctccttttgagtgctgggctctgttgtaagtgctttatttgtataaattcatgttttctccaacagtcctataagagagtatacacatcattttcaccttacagacaggaaactgaggctcagagagattaagaaactagccggcagtcagctgatattaataaaaaaggaattgaagtcctcggagttggtttctagagttcatgctcatagacaccatggctaccagggcaggtttaaaacctcaaagctgtagattattgaattacctaatacggtcagaaaacttagaaaaacggtgaggcctgaaacgaaaggaaatgtctactaaaggtacagagaagagatgggttcactaaggaattaacaacctgaatattatattgaaaaatattacaaactcgtatgctaactaatttacactatttctcattacatttacactatttctctactaaaggtaacagataaaagatgggttcactaaggaattaacaacctgaacattatgttgaaaaatatattacaaaattgttatgttaactaatctacactatttctcattacatttacactgtttcactttgggaggctgaggtaggcagatcatgaggtcaggagttccagactagcctggtcaatgtggtgaaaccccatctctactaaagacacaaaacattagtcgggcgtggtggcacgtgcctgtaatcccagctactagtgaggctgagacaggagaattgcttgaacccgggaggcggaggttgcagtgagctgagatcgtgccattgcactccagcttgggtggcagagcaagactccatctcaaaagaaaaaaaaaatttacactgtttctactaaagatacagagaagaggtgggttccccctttaaataattaataacctgaacattatactgaaaaacatattacgagtcggtatgttaactaatttacacaatttctcaattaaattgaatttattgagacatgcaaaaaagtacaaaaattatgccaaataaacctaactttgttcattccttggaaaataaaaaatatatatataattatcttaattttattttaaactgttttacattttagtttaaccagtgatatcactactatgaaaagaggctgggatatgaaatctaagatgagaaacaactttcaaaaagattatatatttaaaaaaatcacaatcatgtgtagtttcagccttgtcaaatggtcttttagaactgtcattcccaaatccatgctttaaacttcttttaggtcataataaataaaacagctgatgaaaatttcaaaatataaaacctcaagccaaattggtgctgttatagtaaaataagttagaggctaatcaatgcaatgaaaataatgtaaaataccagtacaaatggacagaaaaacacactgtattaaaggacaggttatataatcatacagaagaaaatgtatgagaatctaatggatctcaaaccaaccattagtaatgtaacaatgtaataccttactttgtaaaagtatatatgtgaaaacaattactttaaatgaatgaaaatcattaaagatctaatatgtagagaatattaaataaatgagctattattattaccattaagaattttgaaatcaatcaatattagaaaatggaaaagtgcgtatggcattgagtaaaatgacataaagattcagggtccaagtctcccatctggccccaactatttagacattgatgtggcttatgcaatccttggctctccattagtatggataaattaatatcagtcacactattaaaagactttcctttaatacatttttttcccttaatttctggactgttgaacacttttccttatttgcgttttaaagctcagttgaccaaatcattctccttgtaggattactctatccaattgaacccactcagggcaaacactggagagggaaggtgcttcatcaactctgtaaacacactcctctctcgtctcacctgctctacaaacagccccttttcccctcaataagctcttagaattcaatgaactgtatcactggtctcttcgggagatataacaaatagccacttcagcagctgacgtgatacttcaatagatacctacgctttcatgaaattatctgttttctgcagagctgcacaaataagggcctagtttataaaggaaaaataaagagatgttttacgtttatgtgctgtatttgtttgaaaaaggggaagaggcatcctttttaataaagtgaaatattctgctttatgatagataattgcaagcattatttactgacaatggaaaaaaggagaacagaataaaatacaagaatctgggcacacagttacagaaacttggtggggggaaatacaaggtaatgttcaataaagaggaagaaaaaaagcactactttttggattatttgtctttaagtatatctgcatatacagataaatatgaaaacattaagcacatttacatgttatgtaaatacaaaataagcatataataaagtaattaaagaatgtccctctgaaagttcagaaaacaaaaatagatgaggtgacaatgggtccaagaaaatggcctacatacttggaattcaactcagtttctttagggatagggaaactctagcacccaatctggcatatatccaagagtgtcatcattaataactgaactataaacattttgcaattttctgtactcagcacaagttgatccatctaaattcaatggaaaaatactcaagggtaaatttgaacatacaaaatttaaaataattgcatacattactatctttgtggggagaggcatttaatgcatgattcttagtagtaatggaataattgtcattggtgttgaccttgttttccctgcttttattggaaaagaagacattgaaaacaccagaacaggccaaacatgcctatcacattggttctcaaactgaatgtgggatcatgtgtatgaatatatcatagatatatttgaaagcgaatatgatgtaaaaccctatccttaaatagctctcatagtttccttcttgttataaccttgaaaaaatttaaaaatgcaagctcttcatctggataaatggctaatacatgcagggtttaatacctaggtgatgggttgatgggtgcagcaaaccaccatggcacacatttatctacgtaacaaacctgcatgtcctgaacatgtatcctgaaacttaaacaacaacaaaaaaaattcaagatgagatataaggtactacggtcatgttgaaactttgaataacatttttgtgatggtggtgactatacttatcttaaccaatagcattgtaatgagcagatagatttctatgtaagtacaatttttaaaaatgcaagctcctcattaggtcttcatgatataaattagcaggaaaaaaacaacaaatgattaacacaaaggatcctgctcattcattggcaatagctactactatttctaagaatgttatggcgatatacagcataatggacttcagcaggtttctagaacttggtataaaaattaaaaatgtaaataagcgaattaataaaaaaggaaagaaaaataatcccatgtttaatcctacatatgtatgtatttatatctatttaaatgtacatttagcactgtgcattttagttgtcctctaatttatagtgtgtgtaactggagtcacgatgaatgatgaagaggatgatacacagtcttttttttttttttttttttaaccattccaagcacgttttcagccatcaatgggaaaggataaaaataaatgctacatgtatttggagcttcccattgtgccaactaccatattaggggcttcttcacatgatctcatttaatgctcacaacagcctacatggcaggtactactatcattaacatcatcctcattaggtcacagaagagcagtgacaggacggtgggcaggactgggactgaaatgtagcagtggactccagggtctgcgtgttttaccccctctcctccactgttcggcactagaggtgagggcaggcctggttaataaaacctacacattttgaagtgcaatatgtttggcagaaatgccagaaaaagactaaaatttaatgtgatatagagtgtcactgcttaaatccctattacctagataattggctccatcataatattcctagggctgggtgcagtggctcacgcctgtaattccagcactttgggaggccaaggtgggcggatcacgaggtcaggagttcgagaccagcctgggcaacatggagaaaccccgtctctactaaaaatacaaaaattagttgggtgtggtggcaggcacctgtaatcccagctacttgggaagctgaggtaggagaaccgtttgaacccaggaggcggaggttgcagtgatccgagattgtgccgtcgcattctggcctgggcgacaagagcaagactccatttcaaaaaaaaaaaaaacattgtattatcattttctttggcttcttcttcagaaagaaatgcagaagaatctccttcaattgaagacagaaagggattaggggaaggtcaatgaatagaattttccataaaaatggaaataggatggttgggtggagaatgctaatgtatccacagtggacttatttctttaccttgagtaagatgaggggaccgagcaaactcatcacaggacaagagagaggcaggccagaaggagaggctgcatggggcaacctgagcaggtttcctacctgccaatctctagagagccagatgagaagagatgcattattcatgtggtttcacacgaggctcaacaatgtggtgatagagctggttttgctcccaaacatgagctagtttggtgagaacagaattagctgtggaaaaaatcttctctgccatcttaagcactaaatgattttacatcaagtacttggcaatatgtggttatggcataaaaggtatattatattctttatgcatccaaatgtccactgctgaataagaggctcaaaaagaaactccaaggaagcttaagtgttcaaacaaaataccttagctggctaagggccttaaattagggatatagcttggaacctggtggatttaaaaccacaggtgctgtgaccctttttattttgtaaaaataagcatttccatgtcaagcgtattccatgctgatcttgatctattcatttgtctatacacttgcaacatttctgagaacatttccacgaacagtcatataaataaattttagaataaagaaaattattattagacctaaaggaagagatagactatagaacagtagggaacttcaacccccctttaagtgtggacaaattatccagacagaaatcaataaggaaacatcagacttaaactacgctccagaccaaagggacctaacagacatttatagaacattccatccaacagcttcagaatacacattcttctaaactgcacatgaaacattctccaggatagatcatatgtggccacaaacaagtcttaacaaatttaagaagacagagtcaacatcaagtatcttttctgacaaaaatgctattgaattagaaatcaacaagaaaaactttggaaactttacaaatacatggaaattaacatgctcctgaaccaatcaatcaacaatttaatgaaattaaacggcaaattaaaaatttccttgtgacaaatgaggatggaaacacatcctaccaaaacctatgggacacaacaaaagcagttataagaaggagtttatagcaataaacacctatatccaaaaagaagaaagatttctaataaacaacctaaaggtgtacttcaaggaactacaaaaacaaaaacaacctaaactcaaaattggtagaaagaagaaaacaataaaggtgtgtttattttttcaaaattctcaacaagatactagaaatgcaacagcacattaaaaagatcgttcactatgatcaaataggattcatcccagggatgcaagaattatttaatacatgtaaataaataaatgtgatatatcacattaacagaaccaaggataaaaaccatataatcatttcaatagattctgcaaataagttgataaaattcaacatccctgcatgataaaacaaaaaaaaactctcaacaaattaggtatagaaagtgtgtaccacaacacaataaatttaagccatacatgacaaacccacagctccacagctaatatcatactgaacaagggaaagctaatagcttttactctaaggtcaggaacaagacaaggatgcccactttcaccacttctattcaacatagtactggaagtcctagtcagagtgattaggcaagaaacaaaaacaaaaggcattgaaattggaaaggagaaagtcaaattgtctctgtttgcagatggcatgatcatataaatgggcagccctaaagactccacacacaaaacaaagcctgttagaattaataaatgaattcaataatactgcaggacaccaaatcaacacacaaaaatctgtagcatttctatacactatctgtacagaaatatactagctgaaaaatcaggaaaataattctatttataatattaatagctacaaaaattagatatgtagaaataaacttaaccgaggagataaaaggcctttacactgaaaactataaaacttcaattaaagaaatagaagaggacacaaataaatgaaaatacatctcatgctcatgggttataataattagtactgttaaaatggccacactacacaaagtgatctacagatttactacaatccctaccaaaataccaatgatattcttcacagaaatagaaaacctatactaaaattggtatgaaacaaacaaaaaaaggcccttaagagccaaagcaatcttgagcaaacagaacaaaactgaaggcatcacactatgtgacttcaaaatatatgacaaagctacagtaaccaaaacagcacagcactagcagaaaaacagacactagactaatggaagagaatagagagtccagaaataaattcatgcacctagagccaacttattttcaacaaaggtaccaagaacttacactggggaaaagatggtcttttcaacagataatgctgagaaaactgatatccacatgcagagaatgagactagactcctaattctcagcatatacaaaaatcgactcaaaatgggttaaagacttaaatgtaaaaccagaaactttgaaacaactagaagaaaacataggtaaaatgcttcacaatattgggctgggcaagaatttttaaaataagacctcaaatgcacaggtagcaaaaccaaaaatagacgaattaatactaatattaataggcaaactattaatagactgagaagacaatctatagaatgcgagaagatatttaaaaatgatacatctgacaagtggttaacatccagaatatataagaaactgcaacaactcaacagcaaaaaaaaaaaagttccgattttaaaatgtgcaaaagaccttacttgacatttctcaatacaagacatacaaatgaccaacaggtatataaaaaaaatgctaaacataactaatcatcagggaaatgtgaatcaaaaccacagtgagatactacctcactccagttagaatggctattgtcaaaaagaaaaagaaaagtgttggcaaggatgtggagaaaagggtgcacttatatactgctcatggtattataaactagttaagccattatggaaaacaatatgttggttcctcaaaaaattaaaaatagagttaccatgtgatccagcaatctcactcctaggtatatacccaaagaaaattaaatcagcatgttaaagagatacctgtacactcacatgtttattgtagcactatttacaataaccaagatagggaatcaacctatgtgtccaacaatgggtgaatggatagagaaaatgtaacacatatacaaaacagaatactattcagacatttaagaaaaatgaaatcctgccatttgtgataacatggatgagcctggaggtatcatgctaagtaaactaatccaggcacagaaagacaaataccacaggatctcactcaaacatggaatctaaaaaagaagctgatatcatagaagcagagagtagaatagtggttaccagagactagggaggggaggaggatgaacaggggagagaatggccaatgggtacaaagttacgatgagataggaaaagtgaattctggtgttctattgcatagtagggtgactatagttaacagtaaaatattgtatattacagaatagctagaagagaggcttttgaatgttctcaccacaaagacatgacaaacgcatgtggtgatggatacacacactgccctgactggatcattagtatacagcatacacatgtatcaaaacatccaattgtatcccatgaacatgtacatgtgtcattacaatgtgtcaactaaaaaattaaataagtaattttttaaaatttgagagctttttctattataattttaagtgatagagcatgtctggtgttgagggcagaatctgctaatgtgtaattatggttccatagtgctgtatcttcgggtaatgtcttaattattcttaagttccaacttttggtattatattatatgaagccccattcaatgtgccgttgaaatctcatacttggcttctattcttttcaacattgctacgcttaatgatgtaattccacgtatgaggtgacacatcttccagtaattggggtgcatcatccaggtcaaggccagctgtgtaattttcagtatgtgtatccctagttgacatgacattaataaacatggtttcatgatctatttgtacaaaagtatgacagttatgatatttttgaattttaccaataaactgttctcccatcaaacactctgtcttccttcaactaaacaattagacttcttatttatacctttttaagtgaatccacacaggtaagcatctgaaagttctctttggttctaagatgacatttatcgttgggttgatataaaatttctaactgggtaacaacaggcatttaactttttagcctaagaaaagtgaaaattttaactaataggttatagagaatcttatttgacttgctccaataggaagcacttgatttaaaaattttaagtaacagctcttaataagtaataaactgctgataattcacatctttgtgaactcaaataattttaattaaaatatttttgatactggactattatttatatcacaatgaataacagtaataagattttatgaatatgcaggtcctatgtaatccctctatcgcttcattaaacactggctattcttgcagaggattacgttttttttagagactattttctctacatgtgtaactatttcaccacattcttttttctttttatgttgcagtacttgtcatcttcatgaagatatttagcaagtttgctccttgcaacatatctatgataattctttctttattacaagctgacacatacatcacagaaagcttgttttcaacactcagtttgaatagcatttatccaaaagaaaatccatctgactatcatcacagcagacgttggccatttctactggtttataaaaatgtgtttaaggggttgtcagagtcaagtgtttgtgttggtcaaataactcctaaattgacagtcattcatacatttgagtttgaaataaaaattcatgttatttatttctgcttaatagactttaccacaagcaaattcatgaggcccacacattccttgtttcactgtactccttattttataagctctggttttgacaagcctcatctcacatgaaatgtatattttatctaaatagacaccttagttaaaattgtatctctttacattttcatcatgcaagaggtataaatgcccaaatattagggggatggtcatgtaaaagtaagtctgtcatttctgctgcagttcacacaattctgcctcctcatctagggaaaggacactggtggccttcctctctgttatactacccgcctccccctgttaatggtcctgcaagaaagatgtggctgtcatgtctggtgatgggtactctccgggagctctgttgaccagggaccactctgtggcacaaagtgaccctttcaccttttcctaggctgccagatctctggagccaccatgctggctctgtctccctcttggagtcctcgggcaggtgggcactgctgtactttctatctgcctccctgttcaaagcactttctatctgtctctctattcaaagcctggggccagggatgcaggcattgctgtccccagagcccatacccttctgctgggcctagtaggggacaaaggtctttggctcttatcttgcaatggctggcagacgtaggtctggggcaggaggatggagaacccctttagaccatgttctctaacacagccttgggtgatggcatgcctgttcagcttcatgaaatcctattgtcaatagtgaaatttgtttctgtcaccatccacaagcctggagtagaggagaggtgaggagtaggacttgggtaccctgctccttggacattacatagatgttcctatatgcatgctcaggaggtctctaacattatggctaggtagctttttgggttaggaaagcctggaggacctgtttgattacaaaaaggtagacagtagtgcgcatctgagttggtacccaagatttaaattagtcttcataataaagtaacaggcatggatggattacttatgacagctaagaagaaaagagagatgaagaaggaaggtctagaggagagataggaaaagatggtggtaggtggagtctaaggggaaaagctaattgagaaatcctctttggtgggaaagttaagagatctaacatatcttatcttcaatgtctgaagttttttttctggtcttctctgtgcagttatctccctgactatctctcagccctagaatggtctcttactcatgttagccttagtggtgttttgagtaaggaaagcccaggggtgaggtcagcatggggcagagcagggcagaaagagtagagtggccactagagccagagtcatgcccatgaacccgagctggtagagcgtacagctgtagcaccgaatgaggagtgatcacactcataccttcccttggtgtgattccatccaaatccacacctttccatgccccaacttgctacccacaaaagagaggaaggccactttagtagggacatgagcaggagagtgaagggcaactcaatccctcatttcaatgtcttcaggttttttttggaatatgcatgtagcctatatgatattaccttccaataccggttaatttttcagatgtttatgtctttctctgaaacaaaattgaacatgcttaaggacaaggagtagattttaagcctctttgaatccgccagtacatctagcacacagagtatcttaaacagatattatttaacaggatatagaagaccattaagctccacagatgaaaataaatgtctatctattttgtttttaaatgatgatttttaccaatgcagtcaacgaagcccaggatctagggtaagactgcctacgtatgaaagtttgtttatttatttatttatttagatggagtttcactcttgttgcccaggctggagtgcagtggcgcgatcctggctcagcgcaacctccatctcctggcttcaagtgattctcctgcctcagcatcccgagtagctgggattactggcgcctgccaccatgcccggctaatttttgtatttttagtagagacggggtttcgccatgttggccaagctggtctcaaactcctgacctcaagtgatctacccacctcggcctcccaaagtgctgggattacagatgggagctactgctccaggcctatttatttatttttaatagagatagggtctgactatgttgcccagtctggtcttgaattcctgggctcaagcgattctctcatctaggcctcccaaagtgttgaaatgataggtgtgagccaccatggccagcctgtgtgaaggtttaaagactggttccacacaacccgtgtgaccttcgcatattactcaacatctctgtgcctcggttttctgatccaaaaagcaagcaccgagcatcataacagcatctccttccaaggattgttctggtggttggtaaaatacccaaagcatttggcacactccctggaagaagttacaagctagatgcttccccaccaaaggggatttctcagttagcttctccttttaggctccacctaccaccatctttttctatctttcctccagccctttattcttcatcctacctttgtttatctggcctcacatgcttgtttcaatgacaccgtctaataattccctaactgttgaggcatgtctacttttcttcattcccaagtgttgaccccttgaagggaagcaactggtcttcgatctttctgccccacttctcttgcagtatcatctggaaatgccttatgaattgtactgaaagacctccacctggtggtctattcttaagggcagaaagataagaccagttgctcgggtgccctcagccactcatctgagctaagagccagagaccatgaacattttcaggctggtaggcctcataagaacctgtcctcttctttcaaggagttagggtgtctgctttaggcctgcaaacctcttagagttctgtatcagtggtctccagggtagcggtatgtacaacacagatgacccccacaaagatattgggaagcaaacttagaatgtttttttacggctactggataactatatttaatccttacttctttgtaatctccatttttatgggtgttattctagacagaatttaataatattatatatgatgtctttaatatctaaataaaaagacatatacacatattaaaggcattttctcatacatgcaggttgtgatacagtttctgtggctgtgaaaatgtgaagacatgaaattatatgaattaggtatagacacaggggtaaccttggtggatgcagggaagacagagtttgcggctttatgcttaggagctggagagaggtagtttctcctcctccacttgtggtcctaagaggtcatccaagcacttctggaaatttccatagtattacgtcaatcagcatgttttctcaaaattgccttaagttcaaaggtgcaggctgggttggggtcttggacatctgaatgtcacaatcatagcacatctctgccacatttattaccaggaaaagcccccagcaaatgggtttcacctttgaagcagttagaaggttactattgcctccctcataggcggtaggaaaaaaacacttgttcattctggatagctctccattgaccgcttggagcaggagacgacaaatttttcctgtcaagggccagatagtaaatattcttggttttgccaagagtctctgtcacgggcactccactctgcccctgcagggcccaagccaccatggatgatacataaatgaatgggtatggctgcatctcagtaacgttatttatggatactgaagtttgaatttcatataattttcacatattacagaacattaatcatcttttgatttttccccccaatcatttaaaaatgcagtcatcattcttagctcatgggcactactaaagtagattggtgagctacaaatggcccatgggccattgtttgctgatgcagactcagaaaaaacactatcacactagagttttctttttttaagtatggatatcttccctgtgtttaatgtgatatagatgaattaaagtttttttttcttatgtagctaatttttcattaaattcctggaagtttattaataaaggataattctaagaacatgtgaatatggaatagagaatcaacataatctcttttgtcagtttttattcaaattagatattgaatgtcactgtggttatcttcttcttttataagatgtgcataaaaataaaattaccttacttaaaaacatgcaaacattaaatgctaaagtagcccaactccaagcaggagtggatctaacaggctgaaggtgaaaaaaattctgacagaagaacaaataggcattctttatcatcaaaaccaagatatgtattattaatattgggtggcatttatgatgtcaaaaataaaataaagagtattttgtgcctttctccctatgattcagtgaaatactgaaatgtaaatatcaataatcaactataaaagcagcttggcttgccttgatttcaaagcatgtaatttagcaccataaggcagtttaagaaaattgctatgctctacttagtggtcactagaaattccagtagtctgaggatgtagagatctgcgtgccaggttctgaagcagagagccagctctgccagcctcagtccctgccggagctcatatatatcattaggaaagaaggagagagctgtactgtctgcagaccagcaacacagtcattccagtttacttagcaatgtgcagcttgataataaatgcaattctcaacctgtttttaattatatcgattttggagttaagataagtgttctctagcaatctaattatgacatttgacagattatgttgcaaatggctccagatactggaaaacacttgcgttttgtcgtgtgatctgtggttgtattcaattgaaaatatatatttaatccaggagagctatataactgattgaaccatttgcaattgccaacatccaaccttcacacaataattttgtgattcaatctattagtgtatatgaaataaattgtctgcctttcaaaatatgctacatgtttagtaaatatgtttttgttccaagcttgccaaataggtagacaatatcatgaaaaaaacacttaccatcatcaagcatacgtctttcacgtcctacaaatgactacgtccttggggtacttagattcattacgtaagtgaataacgatgggcttaacattagtattgcttctttcaatttttctctttgacaaaatgagcttacaatcgccatttgcttcctttcattcagattataccaaggtagcctgaattaaagtcatattctgtttctaccattatcattacagacattgatagaagcaggtcacagtgcttgtggggatagtggacacagacacacacctttcatttgggagtgttattgaagctcccgcgcagagcccaccccctgtggacaggccacccagtggggtcctgattacacacctgtgctcgtgcggtaggtgccggtgtgtgctggcggcagagggtccccctggctctggctgagactcctcatagggggcttctgatagacgcggtcttcatagatgggatctatgtggtgttctggggactgcagggcccgcaactctgggcccaggtgcccatgctggctgctgtatgaggctcgggaaccagctgaaataaatcaacagagggacatcaaagctcaggcgacctccaaacagaacttgtttaatcaaagacatattcaaatttttttggacaaaattgttgaaattcccaggaaaccaaatgaatagcatgaaatggcagcaatatgtcaacctaatcagcctgtcggcatcacccagctgcctggctttgcgaccaaacatgatctcactctaaaaatgacaacgtttctgagataaacccacatggaacaagaccagtgaaatgttatttttctcaaaacctaatgaatgtagctaggttcttcactaaaggaatcaggtagatagtcagtcctaaaaatctgttattagcccatagcccttgcaccttaaattgtacaatagaaattattttaaatggcgagccacaatggcaaagccatcttgatgttgttcctaaaaagtgaactagaaattgttcccatcagcagtttttccctgggaaaaggataaagcaaaatgtttgaacttacaacagcctaaatccccgagagaagcagatattaaagaaagaggtttcaagttatattttcctttactctgaccctctaaattgaagcatttacatttagcctgcctctctctgaaaaagttaggaatgattgccactaactggtttaatgtataaattgcggctacacaccactttgctttgtagtatttataaatccttatttgtgtcacttcattgcatgatatgggaagaggtgttgatgtgaggcaatgctatggaccagagaatcacgagaaagtctctgaagaaaggaagcctctgtacatcaggaaataagactttagtgagggtgaagaggctggcttgacagacaggaaagaggacgttgattgagagccaatattttatctgacgtacagtcagaaccactggagcagaaacgtcacgaaaatcatttgcgttggggcaatgagatggccttggggcatcaaggagaggtggcatcttccatgttgaatacagaacacggacaagaaccaaaggagacaatggctgattttgggaatgagccttcagctacatcctacaactaatccccacatggcgtaatgggatttaactggcaactgtctttcagcagccctagttcagcctctctattccggactaacatatcagggtgctgggattccttgatcttggccatgtcgggacagctctccttccattttgccttcctcaaggaccacttcaaagccaaagtcttcaaatgctggatgttaggtctgttttgtcaggaacatataaactcaaaattgtaatattcttgtctagaatatttgagaaaaaaagccattgtaaagttttaaaattgccaatagaaaaatgttttactggtatatttaacgtgggctactttaaatttaagtacacagagaacagtattcctgaataattggagaagtggtgagaattctatgaattcagtgttaataaaaaccactgagtattttgaggaggagaaagggacagggcaggcaagttccttaccattctctttgctggtaattaaattctgatttagatagcgctccgatgaatgacagattcaaagtaactgttttgcataattaggttcatcgcatctgatctgtcaaatgccaacatcactctgaatattacctcaagcttaaattttccaggaatatatttaagtacagtatgctttgagttcctgttgtcaattcttattcctgaaggttttgaaaatattgctaaggatttaaaaatgtaaaaataaaaaaaaaaaacagtcatcacatccaaatgcagagataaataaaagttatccatcactggtacatttagaattgttactttatcactattcctttattctaagcctcaaaaaaacatccaatgatgaccaatgagaggatctgctgaacttttaagtggtaacatggtcttaggctatatgtaaaaatcctcttattacatgcatttatttggcattcagaaattttcattagtggcattaatcaaattgatgaccaagggtgctaggcaaggaagaagaatcttaaggtaaagtctacctatgtggatatcagtcttttgatgtgctgatattattacgaatataataatcaaattaactatctgaataggatactatacttttttacatattagagggctctgagtaaaactataagctcatagtgtttccctgtgtaaatgcttgtgcaaaatacagttgcatatgtaagccttatgcatagttctgaatcagataaggcattttaaaaagaacattatttacacttctttttatccactgtgatcaagttttgattgctcaagggtgggcacagttattggcaagagagacacagagaactatgggaaagaaaagggccaaggaaacaaaggttaaagatgtcactgctggaattcatgtgttcaaccgcccgtgttcaagaaagaacattttagatccatatgaacaaggcctattttatttggggcaatttcaagaaaaaattctcacacaatgttttctgggaatctgctacaaaatgtcattagatggtgtatatatttgctgattcaaattaaatgtccttttgtttagtagtaatttttttcatcattatggtctatttgaaagtgaatctcaagcgtcacactggactcaaaacgtcattcatgagaatttacatctttgccagggactggaactctgttattataataagaaaaaatgttggagaaaattcaactttgtctaaaatgttatagatgtcaaggccaaatgttcttgccaattatgctggtgcagaacaatcctgggaacctggccttgaccaagaccctgcaggatggcaaagtgcaatcaaaacatggatgagccaaagagaaaaggggaagtagatccacagaccagaccaactttcctgatggtttcccctgccatgacagacataatgtcatgcaatcataatccctgtgtctataaagcatttcatgaccaattaccgcaacaattcctacatcatccagcattaacgtctcaattttataatagggttttgctcttcctatttcttctcttcacagggcaaaactggggcctagagagctcaggcactggcaatttttcatatacaatgcgtttctgaaaatgagcttgaagactcacagctgaaacatgggtacttggcttacaggttaaggaagatttcatgatgcaggaggactaaagggtattggaatttccctagatatgttctgtgctgggtgctgctcctataggttcagagagccccccaaaactgggaagggctttcaagctgatctaggactaagcctgaggcatttgctgtataagaactaccacatatcctgtcatggaacctcagagccatctcttcttcaccacagctacaggtgacctgaatggatgcttaaacagctcagaacctacctgactactgaccacttggctgtggggttggtgttgggggagcgaggaaagggttcagtcctatggcagggagggaggtatagattctagggacccagagaggtgggcagaagggaccactggagaatgaagggacacaagacctcagacatcccctgcttctatgttgacacgtttaatccttggctctcatttccatgtacaactactatgaagaatcatgacaacatggctcagcctcaaattctacacatgaaaggtggcctcagggtgttgatgttcaatagtttgaggtaaacagaaatggtatctaaagtagtaattttcctgctgtttcttgtgtcacttttgcccacagaacttgaaataagaatatgtgaattctgtcccagatctgtctctaaccagttggataaacccaggaaacacaccaaactctttgatccccagtttcctcaagtgtagaaacagagataataatataaatggtattgttggagggtcagatgagagagactatgtgtgaaagtgctctgcaattgataaagccacatcaaaataggtgtcctcatgccaatgaatctttgaatcaataaattatgtcacctcatgcaaatatatcttttgatttgacaaaatagttgaatacctcttaccataaactatccaaatttcaaaaacaagttgaagatttcattttgaaataatctaaataacaaccatttttctgataattctgtgaagtattattgcaaaatgtgaatgttatagttttatcttttcttaaaaatgtgtgctttctaatggattattgcaaaaaatgtaggaatgaatgacgttcataaggaaagaaaacactgaaatgaccacaaaaaggtgacatcctttttagaaaggaatagggcataaattaaatctccaaattgaaaataacaaatacctgctaattcagtaggaagccagtgacagatctcagggggttcttgacacagaaaataattacaaggctgaaaagggctacatatggctcaccgccttgtgtcttgcctgttcctgttccacaccatgttttccttgagtcaacaaggctctgttttcatttggccaacaaaacaatgtatttattatttttggaacgatttgtaactaaatttctatgtactagattttacatctatcatttgtaggtactagttaatcctatggatctatatattcattcaacacattcaacaagtgcctgggaacctccaggagttgaggatgtcctagtgctcaaaacagacaaggtccctggctttgaaaataagttattacatgcaggaggatggaggtaaaggtgttgaagaaaaatgaggcagggcagtgagaaaagagataaagtgtcaggaggttgtggtgttgggatagggggatcaagaaagttctttctgagcacctgacattttagcagagagctgcagacagtaagagaatgagcctcactggagaaagagctgtatggttctcaggcggagggaaccagcagcagacacgaagggtccctccgggatttcagaatatacacagaagtgattttatgtgtactgaaaccacatcatctttaaaagaaataccagtaagtatatgaaatctttacgagttcatactacaattgattggacgaatgaaaggatttttttaactcaaaatttcaaaatcacggaaacacatttttattagaaggatttgcagcattcaatgggagatcacataaccttgggagaactgcatagctgaaaattcagctccaactacttgggttttttttttttttttacatttcaattttcattccttagaataggattaattctcaaatcttagtttattcctcaaagaatcatctagaaaacttgctgaaaatgctgacttctgaatacaacccccaagagattctgattaggtcagccaagtgggatgcatcaatgcacattttaatgggcacccccgagcctcctggttctaatgctgggatcacactgtgagccatcctgtcccaaataaaggagaaaaagaggagatgggcatatttattttcaaaaaataagcatctaatgtgttacaccttccatttatcatttgttgctttattcaaacaattccacttaatacaggttatgccaattattttactacattaataaaacaggtccatgctggattttttaaattggaatccattcatattattttatttatatactctataatctatgactctctaatttaatgcaaattcacctgcctttacaaagaaatatatttttccatgttttcattttgcagtatcaatatagtttataaggacatactgctatgtaactggtgtcttcaaatttagcatccagtttcaaatgcttatttgcaaagaaatggagggagaaaaagaagggtctaaatgacatagtattcacatagccagagtgagcaggcttaatgtgtttgtgaacagttctttcattattgagataaagtgctgttgtatggagaaaaaagtaaatttcttatgatatgaagaaaaatccaaaataaaattgaggtttttaaaaactgtaaggtcagttaatgcactgataattattaacgaaactacaactttgaagggcaaaagggaacttctatagagaagggtggggcctggactagatgccaatttttcccttgcaaatctacactgctgttgttcctttgtggacatcctgattttaggggtatgtcccatgatgataggtcagcatcgctaggcaacatggctttgcaggtagtcagcctgtactctatgatagttgatggctttgaaatagctattttctggactttgaacctcttaaaatgtttggcttgatacctgttatcatgaaactccaaggggaaaaggtgatatcagcatataaacactttgagatatacaaaaactaacataactttggttaacattatctcagaaatgtgtactaggtaaattgttgagaggtgcaaatattacatcttagatctgaagaatacctcatcataataaaacttatctcaaagaaggcacattaagaaaggtgtgcctcaaatgctacttcaggagtatccatgaggaactgggcacattcacatccttccttctgaactctgtttcctgagattgacttgttttattcttgatttttgcttttgacctaaatcaaaactccaaagtctccttcctaatcctatgttaattcaaaacttaaatttgctatttaaagggccccaaaatattttcctatgtattctgaatcaagcctatcaactgaatttcatttgcaaatgatcattactttgttgtaattaatttgacatcttatatcatgttgttataaatgcaaagatataaagacacatttctcatatagattgagtcgtatttcagacttacgtttggaaggaacattgttaattcatatgatttcaaagataaaattgcactgaaaccaaataattccagtgtaacaggccatctgataatataaaatgatcttattataaatctatttttggaaagaaaaaaatgccctcctatttcatcatatttcataaatgttagattttcttatactaacttagtacagctttgctgctttcactaataacttgaatactatgcagtctctggcagcgtacaaaacacagaatttgttcccataactttgctgatgaggttttccgatacaatttattgtcatgatgaaacctcatcacaccttttacaaaatgaatactgtaaactattgggactcaaatactttccagcaaaaataatttaaaagtcaaaatcactgcccaggacatcatggtaagtgtgtccatgtgatctcatccctagaaaagtatatgccccttgttcctgtactttctttttaaccacaagcatctattcccaaactgttaggaaaacaggcttcctttgttcagttctttttgtaacaggcaggcatctggaaaataatgatagtggtaacggagtataatgagtaatgtggggtcctgtgtcaagctttgcatttttacttgcagtggaaggttgttcttcctctctagtgaaatggatggagtgtaataccccacccctcatgcacggcttcaacttaacaaagaaccggtaggaacctatggctaaggtggtactggtaatagtaaaacatatgaagtacacagggatggtttgacacctgcaaccaatatctgttctgggtttcctatctcacaggaagtagaaagtagcaccaaatttactagccacgtattttggtgtttttcaaaatgccacaggcatatgaatgccttaattggaatgcaggttctggctcagtgggtttgaggaagggcctgaggttcttcatttttagcaagttctcaggcaatgctggcgctgctggtccacggaccaccctttgagaagccaggacatatttgtctagctatgaatacatatctggtctctaggagccccggagacagaccatcaatgccgtggtctctcctgcctcagtgctaggattacaggtgtgatccactgtgcccagcactcctgctttgttaggcaaacacaagtggcctcaataaaggcacagttcaagagtatagctagacactggcaatgcaggtgctcatcagcttgggctctgcaagcacaagctgtgctggccatgacaactgtgaccattctatcagctgctgcagagtgactgatcttagctacagttgtccgggccccacaccagggggacttcaaaggccttaatgagcaggatagctggggcaagagtcacttctagtggggaaagagcatctttctatctctagggtggactttttttaagacagggtctcactatgttgctcaagctggtctcaaactcctgagctcaagtgatcctcacacttcagtctctccagtagctgggactacaggggacccaccaccatgtctgggtcagggtggatattttagacatgggtgggctggaacatttttgctatgattatggtgtttcttgggtgattctggagaggcaagtatctaggttccctgcattgccacaatacccacataggtaaggatagctcagggcttctcaaccctgaaagaacatgcacagcatttgaatgggagactttttaaaagaggaatgatgctgtggctgcattccagaccaggacctcaggggaggggcccagggaatggaatagttcaaagattctccaggcttctccaagaagcatccaatctctggatggccaggggtcaaactaatagatttggggctagatgtaggatcttgaggagcatgtgtcaaggtttggtcctcagcagactctttaaggctgaagcttcagaatatccccagaaatatccattcctgaaagtgagggaaggaaagaacctcttcttagatgaggttttagtgtcagaaatttgcgggtacctttgaaagtagaggctgctttttgcccctggcatgctacacctaggggcatgtccctagcatgcctcctgctgggaagtccctgggaggtcacaggttgtggccaggcagagatggcaggacatttcctgcctctgccttttccctttccttctgcaggtctctgggctggatcaagccttatgtctgaggagggtggggtcagtgctgtgatgatcacgtgtgtcttgtgaactcttgctataaagaactactgtaaccatacccttcaagtgagagacagtcctgactgaagctagggaaaagacccctagaaagactctacccaggcaccctaaacccttctcagctgagaccaggtagaataagaaattatggagtgattgaaattttgaatttgtaatatctttgtacagaagaacaacataacttgacatcagacttgtaacaaaagtcttttgacatgagcatgtaaagaaatttaatctatgaaggttaatttttacctgggagaaggcttgtgtttaagatttgcttcaaactacctctcctccctgggagtagcttttggcagctactaggaggagtgggcccagagtcttcaccaccacaatcttctgtttgtcctgattaactacagatgcagggcgatctatgactcggtattttattcattagtgacttaccagagtttttaatgggcatattcacacagatactcttccttatcaaggagggggataaaattcaacaagtggcattttatttctcaacagctgtgtctcaataccccatcagtgcaatattccaacagtgcatctggagtctggcttccagacctcattattatggatcactacgaatatttccatggaaataatccagaacaaggtgctcccaatctactttttttttttttttttttttttttttttgttacatcaagatgcaaagcagacctgtgggctgaagcttcagagagcccagaagtctccattctgctttccagagtgctgactgctgtgggaactaagctaagtattcatttttgattatgtggcttctgcccatcaaaggggtacagatgaacttttcaaggtatgaacaggaataaggcttaacaagcaagaataggattaaacatgcagttgtctttgtaaatgggttcaaatattttgaaaaacatgtaaacgaagatgttttacatctcaacatcctaaacagaggcctttttcctcagattgcataagataggtaataggtaggctgcagaaattccctttaaaccattagacatttagcttctaaaatacaaactgaaaatgtattctccctatatcattttcttctacttctttgtatctttcaccaacactcagagtgacctctgtcataactccagaagaaaaagacaccctaactctcaacataatttagagggaggaaacgacaagtaaacagcttcacagattagtaattctctgtacttatattttacaacttctctatatcaacattttattaatttttattattttattcaacataatattcagcatatataaaacgagttggagaagagaggaattctgttatgtaataaacagttctaaggagaactaaaattttcctttgattcttttcctctcaaaagctttaatatgtgtgtatgtgcatgtatatgttaaagttcaattagttattgggttatgtatgtataatgatcatttgaatcgcagttgtattcattaaaacattaattttctagttgaatacaaaattgatgaaaccaatctatagccaaaattctctcacctcctttttcaaatgttgtcattatccagataatactgttaaacaaccaactggttttgtaccctagtgatgttagtgatgctttctagtacagaaagtcaatttgttttgactacatacaataaatactacatatctgaaaaaagctaccaagttgggggaaaggggactgtttttcgtcatgtgaataacaacaagcgaactgactactagggtctaaatgtttgtgctctcctcgccccccgattatgttgaaagctaacacccagtgtgatggtgttaggaggtggggcctctgggaggtgatgaggtcatgagggtggacatgtcatgagtgggattagtgcccttacacccgagagagcaaggtgaggacacagcaagaaggggccatcgatgagccgaaaagtggaccctcatgggacaatgaatctgccatcacctttattttggactttccagcctccagaactaggagaaataaatctctgttgtttgtaagttacacaatttatgatattttttatagcaacctaaacagactaagacactgactcagccatggaaaaagctgtggcattatctgcttctaaccacctgagcttaagacctgagtgatgaatgcctttgtgtgtgtgtgtgtgtgtgtgtgtgtgtgtgtgtatttcttattctaaagagaaataaatactgacttcccctttctacatcaattttctattttggtctctctttttcatgccactaactctttccaattcctcagtaatctttgataatttatcatatttgagaaagaaaaatccagtgacagcttctttccacagtgtcaagggcagtattttccactgtgcattctcgagttagaatttctggaggggaaggcagggcattcagactggcagtcttccttcagaatgagtggggggttgggggagcagtcccaacttcctcatcactccatacgcttgtactatctaatgtaaaccagcatctataacagaagtctagaagtttcttcaagagaacacctctcagagtaagcactggctacagggtcgccattttggtaggagagatgtttgtcagggggtgtcaacctagaactgtcttgaacactgactttcaatgaatccctctatcttcagcccatctctccccagccccaccccctcaagctcagctctgacccttgggcctgtccaggaattcacacaagacagccagtccacctccaaagtccagacagagctcattctcaaaagatagcactcctatattttaattgcttatcactctactttctagaaattcttaacttggcttgcttgtcggtgacactcagaccctggtctctgtgtttttgtctcctttttttttttttgagaaggaggctcattctgttgcccaggctggagtgcaatggcacgatcttggctcactgcaacctctgcctcctgggttcaagcaatgctcctgcctcagcctcctgagtagctgggattacaggcacgcgccgccacacctggctaattttttttttgtattttttagtagagacagggtttcaccatgttggtcaggctggtctcgaactcctgacctcatgatctgcctacctcagcttcccaaagtgctgggattacaggtgtgagccactgggcccagcctctgtgttttgtctcttttgtgacttcattccctattgtattcctgtacttttattttttgaggtgtccgggaaataggggaaacaaatgagtgggcagaggatgccatcttgaacaattatcttaggtagttttcatttttttagggcacattttctcagctaaagcacaactgaagtcatatcaatatcaataatattagaagagctttcacagaattctatataaagatgccactttcctaccaaagaacaaaaaaaggatctgtttacccgcatttgatttacaaggatgctatgaggtaggaaaagaatggtagatattaacttctgtgaaggaaacaaaaatgaaagacaccaggaagacattttgggccacctcgcaatcccaactcttagttccaggcttaggcactaacttgccatacgggagtgttaaaattgcactgttcccacttcagtttgacctggacatcagttggatagaaattggataggaaggtaagtagaatagaggtgctatatcaaatgaatttacaaaagaaatgtttgattaccatttctgttgagttctggacccgtaggcagatgaatgctattagactgggcttagcatgtataaaggatggaaggtttgctgaaccttcagcaaaggcagacctcatgtctgccttcctgggaggtggggaattccagagagatgagcttgcacgaagccactgagatatggattccctactataacatggggtcctggaattccagagggtaagtggctggctgaataactgctttgttggtggaagcaggaaatggctggtgtgtggaaatcagcctgtactccccaagtgtgttgaggtgtaggatgacacaatgcactatgcagaagagagacccatattacattgattctaaagacacctggggcaggcaatgggttcctaatgcttatgaggaaggggctggagcccagaggcatggccagcagggaaggcaatgagtcgctgtcgttgggagagtgcccagttaggtctagttcgaaagaacccctggaagctccagttgagagcaagtcagccttaaccacctttacaaggttaaagttgattgatatcacaggttgatcatattttaattagtaaatgtacactggaattttttaactttaagtgacagtgggaaaatctaaatatctagcactagagtgagcagaatgttcgtgagaactgcgcaatgcttgtccacagcacgggaagattagctttccaaaatgaattgaaaggagcagcaggagccagatatcatgttgcattttgaccccatcccaggagctgtggcctaaacaaactcgttcattaccccagtagacttcacatttcctttgaaaacctcactgcagagattgcgaagctttcatctaggactagactctttttttttctttctcatataaagtgtacctggaagccttaatcagtcagggaatgggtctgaaatctctaaacagtaaagattcagcatttatgtgcacgatccactctaaatactgaattttatgtccatttgactgggggacaagttagacaggccttgaccaaattcctctccatattaggtcaattttgatttaaatcattggttaagagtctccacttcattcatttcaattttacctcaaaataagcttctgatgtttgactcaacttcaatgcatgtctacaactcgtatttcttttcaaaacaggattaatttagctacaaatcccgaaagtgaaaggattatgttattctctttgtaaaagtgaacaaaaattggtactggtgaagttacaatcacacattcaataggatgtcgacagcttttttagatactattattactttctttaaaataatgagtcacttaaataagctgaaaatttatattgcatttctacatccttcgtgtttttctccactgacacaaaaatatactacctctaactatgcatcacgtacatttaagactacagagattctggggtcaaagcgacgtaggttcaaatcacatccctgtcatttctagatgagtagctttgggcaaggaggttatcatccataagcttcagtttttaaatctgtagaatgggggtaaaaatcatgtctgcctcatcaagttgctggagactacatgagatgtattaaaataatacatttaactcttaatttattaaaaaaaaactaaacaaactttgggtcaggaaaaaatataaaaagtaggttctgtcgctgactagcctttttctcaaccatttataagtgataatttttgtattgtcccatttcaaagcaaacgggaaagagttttaagaagcagtgaaggactacttcactggcttccaaagtgattctctgcccattttttctttgtaattccagcctccacacactgcccagaacaaagtttctaacaagcacatatgaccatgtcagttgtctgctggatggataaaacgctaagtccattacagtgggatgcagcagccttatctccctctgcgccttcatgtctcaccacccctaccactctgtctttgctcaagaaacactgagctgccagttgtcttcccctgcctccctgcaccccacacacaccctctcaactctgactttgttctggctaccgcttctttctagttgctcctttatagctttgttctgggaccacttcatcaaggaagcatgccaggtgcacactgaaccccactgtaagatgctccgctaggatgctcccatagtaactagcttctgtctgactctgcgcggggtttaaaactgcccattcctgtggctgttccgaaactaagtctcttgaaaccaggggttatgcctcattcatctgcatatgcccaacacagacactgacatgttctgggattcaataaacctgctgtgtctgaagcaaagatggatgtcttcttccttgcacacccaaggtagtgtggtaggtattactaaataatatgagttaacttctattgagccagaaaatgtgctagtactttacatatgctaccttatttatgtgcaaaagtatatgaatagatacaatggtgaccccttttatcagggaataattttaagccggtgagcaatgagcctaccagccttaaggagctcccccaaggcagagttggctttccactcaggtagctctatatgataaaaagcagatatgatttttttaaataaaagaaacgaaatttttaaacctatccagggatctttgggttctgatgacttaacatctgagaagttacactctgtaggttgaatctgaattgtagtgttttcccagagagtcagaactctgacgtttgtggtcagattttctaaggtttgtctatcaggaagatccaatgcaaactgtgaatgtgtgttgccttaccaagtgcccactatagtcgatgacccgaaaccctcagatagaacttctaatttctggaaatgtttatagcgaaacaagaaaaacttgaaaaactctaacctgcatatatcccactttctaatggctacatgcactttgattctgacagatatcacctatgcaaaaccaagatcttagcatttaccagaactactcccagaccacccggtccctctgcagcccactccctctcaattgatggtgactctattcttctggttgttgggtgggtggcatccttgagttctttttctcttaccttcatcacctagtgcatgagaaaatctcagtggctacaccttatatatacatcaagaactataatacccacttccataacgtccaatgcttccatcttaacccaaaccataatcacctcttgcttaaattactgcaatcagctcccaactgacattcttgcttttgcctttaatcctgatagtctattctccaaatggcagccgaagtaaccctgttacaaactagatcagaatgcagtactcctctgctcaaatccccaatggtgcccatgggtttagcaaaggcagcatcaagttctccacaagacttacaaggcctctcagacttggccttccactcccaccttgctgacctcaagtcatgtgtttgctcttgttctctctgattaacccccgtggtctccttgctactcagcaaacatatcagacacacccccatttataagcccttgaacttgctgttcctcctgcttagaaaaccttctgcccagatagtcacagggccagctcactcacctatgtcaggacagattcaaagttaccttctgtataagtactgtgtactaactaatggcatcactggaatctaaaaaacaaaatattggggaccaggtgtggtggctcacgcctgtaatcccagcactttgggaggccgaggcgggcagatcacgaggtcaggagatcaagaccatcctggctaacacggtgaaaccccgtctctactaaaaatacaaaaaattagccaggcgtggtggcgggcacctgtagccccagctgctcaggaggctaaggcaggagaatggcgtaaacctgggaggcggagctgatagtgagccaagatcacgccacggcactctagcctgggtgacagagagagactctgtctcaaaaaaacaaaaaaacaaaacaaaacaaaacaaaacaaaacaaaactattgggtactatgctcagtacctgggtgacaggatcaactgtaccccaaacctcagcatcatgcaatatacccagctaacaaacccagagaggtaccccctgaatctaaaataaaagttggaaattatatattaaaaagtctcttcctaattagagccttccctggccatctatcataagtattttgataattttctgtcttcctcatttgaaacaaggccaaggattttggctgatttcttatccctaggatctaaatcaatggcagtacataaaaggtgcttaaaagtaattattgaaggtggctaggtgcggtggctaaggcctgtaaacctagcattttgggaggccaaagcgagcagatcacttgaggtcaggaggttgagactggcctggcccacatggtgaaacccagtctctacaaaatatacaaaaattagccaggcgtgggggcaggtgactgtaatcccagctatcgggaggctgaggcgggagaatcacttgaatccaggagatggatgttgcagtgagccgagatcgcaccactgcactccagcctgggcaaccgacagagtgagactctgtgtgtgtgtgtgtgtgtgtgtgtgtgtgtgtgtgtgtgtgtgtgtgtgtagaatgatgaattagtgaaagtcactacatatcctgtatccacccttcctagtcatcagtgacaaatctctaaaatcacaaccccgaaattccaaaagctgttttgccatctcttgacctaactgctctttcaactagcaaaccaagtagctcccaacttcacaacgcctcgaatggtatcaagcacacgaaatcaggcatggaggtcttggagttgcaatattcctaatctctcagaagcatcgagtttgtcccttataccttccctgggccatagtttgcaacctaagcgcaatacaatctatttttacaatgtacttttactacctcttcttagatgcaatgatagaaggagctgttggctctattcagctccattcaccctcccctaacctctccacaggtatattcagccatgtggccacactctcgattgctactgaaatgatagactagaacatgcaaaagtctacacaaatcacccatgggagaaagaactggaagctaagactcctgatttctttcatgaggtaagtgtaagaaatgaaatggcctctagtaggacgcctggactccctgcgcctcagtctcctcttctctgtggtggtgcgcatggctgagaagggtgtcatggagtctcgtaagaactccacccatctcccccttcttgacatgatctggtaacttattttacaaaagcatttacatgaagtttcagtacatgttcactcgcccccttttctaagcagatcgctactcctgagtccctacagcatgaagatttaggtactcatactgggttggcactaataattgtctacctcaaaaattctatttgagagagaggcagtgagtgagagaatattttcatttcagtaaacgtagctagcataattttgtgggcagtggcaccctagcctgcatcctgttaggccaggccagtccacactggcaattactgtgctgaattaaagaagcccttggccacctgcctcatgcatgcaacaagctccttttttaaatcctatttatcttcacagtcatctatttgtgtcaagaaaggaagcatatgagcacagcatctgttactagagtgacacaattaccaaatccttctgtaagggaaaaaaaattcacaataaatccgggttagttgtcaggtgtttcagaagacaaaacattagtctttcaatcatggtgtcttgtttaagctgagcatatggtgctaacagcagagaggcaccagcgcagcctggtcgctgacgggcataacgaccacagaaatgtcacctcctctaaactgggagaggaaagcaggtttctctccccaagcccagcccctccctccctgtaataaagcaggtacaaatttaagggacttcatcattgctaactttgtcgcaaatgttaggacccaagtacatccaatgacaggtatgggagagtcctttagttttcccaataactaatttagcaaagatgtaaataaattcaagccaaaacaaaagggtaataattcaaggcaattcattattaattatttccccactactattgaaaactatgtaagctgaacgtctaatttgagaaaatcccttactttttccacaatgaaatgtagacaactaaaggtgaccctgtcaatactgcaactgttacttgttttgctttttttctggataccatcaacaggtctatgggatgctttcctaaatgtgtcttacttttatgagttagtctttaggctggggagagggcagagagagaagagaggagagaagagagtgatataggtgttagagattgagacaccacattactccggaaaagaagtcactgacaaactgtagggaagatactgacttgttccaggaaagccctggcgttctctgtctcctgcaactactacaacctggcagacagcgcgcccggcttcgcttctgctcaagccgggctgctgcttccgcgtccccgccacgcgcccaggtgagtcgcgccaggtggcagcgagcctttacctgccaggctgcccggcctctggagggtggccgtggcatacagctcctgcgagtgcttgctgtactgctcggacgcgtggaccaggcgcttggtgggcgacagggtggcgtacgtgccgatggtggagctcagctggtggatgggcgaggaggagatggtggactgcacggtggggggcgaggtcacgcggatcggggacaggccggccgaggacacgacgatgttgatgggcgagctggtgctgtaggacttggccaggcggctgggcgactgcttgggcgaggagccgcgcggcgcggcgtaggtggcgccctcgggggccgagccgccgcgctgcagcttggtgggcgaaccgccctggggcgcggccagcggggagcccccgcgcggcggcgcgggcagcgtggagctggagtagtagagcgcggcggcggcggcggcgggcggcgcgtcgggcaggtggaaggcgctgcccaggctgggcgcgaacggctcccgcggcggcggcggcggcggcggcgcgggctcgggccccgccaggtggccggcgcggctggtcgtgccctgtgcccgggagaggagagaacacgcgcacttagcgagggagaagcacacggcccacccggcccagcccggccccgagagcagaggcacaccggggatgccgcgggcgcccggcggctctgcgatcccagctgcgctcggggcagtacgcgaacctgcgccccgaactctcctggggcggatttcttgtcctgacactggcacaggccagctgactactggagggaagtcacgtttgacaaatgagacctgtgtttgcttacatgtagatgttatttcggaaatagcagaagcatcgcattagtcacataaagatttttaaagccccaccccgacagggcaatcatgatctccctggtcgcaatcacaatctgtttgttttaatgagaaattcgggcagtaaatctttttctgtcccccactccccacccttgccccaggtcatttcattagatacactttctacctctgagattggccgagttacatacttatctggagaacatcaagaataaacatacttcttacagtttattctgttgctattgtcgcgtggattcttctttttggacaatgaaaagttaaacggagggaaaaatactaagtcagaatgaattcgcttcgtcttttcagcattaaaaaaaaatctagaggaattagagcaattggaaatgagaatgctaaaaaagcctcccttttctagattttaatactgggctcccaatctttcagcatctttctctctctagctccctttaagagccccctgcagctgtgtcttcaaactgaaagccattcgcctctcatttatttacaagaacacaaaagacaacaagggctggggaggagctggagagacagttggaggggaaagcactttccttgaatcttgtccagagacaaatttgcattcgaatgaaaacactacattgtcaaccacttctgggcaggaggtctcagatcttccaggctttccccggggagcagagaggattttgagagcctgctggtgtgaaaagggagtaggattgtacacagagttggagagaagctgggaaggagggatttgaaatgagggatgagaggtgggtggggaggaggactccagagagatcgagggaagggaggaagagaagattgaacagatgctagccattaaaagtttcaattatgcctctctacccgttctggaatggcaattggcaaataatagactgggcactttcactgcacatacacaggcattccaaattttatctgggatgtcaagttcatatgcagatctgaaggagttaattgagcaacatcaaaattctctattaggagcagcctggcataggaggtaaacagtttggtgagagactttctctatgcagagtgtgtgtatgtgtatgcatatgtatttatgtacggtatatatattttaaatattctcacacacacatgcaatccataaagcaattattttaatgttaagagtgaaagtaaaatgtaagctccatgagtttgttcaatgttgtgtccccagcaactagaacagggcctgattcctagcagagactccaggaatatttgtggaatggttcctcaagttagtctcaaggctatgagggtcttatatgtggaggatgggtaacgaacactacagatgtgggtgtgcttactctgagccccagagaaatagtctagcttcatccagagtcattgagggggtggctttgatgcaattttgcttctctcccagtggcagctctgagcatgaaacatgtattaaatagattgggcttctcaaatctagttgtatattataatctccaagggtgcttttaaaaaaaatctcaatactcatgacttaccattgctatttaattcagcatccctgaaggtgagaccatatatcagttttttttggaagctcagcaggtgatttcactgtgcaaccaagcatgagtcccacgtcccgctagagcagtggttttcaaagggaggtccctgatggtcttttcagcattaaaaaaaaaaaaattctagaggaatcagagcaatcagaatcatacccccaccataaactgaacaaactctgggggaggggctgagggatctgggttttaaccagtactctgggtgattatggtgctggtcaaagtttgccaacactgctccagaagacacttggatttggagggtgcggagtgggccccagagtctgcatttctaacaatctcccagagcaggcaaatgctgttgctctgagaactaccactaagctgcagacatttttcttctgaagctctactggggttccctatcaactggggcctgagcaacactcagccatgcagaacacagctggcaagtgatggaaaagcatccgacaaaaatttctgaaaacccttcccacaggaacaaaatgagaagaaagaaccctttctctaaggtttcaggagcactctctgctccctgtttacaacaaaacaaaaactttttgttatgtcttggctatgtaacattaataaaacaaccttagagtacactaacgatgccattaccaaatagcataatttttaataaatactaactaaagcataccaatgtaaatgagaatattaagtcggtattcattctaatatttaaatattagaacatatatcctgtgaaaaccttaatgctttttacaaatactttatttttcttgtaatctgtcaaaacatctagtctcaggtgtactaagtgctgaatacgactgtctcctatgttttcttaaatgcaccccaaatctgtagaagtcttgacaactgccacatgagctgtagacattttgacaagctacggcaaccaatttgaaagtcttttagatattataggatcttggtaaaattgtgctaataattttggcatgaaaaaaggaaaagtataaacaataaaattttatatactgtttaacatagtaagtggtattgtccactgtgtactaaaatgcacttccaaaaaagcctcctgaatccatttgcataagaagccattatcaactagagcaccttctcaggagcaccagctacactggtgtgttaccagcaatgctttctacaacgtagagaatgttctcaatccgtactgctcaatatggcaccgctgaacacatgggctgattgacagcttgaaatgtggctaatcagctgaggaacttcagtacatacttaactttaattaagttaaacagccacatgtgactagtggccaccttcttggacagcacagttgtctaagctcctctgcagtttacaataaataaaccaggggtgctatactccatttcaatggcttatagagtaataaatgcctaagaactattctttggttaaacagagaaatttgttttgtagcatcatttgaataaaaacaaaatttgggggagcctcttttcacccttgtgcttatgttttctttcactaccgaatttgatttagtaactctttgtcagttaaggttacctgaggctgtcattcaagccagctgcacaatcataggacagtttattactacccatcgttgcattagagataatcgaaacacattccaacacatacagaattgtattcactttagtgtcacaagagttcaattctaccttaaaagtatgttagcactataaagctgcaaatctgattttaaagttagaattcaagtaaagtttcattttccttttttaaactaaagattactacatactgcttccctgcagatatttggaaatgtgtgtgtacatgcaaagacagttgaaataattttttattgatgtgtgactctgaaaataaaaataatgatataacaaatttagatatacttggaatagattgggccccatccttggtcacaccatctaggctgttggcagagacaattcttgactctgtcttcattctcagctctttggatcagtctcagcctcgagggcaactttatttgtctttcccactccttcaaaatgaggaacccatttacgagaaatggacaaggaagcagaatgttcacagataaacaaccccatcaaggagatgttctgattcaacagtttctgataggtagagtatggtgcacattaagtgtagttcagttcttgtttcccttatgggaaatttttcaagaaaaatatggaacattaactcatcaaagctattacaaattattttatctgtatacatatgtttcagatgggtcagatttaggatatattcagtgtcacaatttttacattacatggtgtgtgtgtgtgtacttagtggtatattgaggcctcttgtgtaattgtagatgcattgatatctattttatagaactgtttaaggggaggatgtatttacaaagtatagtagaaaaaatattgaaatgggaagttagggaatatgtacattattccaacagccattaatgaacagtactcaagtttgatgcattaatttactcactgactcaataaaccattaagaagagcctactacagtctgggaatccctactctgaaaatccaaaatctgaaatccaaaaatcccaaacattttgagcactgacatgaatgtcacagtagaaaattctacacctgacacctttgctttctgatggtataatgtacataaactttgtttcatgtacaacattatttaaaatgtcatataaacttaccttcaggctatgagttatgtatgaaatacaaatgaattttgtctttagactgggggggagtcccatcccaagaaatctcattatggatacgcaagtattctaaaatcgccccccgccaaaatctgaaatccaaaacacttctgatcccctgcatttcaaacaagggatgcttgacctgtctacaccatgtacaaatgaggagtttgtttttgaagagctctcaacaattcccttatatggagtattttactttgatgttattttggagatctatcgatggagtatttttgtttgtacagaatactatctggccacaattaagacactgttctttgggggagtaggagcccctaagaatatggcactcttaaaccagaaagtggcactcgttttagtgccaagcacatttgcttccagattctttcacgctgaatcttctatggagggagtaggaatggcagaggagtcataaggggacaattctcagaacttgaaaatttattcaatcctcattctttggggatctggcagtgcaaacaaaacaaaacaaatccccccaatgcttatatccagttaacaagagacctgacagcctgtaatctctaaggaatcttgacttctcatcatgagtaagccctgtcactaagcaaaagcacattttataaagcaggctcatgatttatgagcggtcctgtgaagatgcatttagacctgccaagttttcttaaattgccagcaagtcccccagttctgggacaggaggcctatttgcccaggatgctgggcagccgggccaacagtgtcaggaatggagaactggagccccgttttgtggcttccctgagtccagcttaacgggatcagcagtctgctcccccattcactgtattcatccctttctgttttcctgggattacaatcagactggcaaacctagttactaatgatgtcttccttttccagataatattggctggtggcacctaaggtcaccacagggagcagtgtacccatgcaagcacagggttatgacaggtgcagctggggagcacattcaaaggaaggcacaggccacagggccagggccacagaggagtcaaaatgtgaatgtggccacggactgggggaggaagacattggagctcatgtgtgaggaagatgtctcaatgcagagtggtttaagttgtgacaaggacatgagaaagtaaaagcaatgacaaaatgtactccttcagtgagttaagaaaggcaggatcaatcctgcataataaaaaacagggcatggcttaaagatgacatattcaaagaagtctgtttctactgagagcactctggtaaggtaactgagttatatcagctctgtgctgctgattaacagttttaagaaattgttgcactttcctagtttaagtttgtctagagctttgggcttgcacacaaagacagacaaggcgatttgatctcacaattttgaaacatgaagaaatcaccaactccaaaatgcttacagtcatatttagtactatatgaaatgttcctataatatagtgcaagtaaaacaaatctacatccccaaataagttgtgtgccttgaacttactccctgggatgtaatgaatttgcttgagcatgcacaccattgctcaaaaaatttggaaagttttcttttcaaatcgtcttccaaaggaatgccattctttaattccaaaggaagaaaactctggtactgcgagaaaagtttgattttgtcaataactaaataaaatcatccagggccttgtttgatgattctcttgaggggtgctggttttggtaaaagctaatatgtaacataaaagaagagatagcttctatgcacattttatacaccttccctgaagtcatcaccactgggatcattactgttggtgagaaaagaagggctgggtttacctggtggtgatgtcccactgacactgaaaggtggtgtccacaacaaactgaacttaagtaacggaaaacccaaggtacttggaagaaattcctttcctcagatgggaacatccaaatcaaaaggaccataaaagcaactatatccctggaaataataacagaaaccaccctcgctgctttctctctgcccaatggtcccaaaattatggaggagggggagagaaagaacaagagagaaagtgagagagagaaattttgcaaactattttgtctctgccactgcagttagaaggaggcggcaatggattcattttccccaggtctctaagtcacaagtgcaaacatggtgacgtagatttttgcatccttgagtactgatttttcctacccttttacctccctttaaagaaaactgattaggatcattatcagtaaatgttctgaaaagtatttcatatggccatttctgtggtctaccagtggaaagaaaatagagaagaaagaaataaagcaatgatgtaagtatcttatagatttatcttgaagaatacgtaaggagagatttcttgatggcaactctttcttaaaacctacatgagcacccgcaaaaatatactacacagaactttatttcagcaagaggctcatttaatataactgcaatagcccaaatatttgctcagaagagaaaatgttacagcaaaacacatatacaccctctctgccatgagaaacgtttccattattgaagccaaactaaatttgcttatcctggaaagagaaaatggagagaaaagattttaaagcaaagcaaggaatagggattcacaacagagagtcatcctaaaactatcttaaaaacaaatattctgccactttcctgcaaatacgggccaaggaaaatatgtgaaacaatatgaattctcttctaaatgttgcatagtgtatacatttatgttaaaaatctctctgcaatttttgtgttttccaaatttattggtgacttttctctgcaggttttacctaacaacaacttatttcataattaagcaaatgggagtgaagtcatactagctgtctttaccaccctttttattcaacactcaagacataggtgtttacagggaacttgctcttccttcaacttccccttcccctcagccttcacatccacccgcatgagtgtgcaccaataagcaatgttccaaacacaatgaacacacttccttctgaaagaagtgagcagatggtgtacttatgattatgatatagcattaatgaggacttttaagacatagaagtcagcacaacattaaatagataagccagatcaaaaagaaatggaaattttgtttctcaaaaagtgtattgcttttctagaacacttaccactgttcagttttattttagagaactatcatacaattcttaatttctcttacagcaagcaggccatttccctaagattgcggttgtgcacactgttcaattctactggagaatatgcaaagattttgaaatctttaggcttgtgtactcctttgccagtgctctgtctacagatgtatatttttatatttcttgcatagtttttttgtttgagggacaaaatgcttggtgaaactattttttattcggacatggggtgaaaccaacatgtttagagttggtttttggctcctctttgccagaagttttatatttagcatttcatataatccaatggaaactttatgtgagtggaaaaagccaacttctttatcttctagcccacccacaaaccagcacagaataattataaaacatcagtctggttttggcagaacctgatggatatctggtgaaccctgggtcaattatgagggatatgaaggtaagtcttgcatcgttctcgctcttgcagcagggcaatctaataggaagaaacagacttaaatgcaactaactataggatatcacttattatatgacagagtaatgtttttaacacataaggtagatcatgtcgttcctctgcttgaaattctctactggctcctcacttcactcccagtaaaaaaaggaatcctaccaatgactgagtggtttcccatcacctcacaactcctgcagtccactgtagccactctggcatccttgctgctctgtcagcatgccaggctgccccatccaggggccacagcatttgctgtgcagagggagccatatagcttccttcctcttctccatgtctttgcccaaaagtctcctcgaggtccctatcatgctgcactcccccatgcactttggatcttgcttaccctggtctgtatccatttccttcccatagaaaccatcactttctaatgtactgtgcaatttacttatttgctgtgttgattttctgagtctccatccctgatgctagaatagaagttccttgaggactgggatcatgtctactttctttacttctccatcccaagcacatgggctcatggcatcaattggcacatgataaacatcttgaatgcatcaaagaataacctagacacacaaaggtgaaggttgacctggaagaagaaggggtctgtggaggggtgacctacacaacttatttagaggctggggcaggagcttgcagcatagctgagcagagtgctggcagtggggaaaggatatctgtaaatcagttcaggtcactttctagaatggccttggggtctgatgggaagggtagtctactctctctcctctggaccagctccatgaactcatcctaagtctcagaagaatgattttaaagagtaatgtcagagaacaaatattttatggcaatttgggtggcttacagtttgagttttgggctgataagttggggcaatgtgggttacacacatatcatcagggcctgttgtagatcctggtgatgatcactgaataagcatttattacgctgaatagagatttttaaatactgaaattagaatctttgagcatttataatactcctttgaaattacatttaaatttacgaaccagataaaaaattattgctttactttagaactacatagttttttagaaaaaaaatagaatatttttgttttgattgattattgaccatactcacttggtctgacatctgttagccatcgtttgaattatattaggccttgtggcaatttattattacaggatattgtaaaaattaacctcggcttgaaggagtaagatttcacacggatcagaattttgaaaagaaaagtatcacaccactcaaatagagggatctgaacaatagtgtcattattggaatggaatgtggcctcccttctctcaagggtataacactaaaagcagagtgaaaatgctggcttatttgttgaacgtttctctgacattacattgaagtcacaggcgctacagaatattcaataagcatccctttcatacttcagcacacagctaaagtaaattataataccaatatctaccactgagttaaataaatgagaattcagatattccacaatggtttcccttctgttagtagagtgaattagaacatttcaactcctggtttgattattcatacttgtgcatcctacccactgccaggtaagtgagtctaccagtaacctttgcctcaaacttaagttatatctttgaacatttacatttatcgatgtcttcaaactataactctgatgacttcagatacagagctttgatatctttataacttagtaaccctttctgattaaactttaaagcaactttgaatgtgggtagagggacaggccctttatctcaatggaatgttttatcagttcctcttacccatattcctatcattcagcattgtgagaaggtaagacttacaaagccactgatgaacaaggatgttgcttgaagaaggtaatgacattttaaaaattgtttctggcacagtaatttaatgttagtagtggaaatccaaaaaacttccagctcctgcttcaataatgtgaatgtcacataaatgaacacatagtggtgcctgcaccaggctgttaaccctctttgcctctcacctctgcattcattttttggggccatgtggcctgccaggtgctcctgatacaaacatgaaaaaagtcctgacctcaagtagctttcagtttagttagaggaatgcctggatggataacatcaataaattggtgaaagagatgggctcgggggttacagagccagtggtgcatagtgagcatttcagaggaagggttcctggaagagatagtgcccaataaatgcaaaagggctgaaactaactttgtcagctgcaaacgtggtgtggggcttgcagttcttcattccagaagcaaaaacacagaggttagaaggacttatgttgctgaaaataagcttaaaacaagacagccttccaataaattaactctggcgtgatgatcaaaattatactctggtgggtacctcaaaattataaaaactaaaatattagcatcccttctctcctctcttctaaataacaacatttacatctttcttgaaaaaaaaaaatttccagattggtagctgcttctttttaccaagagttggttttaactgcagctaatgtatttgtgcagtgaaactgtaagatcaagcacctgccttaaagaaacaatggagggcaaatttcaaaatcagacttcacaaaatgcagctatgcctaaactcatcacaatcattttccaaacagttctgtttacctgattacacatttatagtatgtttctttatattgatatcaaaaaccacaaagcaatcccatgcttttttttaggagacacaatactcagtattttttccgagtacactcacaaattcagaatgtatatcatacttatatcacatatagacatagagggagtaactagatggacactgacatagtcacacagggaaacatatataagacaggtatagcgtgaacaatacatagatatttctaaagaaaatgtctgtaatttagcattactccataattgtattttattatttattttcttcattcacagcaccaaagggcattttccctcaagttgagggacacacctacaaaaaaggcaggctggatctccacaatctccacatccactgcatgcccattccccacctgtccccttggagtccactgacaccatacagcactgggtacctacctggctgaagctctggcccgtagctcgggcttgtgtgcctcgggccgggagctgtgaaggggtggtttcccccagggccagggtctggttgctatggtagctggccggatactggaaagacccttcaggtttggaattgagctgaagtgcactctgggagagcaggctgggccctgcattgaaagtcatttagagcagtcagtgacagtctcagtgaagcagaaatgacatgtattatttattgagagtagcctagaattatctcatgcacatgattccagccatccatgcttaaaattctgagaactaaaatgaccatataatttgactccagctctcagatgagattttttattttttattttttttttggtggtggtttaaaagttctcaaaggagtagatttttcaaatgatctcatcctgacctacatagagacatttcttatgagacaaattagttaatcaagtagttattttgggatcagacaatatcagaaacatttgaaataatgtaaaactctacttttcggtacctgttaattttgctaatataattatatctcctacttaatgatggagatgctaaaacactcgaaaccttccaatcactgacaaattctactgtataaatagtgatataatacctcagtgcctgaagggtagacagtgtttaaaatattaatagctctttgtacgatgtggaattcaccgtcgcctcacataatccctgatgactggttacctttaccatcccagcagtgcacagtaggagaacaaagagaacatacggtgttcaaattcatgccacgcatgtagctgatattacaaggggtgaagaatcagtttctggtcttacttaattatacgttgcatatgaaattgtgttttgttttcttatattctttttagatgagatccttgcaaacattttcccattttctttttaagcaaattttctttgatcaaatttaatactctctttagggatcaaataaatatggaggagagtaaatgtacttgttattttccattgtgtgtgtttgagaggggctggggtaagaagagcgtgtcagtggcaaaaacttggcaatacaagttttctcctgcctctttgtaccatagtacaaagtcatatattcgatggagtgtaataatacacatatagactatagcataaccattaaatcattcttgatccccctctttggctgttttagacaataatatcacttctgataagtatgagcaaatttcaagttccttatttttttctttttaagaatggaacatgactttatatttcgaatgagacatgatgtggatcacctttcataaaaataatgcatcctcttttaaataacattggttcacaaattctttggcacttaaagccttcccaatccctctgattttctgatggaactttgaaacaacatcaagatattttttcatcagtatttgaaacaacatgaagataatttttcatcaacattttatattgaataatatgccaattaactagtacagttattttggaatctatgcggtttctggaaaaaaaaaaggtaagcaaggaaataaaagtgttttcatccagccacaacttcatcatgaagggtgtaacaaaagtacaaatgcaatcccttcacttttaatttaagaaacccagtcctgagaaaacagtatgtaccagatggtaacatttccaatagcctggaaaaaaaatcatttattctgtcctaatggcattataggactcaatcactgaatataaggaagtctctgaggggagatgcatttagaatttgattctgggtgccaggaacgtattgtccctatcactgctatggaagctgccaggcccagcagagtcaaagaacagtgtctgaggtccaagtgacaggcaggctgagatatgggagagcctctggaggtggggcaagtggagactaaccataaagcggaggagaaggaggtgggcactgggaagacagtgacaactgtggctaagggctttaccctttgtccctccgaaggtcacattttaatggtgggagtgagctatggtggaaaagcaaaggccttttcagctgggtggtcaccattctacctgacaaaggagggctgcctgctgcagctttcttggttctttcttttttgtacagtctacctgggcataatggcttgtactggccagcctctcctccccccttgagatagtaatgcatcctaagggcaaagaaggttaaagcagatacaacgacagtgcacagacctttggaaatatcaatagaatgaagtaaataaacacataaacaaaatacttaatttcatggaagaagtttagcattatcttagacagttgcatgtcctcattatttgtctttcaaagagaatgcaggaattgctctgaagaactgttttgagtatgtagttagcaagttaaataactttgtatattctgaatagactcatacaattatctccagaaacttacaaatgctgtctgtacagtatcttctaatgacaatgtaaagtcccttttcaaaagaatttaaattaaaaatgtggtttacttgctcccagaatatatatgatagaataatgaaatctcttcatcttttatagaatcagttgtgtatttgatcagtactcaatgaaaagtaaccaggattttctatctcattactctattcatacatctcaagcactgaaaactagatgtactctgacaaaagtaattgcaacaatgagcaatgtatcagaatattacaacactgacatatcacctggcaaggacagaacagtcaagacaatagccaaaaccatgtatgcattttagaatgtttttccattgctcactaggttttaaatcagtgtcatttactcattctaattttagagagcacagacatatgaaacacgttaaaattttaggacaattcttaactactttataatgaaagtacaatttaaatgtaactaactttcaattagctttattaatattactgtgcaatgaggtagaaaatacaaatttgccaaggatttaaaaagcatttatagttttgggctttaaattatgttttttttttcctctggaacttttgactttttaatcaagccttgcttgggctagaggtaaaacgaggctgtggtcctgaacctatggaatctatgacctgaaggatgtgggtgatatggaaagaaatggtagacgaagagaaagaagctggaccctaacatttcacccagggaaacaggctattgtctttaatgtaatgatttccagtagacatctgaactgtgagcaacagcggatcatcatgtccttcttggccacagagagcagaagccatggtctcatttgccttcaagacgctgacctgaggggtcacagtgacttctttgaccatctggcccttctccatgatagaatagtcctcagaactgagcccaagggttttcccaaaatgaatcacccctgtgagccaggaagaaaaggtgaaaccatttcctcatacattgatgatgcttaagacagttttctttgttctgaaacaaaacctactatccttaactggatagagagaagaaattccaagggaactacaaagttgattccattaatcctaagaagatacatgaagcaaggatcttgagtgtaacaccaatgtctcaatatgttttcacatgtatgaattggttagagactacacagcaacctgtgaaaaaaactgcatgatcttcatttttgtcctagaagtacaggcagaggcaaagaggttaaattggcagccagtgtcacagacatggtaacatgaagaggcttggatccttatcttctgtctccaagtccaaaagttgttgttgtttaatatcaaaacactgtttctttaagtcatatatacatgtcagcagtttaaggttgaaaaagtcctgtgtaaacagaaatccacttgtttgcaggagaaatcttcatgcctcagattttggtgcttctccagtgaactgctgcttacagattccaggtgctggctagaggaaactcgctgtccactattcgtgggacaaaatcaatctcagaagatgtagaggttgaaatgttaattttctgcataaaaattcagacccacttataggtcatatcaatacagacactatataacacagacacaatatggccagcttcttctgatcagattaactgagtattttagagtttccatgattatgtgcacttgttctgtttacctagttttaaagagactttatttggaattgctaatatttgcctgcgttagctgaacatctgccttagaatacagtagaccttcaattaaagaatatactttgtaataatacagaagaggccagaggtctacaatgtggcattcccgagttattctataagtcacaaccacactaatggagtatctgaacgtgtgttgaaaaaaatccaggactggacatccacagacctgggctctagcccatctccatacttatttgaccatagatgatgatgacaaagatgatgatgacagtgacagtaatgaccagttaaccttttttgagtacttaagaaattccaaggattgtcctgagcagtttccatctactaacccattcaattttaatgacatctaagcgaggaaggtacaaccattcccactaatgtcgggggaactgagggatccattaactgaaacctcacagttactcgtgggcctggggttaaacaaaaatagcagattggcttcagaatgtgtgttcttaagcacacttcatgattctgtcacaacaaattgtaatctttccaaatttgaacacctaaggagataatggatgtgcaagtgcttggaaaaattttaactgctatataaatatcagttattattatctgattatctaattgcatagccacatggtctgataataataaaaccttcacagggatattttggtcttgaaaaccttattgtaggactctcccacacattattcatgctttctttcaacaacctgcaagctttcatcttacaaacaaaacatacaaggcacagttcattaaaatggcctgcatgcaataaaacaacaacaacaacaaaactaatgtcagagcaaatagatgaggagctaaaatcttttggcacttagagacagttctccgtttcctcagcctgaaattcttttttccatcaacctcaaaactcattctcaaacttaaactgctgcttaaatgtcacctcccaatattttaatagaaaatattaagtaagaataaaggaaacagatggtagaacttacatacaaaagggttattggaccattacaaaatcaatgagaaaaattgttgattatttctaaaattaccaaactgatttaaatagattcaaagcactttgatcagacttaactctgcagaataaaaatattctgtttaaatttcactactaatgatttcatttgtagcagcagtttcacctttatgggttccagaagaacttgcccatttacaaattaacttagagtaagaggtagctactgatgataaagtggttgttttctcctgatcttcgttagtaacttataaagctcatttggaggagtttctctgaggaggtcccctaaaaatagtggctcagcgcatctaccattccaaaaatgagctgagagaaaaagcccaaggggcttgttatgcaagaaagcttcagagttgacgggcaggtgtgtttataaatatcatttctaagcctctgtctccagaatatctatttcgtctggtcagttgctttcaatgtgtaatgctttatgtgaaaattaaaacgttaatggtcccaggaatatagaagtacccatttagtttttaaactgatttagacttatccaatgtccttggcttaattagtacgcttttccaagtttgactactgtggatggatacataaaggattggtcaaatgtttgcactacacagtaagtcactcaactttttttcttttttttaaattttattttactttaagttctgggatacatgtgcagaatgtgcaggtgtgttacataggtatacatgtgccgtggttgtttgctgcacctatcaacctgtcatctaggttttaagccctgcatgcattagatatatgtcctgatgttctccctccccttccctctcatcctccatcgggccttgtatgtgatgttcccttccctgtgtccatgggttctcattgttcaactcccacttatgagtgagaacatgcagtgtttggttttctgctcctgtgttagtttgctgagaatgatggtttccagcttcatccatgtccctgcaaaggacatgaactcatccttttttatggctgcaaggtcactcaatttctttacaatggtgtaaaatggaagacatgagcaaactgacatttatcataaaaataactctcaaatgtataactttagtttggaatgtgtacccaaagaattttatcatgagtgagattgcacataatattgtaatcagagaagtgtacttttcatcgttcattccaattcccaactataccttacaaagttttgtctttaggttatttgccattaaaaattaatgtagcacaaggagaagaaaaacattatttcttcataaatagtttaaagaggatctgatatattcgtatttctcactatcaatacttgcaaaaataaataaaacattaatacaaattggttttgaagaaaataaaatttaaaagtgaaactcagaaaacactacaatttgtgaatgggaacatagcagtttaaagaaccagtctttgatttgtgacacatcacacatttgccccccgttgatctgcatggcttgctggtgcatttctttcaggtctctgattcaatgtcttctcacaatagaggatttcctggccttcgatcattctttattctagtggttctcaaaactcttggtctcttaaccctcaaaattatagaggactccaaagagctttattttatctgggtatatatgatgctagtcactcaaaatgtttccaacagaagaatatgcagcacacattcccagagctgtcagggacatgatgttgttacatgccatgtagtctctggaaatcttcaaaaacattcgtgtgagaaaaagaatgggaaagcaagtatctcttagtattattatgaaaaccttttggctttgaaagtccccatcaggggccacgaagaccccagaattcccaagtatattttgagaaaaggtgctctactctactgttgacctggctttgtccttctgcaaagccattatcgatctggccctccagtattgaaaaggttgattttggccttttctgactagaatgtaaatgccacaaggacagagaccctttgttcctgccattaataagtggttaatacatacatttaacaaaataaatgactggaacatccacctgtgcctacagtgatataacaaaaactcagtacattaagagttggttacatcagttactgttcaagtgcaagtgccttattgtttgatcagtatctgtcagtatctgtattcttttttttttttttttttttttttttttttttttagacaaagtctggctctattgccagagctggagtggagtgaggcaatcttggctcactgcaacctctgcttcccaggttcaagcgattctcctgcctcagcctctcaagtagctgggattacaggggtgccccaccatgcccggctaattttttgtagagatggggtttcaccatgttggtcaggctggtctcaaactactgacctcaagtgatctgcctgccttggcctcccaaagtgctgggattgcaggcatgagccactgtgcctggccaatattcatatgttttaacttttggggaaatccctcaatacatcttcataatgtgttactgagagagtcctctccttcctctgcctcgcggggaaaagtctgcttattctaaggctttctcactggggctggcagcgtctttgctttttctcatacctatggcagctctgaacctgtcctcactttcagcagctttcatctaatcttcatatttgtgttccgggaatctacaatgccttgacaatttcaagaccaggaaattcccaccaggttctacacacattgtgcttgatcccagaagatcctgataactcaagtgggaatgatgtctttaatgagaaatttgcattgttttctcatattaagtgtgtggttaaagagctcttcttacttgatgcctttgcctattccttaaattcttaggtttgcctctgagctggcgaccttgttagagaaggtataacatgcttctgaaacatctacatggtaggaggaaatctaagtgaaatctaagaaaaagaaattaggccggagcagtggctcatgcttgtaattccagctacttgggaggctgaggcaggagaatcacttgaacccaggagatagacgttgcagtgagatgagactgcactattgcactccagcctggcgacagagcaggactccgttaaaaaaaaaaagagagagaaattaaacaccagctgagaaacaggtagaaatactttctggaatggaggataattacagcttcctgaaggattttattatttcctgtgggccacctatgtgttttccctcagcttttgccctcaccttctatttttgctactgctaacctcccattaatttcatatacccgaggtagggggggaagtgagtgtaagtgaatttcaaaaggaatggtagcatcagccaactttagacatggacaccatgacaaacctctggaaagaacagtcttgtttgtattttaaaaacttggacctcccagcactttgggaggccaaggtgggcggatcactggaggtcaggagttcaacaccagcctgaccaacatggtgaaaccccgtctctactaaaaatacaaaaattagccaggcgtagtggggcacctgtaatcccagctacttgggaggctgaggcagcagaatcgcttgaacccaggaggcagaggttacagtgagctgagactgcaccattgcacaccagcctgggcaacaaaagcaaaattccatctcataagtaagtaaataaacaaaactggaccaaagagcatatgataaagtgatttcacagggaatgaacaattaggatagctcaactgactcagacacgctttcaggatgtggggtctctaaggccaggtgacagtccttgggcacatctgggataaggaaggttttctatcctgttgggtctattggaggacctggtttccactataatagaaagcaaaacaaagaaaacagccctttttccctgaccatgacttttattttttgagccaatttgattaatggatttatcattttgactactatgattttcatgaaaaatttactctcctaagacctcttctgcatcttttggtgtcatgcttaacacgaattatgaaaacattcacttcacaaggatgcctcccacctttattattattattgcatgagaacatatggaattaggttttatagcttttaaataacctgatctctcaaacgtctcttgtaaattaagtatattcacagtaatcaaaataaaataaaactgtaagtcaacagtgaataatatatttgcctctgttaaactatatatgattattctattttaattccacctgcttagaatggtaacatatacgattgattcctgaatatatttaaaaatatattcagatttgaaaacttataataatatgtacttttttttaaccataacactcagaatatattagctctgaagattttcttcctactgaataatggaattttctaaaatatgacagaatttcaattcattaatatgctacagaaaaaataattactattgcaaaatacaatatttaaacaaattaacaatctgtggttaaacatacgagttatttttttccaggttatcctttctatttcttattttgactgacaacatttttgtgaatcactggctaagatataatcacctttatttctgagtttgtatataaaaggatgcatagattaaagaaagtacttggtcctaggcagttcaagtcacattattcattatgtagaaagctaatggccccaagcttctgttggtaaattattttttattgttttgttttgttccactgaagcgacagcagtctctgaaacaattctcctagtgactcagtgactagtttgtttaacaatatttgttaaaattgaaattacacagccggtagtcacaaaaaagaggcagggtggcaaaggttgtgcacatggtttaccaagtgtttcagattgcactgttaaaaatacacaaagtgttggaaaacactggtaactgtatgacccaataaaatcagcatagcagagcagttactgcttgtcttgaggtcaaaaagatgcgtactgtgactcaaattttattttaatcagacctttgaaagacaaatagcaaaaagctttaaataaaacaaattaagaactatgcgatcatggggtgagactgctttccattttagaacttttccagactgagtttagacagtatttagccttgttttagtcccttttgagtgaggattaagagactggttctcaagggcagggtgccaggtccaatttagcattagctggttcatagctaatgaatccattgattgaataatcactgactggcagaatctgatgggcttttcctaattagatgaaatctgtcaatgtgccactgcatatctatttgctatgtttctatacgggagaggtaaatatggtatacggttgttccactatcgaggaggatgctgtgctgatagtgctgtacactcactctctgctagtcctctgcacagagaaggatgtctttcagtttggcttctggttgggtttggccaatgggaggcaggagaaggagattgggggagggaggaaaaagagattatgacattgattccccgcttgctgctagactctgctggggatagttccttgatttcccttagggtctaagggtggtaagggcatctgtcttccactgcctgaataccacaacatgcgctgtttgttcccttaatcttgcccacctcttcataaatagtcccttaattaaattctgttcagttaaactcttttgaatagaatctatatctcatctggaacctaactaatatatatacacagagcaatttagatttttattttatgatcctctgaacacttaaaattcgcaatattgatgcccaaaatgatagttatctacccaatatgttaaaattattttcctagtttttactcagttacttcagtttcaaggtgactctgaatatgttaagggcaaatggttcttaagaataataatattctttatgtgactgtggttcagaatccttccgcatacaacttttgaatggtacttttatcaattgtttcttttttgttttgtttcttttcctttcttcaaagcaggatgaaggagctttcaaaagaaataatcaactaaaatcctaggagtcttcaataagataattcagtacgtgacaatataaagtgactaatctttctgaaaaataaatatttggtggttaccaaatatatgtggaaagaccatactggagcatttaacttccctattataaaccatttgtaggtaatttttgaatacatattgcaggcaaactaaagtgaaagctaaaaaatttctttccattttccttgtgtgtaacagagtttctcaactaagaaagctcagtactattatttgacttacagaaaaaaatatcatctatttatcccctctatttatctcttctggcatttatttatctttgactattttactttatattactttatctctgcattactattatcgtatgcatcttactagtttcttgctatttatttacctcttttaagattttccccaaataagtacaacattctttattttgttttctatttttaatcatgaagttaagatatcctctgaatgtgttttttcccccatacttctgtttttactaaaaaatgttcctgttttatttgcttagtaaatgctatgcaattttctttattatttccatttgattcagtaaatatccagaagtatgtttcttagttttaatattagtacattttgcttacaattttattatttacttttagtgttggtagatttttatccaagaatatggccctccatacttcttaacttttataattgcctttatcttctagtagctggtcaatttttataaattttccttggacatatgtaacaaacatatactatcatgcaataaataaaacctttaaaagttatttaatacatggttatcttaatttgttatttcaacattttgtggctttcccttctagcattctgtctgattcatgagacgtgcattcaaatgttcacaataatatttttccttaatttcttttatttttagtaacatttgttttaatattcacatgctatgctgtttggtgcacacatgttcattagatttgagtatgagcttaacacatctttataagttaagacagctcactacataactcccatctttggccctgctaagtgattctgtattaaattccaatttatctcacattattcttccaatcccactctttgcattgattatatttgcaggcactactttgaccattcctttaatttcaacacttatttcattaaatgttatgaataactcataactactttctttgtttactgcaaatttgaacttttattcttttcagaggagaatttagaatgcagcattagattgatatacctatattttcccttctattttaatttgtttactttttatttaactcattaattattttctgtactttccatttattaaatgttactccttctcctaaactcgttatcaaatatattattatattaaaaaatgagatttccactatcatctccccgtttcccaacaaggcaaactattctgttgctgctcttattacttgctaataagatgaatgcatgtgtttcaaatattaattaaatgtgttctaactagagttgtccctacaagagaaatatatttaatgactatgagtaaaagaggtaacgattagacatttttcaatacaaaatacagagaacaaggataataccaaccaatctttctttacgaattgtattgagaggatgcatatgggtataaataaatctgtgtatacacagcaatgttatcctaacagtaatggtattacaaagattatagagaaaatgagctaatctgtaaaataaatggttttcaagatcagtttgctatcttatccttatgtcttccttttgcatgacgaagcttagtgggtattggaggaaattttattttttaaattaaggaataaaatgcttcactggtttttgatgtattaccaggataatacctattttaatgatgaaatttttagtcttttgtggaattttattaaaataagtaaaaagaattttatgatttatttaaaggaggtccatttcaactcctaatccacaaccattctggttgaaaaatacgtcattaaatggagagaaagtgatttttaaatgttctatggaattaatatagcaatgcaagatggttaaatacagaaatgtaagaatttattgcatagtaccttagcatagtactaaatagataatactaagagtacaccattttttttcctattttgtcatataattgctgctttttatgatttctaccaacagtgatctctatgagtaaagcactgataggtaatttttttttttttttaagacggagtctccttctgttgcccaggatggagtacagtggcgcaatctcggctcactgcaacctctgcctcctggattcaagtgattctcctgcctcagcctcttgaatagctgggactataggcacgcaccaccatgcctggctagtttttttgtagttttagtagagatggggtgtcaccatattggccaggctggtctcaaactcttgaccttgtgatctgcccatctcggtctcccaaagtgctgggattacaggcgtaaaccaccgcgcccggccagcattgatagttaattttaaggcagacattgtgttgactacaaaatatatgatgagttcataaaatgcagtagtctagatattgaaaaggatatcagagaacagtgagaatcaccagtatgtcagtaattagtgcgaaaactagatgccaactactgacttaaaagagtttatactctaatgtgaactgaggtgggataatgtgggaagggaacagatgggacggagtgaaatggataaaacaagtataaaaatatcctgaaatcctcatttgatatggctcataacagtaatgatattagaaataatgacataatactcctatatttcaactatcttcaagcataactgccacgtgacttactttcacctgtagaataatcctgtgggtcaagtattcctgattcctgtagtgacctaatacaggagtccaccagctcgagacctgttgtaagctcatcttcgatatctttttgaccatctgaaatgaaatattttaaagtgatgaacaaacacatggtatattattcttaaagatttaggttatcatttaatcatggaaaatatcctagtcaaatatattacctctatgaagttttcattagctattccattttaatttttggtcaaccaacattaaagccaaggtcagcaatttcatgtacccttgaagagcatagttactacagaattgaaagatttaactctcaataaattgtgaactatcataacaacttcatctaattttactatcgggatgttttcctattacttttctaagtctcattctaaagttcataagaaaagtcatcagtagagatatgtttagaagtgtaagtgttcatcaataagatagacattaccttgtgactgccactgaaactgctcttctgctgaactgtaaaaaagaaaatacagagatataatgcattgattagaaaagaaaaataaaaccctaaaatctaagacacaaaggcatattagggtagtaacagtggccccgttgcatttcctttcacttcttactatgaaaagggattccactttgatataattttaattttaatccatttgctgtatatcccttttgattcgcaagtattagcatgttttaaatggacattgtccagtaattttcagaagagctcattttttacaaagcccaacctgttagactcattctttacaatagcttctctatacatgcagttttactcaattttagttattttagaataggatcatgtagactttgtaaggtagcctaataaggaaataactatccctttttttattagagagatgaaataaatctttgcctccatttagccatatcatattaaaatttccctttagttgatttaagagtttaagtaatttaaaaattataacactttaccaccaactaaatacacatttccaaaaatctcaataatacatcttatgaaatgacccagacggaaagggttgtccatatacatatgccaaagatactgtatagagtggttctgtataggtaacagatttattttgaatgacttattaaatacaaaatacatagtttctaaatatgagcaattcttccattgtgtatgcaaacacttcctacaggccccttttttatatgtaaataatcggtgagaaatctacatgctaattcctgaaagacatcattttgagaatgattttgtacacttatttcatgatattttactctgttcaagcagcttctctgaatagttcattagtttcacaacagcacatggattgtagacctttagtctgtaccttagaggtgggttctgaatacatttacggagaaaaagggaattctgggtataaatcaatgttcagaaaggccatgactggcgtaaatgaaaacaagagtagtccattaagagacatgtgactgttatggggtatcttgcccctgagtcaatcaatattaggaaactggacaatggttttataataatgagagctgtagacaatattgatacaggaaatgataatatttcaaattcagtccaatgcaactatttcttgcacaaaaagatgtgacattatataatagtaacatataactacaaagtttagcccttaaaatagaaatgtaataaaaatgattttaaaaattataaaaaccttttaaaaattaacaggttcacttagtaagtggaatttaatataaagtagtcccatcttattattcaagaatcaccaattcaaaaatcagaaccatagttatcctggctattttaatcctctaagaagtctatggatcattacttttcaagaatgtgaatatcaaaatactactgtttaaagatcaatcccattggtcatttgcagaaactagactagaactcaggcatatgggttctgagtaattccaaatgcttacttgtgtcagaatcacctgtagcatttcttaagtatatgtattttggggccctactagagacctacaagatgaaaaagtctacggattaggctgggagcctgcattgcataacaagcttccatgatgatccttgcgtgcttctaactttgtaaaacactagatactattttcattaatcatccattattaatttagggctccccacaacttcattcttctatattttaaggctggacaaattctcaaggtggtataatattttaagtgtttacatgccatggatttatacacagatagaaaacacttccatattgatagtgggttgaacggagggccttcctctctcaaaagatatgtcctcatcaaaaccctaagacctgtgaatggtaacatatttgggaaaagtgcttttgcaggtgtaattaagttaataatcttcagatgaggtcatcctggatcatccaggtgggccctaaatccaattacacatgtgcttataagagatagaagagagacaaaaatggagaagggcaggccatgtgaaaatgggggcagagactggagtgatgcaggcacaagtcaaggaatgcgtgaagtcatcagaacctgaaagaggtagggaaggaaactcccctggagtatttgtagggaatgcagccctgctgacaccttgattttgaacttttggtctccaaaaccatgacagaataaatttctattgttttaagtcacccagttgtggtaatttgttatgacagcgccaggaaacagatacaacaaaaaagttctcgtgttatgtcctccaggatttgctattatctctatactcctacattccttcaccagtacagctatttactaagtgcttcctgaataccaaggcccagttaattcacaacaatcacaaatctcttctttatagatggggaataacagatttagtaatgttgaaaaacttggccaaacagctcctaaggatcccagcagggatttaaactgatgtgtgaactcctaaactcaaattcttttctttaaacctttatttccgggatccatgcgaaggtttgttacacaggtaaactcatgtcatgggggtttgttgtacagattatttcatcacccaggaattaagcccagaacccaagagttatcttttctgcttctccacctcctcccaccctccactctcaaatagaccccagtgtctgtggtttccttctttgtgtcataagttctcatcatttagctcccacttgtaagtgagaacatgcagtctttggttttctgtctctgcagtagtttgctaaggataatggcctccagccctatccatgttcctgcaaaggacatgatctcatcctttttcatggctgcatagtattccatggtgtatatgtaccacatcttctttaatcagcctatcattgatgggcatttaggttgattccatgtctttgctattgtaaatagtgctgcaatgaacatttgtgtgcatgtgtctttatggtacaataattcatattcctctgtaatgggattgtcgggttgaatagcagttctgcttttagctctttgaggaatcatcataccgctttctacaatggttgcacaaatttatattcccaccaacagtgtgtaagtgttcacttttctcctcaacctctccagcatctattattttttgactttttaataacagccattctttcaaaatcaagtcatggtggcgctaggcatggtgactcatgcctctaaccctggctcatgcttataatcccagtgatttgggaggctgaagcagggggatggtttgaggccaggaattccagactagcctgggcaacatagcaagacctcatctctacaaaatctttttaaaaattagcaaggtttgttggtgcgtgcctctatttctagctaattgggaggtcaacatgggaagattctttgagtccaggagtttgaggcttcagtgagctgagattgcgccactgtccctcatgcaccccagcctaggtaaaagagtaagaccactgcctctaaaacattaaaaaataatttttaaaaatttgtgcaaggaaacatgcttaggttaccacccattttaagtgatatgagtgagggtgtcaatgaaagtcattcccagtactcagtaaagtccagcactcctctccttgcaggcactttgaggaaaacactctgcttagctcccttgcacatagatggggtcacaaaagcgtatgagaggaagtgacaagtgccactttatggccaagcacagaagaataagcatgaggtcttcatgctttctctctctcttaagccctgtgttgagatgcatgcctgagtaactatgtggaatggagacttctgccaacccacagagaacacagagcaccagtgagaaacaaataattgttgtgttaaaactctgtaattagagggctgtctgatcctgaagaataaatgtcacactgaccaaaacaaaaaggtgaattcctaaggcatttcttgctcttgctcttcgatttctgcagcacagagttggaagaaaatgtccggggtaaccctagtacaaataaggtggtgccgattttatgtgcaggtgttgattttatgtttaggactacacgtcatgctattagatatttatttttctgttcatctctatcaaatgtgtttcaattttatgacacaacagaaaaaagaagaaactctttttattataatttaaaaaatataattggaagtgaatataaaactgtctttccaaagcacaggcaacttccttttgggcagacaaaaagcactaatcacttcaatggtttccctgatttctttggcacagttaaaatgcattaaaagtatgactgatcacagagaatggaagtcccaagagaaagctggtttggattttatttcctttaagtgcacactttaatctcttagctaggagattttatgcaattgcctattttatgtatttgattccttgttttaaaaattgctctaaggtagatgctttttaaaaagcaaacaaactatttatttattcaataaacatggattatgcctgggtcacagacacactcatatcaggtgtctaggaattacctgtggtaaattttctctcaattacataattcaatttaatataatagaaacgtcatttttgaaggtgttataacttaaatgcatgttcaacttcaggaaataaagtttgcttttactgctgaaatgctattttatgaaatagaaatcacctctaaagaaataaatgtaaaaaagactatagacataattttgatcagtccatatgtgtttgaatatacctaaatataagatccagaacctagtgactgtgagaaaaacatgtatttaggacaaagacaaccataaataacacttagcctttaaatacataaagacatcagtgatgctaggaaagaaattttgaaacaatatattgaaagcaaaaatcctaatagctaatatttatataggtctcatttggtagcagacaatagtctaactgatttgtagttaatcttcatattaaaacttttgagaaaggtaatattttcccattttagagataataaaaccaaggtaaaaagatgccacggaagttgctagaggtccctcagccagttagtagagaagccagggttatgaccttggttttctggttccagagtctacagaaatgtgtgaaccactattccagtcatacatttggctacatcaaaagtaaaaccttatgtgactaaaaaactcctaccagaaaccaagttgtaaaataagccacaacctgggagaaaatatttgcaaggcatataacttacaaaagcttactttccagaatatacaatgaactccaatgaattaataagatagagatttaaaatgaaatagaagagagctcatcagacatgcatagctggtgcacagcaaaaaaacaaaaaaaaatgtatggccactgaacacattaaaagtatttgaggaataaaaattaaacacaagataactcctcatacaccacaaactgtccaaaaatttgaaagcctgacaatattaagtgtgggggaagaaatggggaagtaattctcatacactgtaggtgggaaagtaaattagtgaaacacacaggtgacctgtgggatagtacctggtaattttgtacatgtaatacctaatcacccaggaattttgcttctatgtagagactccaggaaaacatttgcacctttgtccaggagacttgtacaagattgttcttgcctacattgttgtaatagcaagacaatggaaacagcctatgtgttccagtaatagaaaaataaacaaatataataatatgactacatatcatatatgaggggtcttcaaaaagtttatggaaaatgcatattatgaaaaatttatttgtggatttcaaatatttgttgcacccaaataagctgatattaacttgttataacatgtctgaacctgatctagtttgacgcactaacgagggtaagatatcggtttgaaaagagctcttttgggccgggcgtggtggctcactcctataatcccagcacttcaggaggctgaggtgggtggatcacctgaggttgggagttcgaggccagccttaccatcatggagaaaccccatctctactaaaaatacaaaagtagctgggcgtggtggcgcatgcctgtaatcccagctacttgggaggctgaggcaggagaattgcttgaatccaggaggcagaggttgcggtgagccaagatcaggtcattgcactccagcctgggcaacaagagtgaaactccgtctcaaaaacaaaacaaaacaaaacaaaaaaacaaaataaagaaaagagctcttgttagagcaatatgaattctgctaaaattgaagcaagaataaatatcaaatttacaggaagcttggttggaagaatggcaaaatcattgatgccttacaagaagtttatggtaataaagccaccagagaaatcagcagttacaaatggataactggttttaagaagggacgagatgatgacgaagatgaagcctgcagtggcagaccatccacatcaatttgtaaggagcagggtcgcacctggttactacttggatattgggagaaatagagtttattctttccttttatcttttaattccatttgtccacaaactttttgaaatcccctcatatgaacacttatggaataaatactatttggcaggtaaactaaattagccagatacatatgtagttcttaaaaacaaaatacagagaaaaaaatggaagttgtcaataagatatgtattgcaggatcccaattatgtgattttagaaacactgaataaacaatattgtttataaatatacacattaatacatatacatgcatctctctatatatatatatctatatagatgtctatctatatatagatatatagatagacatctatatagatatatatatagagagagagagaataaaaacatatgaactgaaaaggtatcaaattcaagatggtggtggtggctctacagggggtcagaagggtgaagaaaatgagtccaaggaaggataacttccctccctcttttatctccaatgttttatttatgaaatatgacaaaatgacctgaagttattatgacaaaatgttaacattattttaaaaatatctttgatacttggaagagaaaaaattccccatgattcctacacttagaaatatgcttagttaaatgtttagataaacctttgtgattgcagcctttataatattcttagcattgttagaatcactcccagtttaaactcaaatgatgccaaacaattctgaaatatataattacaaataatagtggcaacaactgtttagagatacactaacttctttttccatttcatatgtgagacaactgacagtgtcatttttacaatgtttcaagtttgatttagtttgaacatttcaagtaagcaaccaataatcttcaagttcagagggcatgaaataggaagcacactggtgtaaacccaaagacaacctttgagttccttcacaagtgatttccacctcatcattccaacatcatagccttagtaactatctccaggccatttctaataaaaatatatatatgaaagttcaaagcatttttcttaatgccaggaaaagacacaaagcaaaccattactagagatattccatctgttatgaacctgctcaaatatactcttattgtctttttcaattttttgatgcccaaagcatcagtctccacattgtatcatgtggtgtattattgctcacaatatctttcaaaatgaaataaaggtacagaactatgagtttttttgttagtctgcttttgagttaagcaatgtacctaaaacataagccagagaaactactgggaaataaattgcttcaaaactgacctctggccaggcgtggtggctcacacctgtaatcccacaagtttgggaggccgaggcgggcgatcacaagatcaggagtttgagatcagcctggccaacacagtgaaaccccatctctgctaaaaatacaaaaaattagctggatgtgttgtcaggcgcctgcaatcctagctacttgggaggctgaggcaggagaattgcttgaaccggggaggtggaggttgcagtgaaccgagatggcaccactgcattccagcccgggcgacagtgcaagacttcgtgtcaaaaaacaaaaacaaaaacaaaaaacctgacatttgattctaacctataggaacaaagacctttatattgatgatgtccatatgacctgaccttgtatttggacagcaaaacatttttagtacatagttttgcatgcagccctcccaagaatagccatgggttgcaaaataaaatgcccttagcctcaagtactgtgaaagtgtaacatatttagttaaaaatggtgaagagtgatcccccactgagctcggctttaggccgctgttgccctgttccattagcgcattatgtccagaatcactggtttgggttgccgaataactccactctccgcagaatgtttcgtggaactgacttccctttggtcggctgcctgtggtctctatacttgtctgtgatataatcccaaatgaatgtcctaatatctctgccatgcaattagaatgccgtttttcttgcttagatgatatatcttctttttgctttaactattgccatcaaaaatacaacttgacggctattatgaacatttttacaggctacaatggatatagctacagaatctcaaagcctggtatatcttgaggaagtaaggaactgcttcctcttttatgagattgttacccagtgtcatgcctacgtgacacaggtaaatttctaccccaccttaactctgcttacctttaggaaactagatccctgagaggtcagaagctcccacttctgaccaaactggctaagactagcgggaaccaatatagcagctcgtctgacctctgaagaacctctaacttcattataatctgatttccatgctaaatgatgctcccactagcaccatgacagttggcaatcaccatgacaacaactggaggaaaccataaaaggacaaaaggaaagtggtagctccagttctgagaagttccctgcccattcccagaaaagatatgaatattcttccccttgcttttcatgcccaaccccttcattcaagataccctacatctgtgactttccagctgtcacccctgtcacacacctgcttcttgatttcatggccactgaatacagcttgctctgcttgacgcttacttttggttttgcatattggcttcgaggcaccaaacagggaaacaccccactttgagggggaccggctttgctagtaacatcatgttgttcaaatggcttatatggcttattgactatggcttactctaatctatttcatcacttggagtacactgtggtccactgggggagggccaaaatggggccaatatggggaaatgggaacagtggacactaaaaaaatacccaggcatggcggtgtctgcatctaagcagccagacacaaccagtcctagagaaaatggtgacacagtcaccacaaactcttggtgagtgctcactgtggctctgcggataacaaagagaggggcagcaccagctgtctatgagtttgcagtcaggtaagggcacaagtaggtaaacacacagaactggggggctgctgcctaaggggatgtgatcaaggcacttctgccttacactctccaagtctctgtttcctcatttgtaaaatagagatatcactagaatttttcccatagtgattgtacaaaagttaagggtataaaacacgaaaaatccatagaacatttccaggaacataggatgcaggactgcccccgcactccagccgcccaacaaaagttaagctatcattaccacatagagaagaacagaggcctgagagagtgcagctaattcacagaactgaaagatgaacgcaggcccaccatatggcattcaacttgtctatacctggggaccaatacatattatcaaaaatataagttacaggctctgtagaatttatattgtctacctttttttcccccacgctaaaatggagaagaaacaaagcagtctgtgatttataaaaaaagatgatttgctttaaaaccgtaagtttttaaatcagtgttgctcaggatgtctttcctggcaactgccaccattcttgccatagtaaaagccataaagaccatttgctattttcaagaccacaggagaaaataaatcagaactaaattgccgctattaattttagtttgaggcaggggaaattcatattcttaagctaattttgttggcactggtgactgacaattgtccaagcaactgacactgcaatgtggtaacagctcccacaccacggcctggacacacgcgactcctgtgtttatcacagagtaccacaacactgtcacgtctgcgggccagccagctacagccaaaccagggagaattcacattaaattctgttttgttttaattccttcaaaataaatattctagtttctaacagccacaaagaattagccagaggctcagtcaccctaaatgttctgtctacatacaagccaagctgtcactgtgggaaagaaatgcattcatttttttcttcttcaaattcttttatagcttcaaagttcattgtacttatattacaagagacacattatgcataaaattcaatatcagaagcagcaacaaatggtgcattataaagtagaaaattctcacaccgtagctccttctatagtattcccggaagcttctcatgcatggggctaggtattatttttcaaatgctcataacagtacatgagaaatttacagtaaagtaacatttccaaataccaactatgttagaaaataatgtatcatagtatctttgccagtgggcattccataaattggaatgtagtaagttgaaattccagttggccaggggtactgttcaccagttgaccgataggtcttataatatacagtgttttgaagtactttccaaaccatcaaactgaatagtttgtgtagtttgtgtgcttggtgtatactgcggcattctatatgccacaatgatacttctgttttggtgacattataactcacagtcagatgttgattaacttgaacacttcattccctgatcctgagagtgaagagagagctcactgcatctctcaggtggattatccataactgatatttctgcaggagaagagtacctagtttgtttgccgatagaagtggcatgtatatcaaggttcccagacatttcaagtttcactcttttgcattcaatgtatttttgttcccagaattatccctgttgtcggaccatctcagttaaggcagctctttaattttggagacctctctgagaaaatggagggggtcaagcttatgttttcctggcttcctgtgattctatgtgtgatattatgtgcatgagtgtgtgaatgtgtgttgttgcatacatgtgtgaactcactcctctgttcctctaaaatacactgatgtgctcatagcttctctttcctctgcttttgcttcctacatatgtcatctactacaggtatatcaaaccctgaatattggatttgactgcatttgctatgattttattaatgtaagcaaagctaacacctcttagacatgtaatgaaaatacaaatgaataaccattgccgatttcacaataaagaaaaaattttttttttgctttttttgaggatcaacagaagatttgtaaaaaataagtttcaatcttagcgcctttatacagcagaaaccatgtaatattcatgtacaacaattttttgtggtgttatagatctttacttccttaagagcaatactggccttttgaccatctgagtcatctgaaaccatctgaaagtttcgttaaaaagtttaatgggtgcacaaatgttcattagagttctattcataattgtcaaaaactacaagtaacaaatgttctacaagtgaaaggttacacacactgatacatccataccaaggaagtgtatgtgaaacatgcaacaactctcaagggaattgcgctgagtgaaaaagaggagtaacgttcttgaaatacaaaattgtagaactggaaaacagatcagtagttgtcaggatttagggatggagaaggaggtgtgtggctaaaaaggggtagcacgggggagacttgcagttatggaatagttttaaatcttgattgtggcatggtttcatacagctactgacatgacaaaactgcatggaactaaacacgcatacacacacacatacacatacacacacatcagtgcatataaaactggggaaatctgttggttgtagcaatgttgattctggttgtgatattgtactacttaagcaagataagactattggaggggctaggcgaagttagaagagacgtgtgtgtgtgtgtgtatgtttggcatgtcataaaaatctatagttatttcaaaataaaaaagcaaaaaaaaattagaggaaagtggttttataccactgtgtctgcttttcccagactggttctttatgtggaatttgttacacaattatttccatgtaataattaaactagaattttttttaaaagattgggaatagtgaagtaacaagaaagaaaagaaggaaggaagatggaataaaggaagaaaagagaaaaaaagaaaccattgttgacttctgattatccctttgttcttcattcttcagccagagctcaggtgaccctgccctgggctcatctctgctttgttctgtgaatgaaagagttatccctggagcataatataccaatcatactgcccattgccaatcagagacaagaaattgtgctgctactgaaggaaaactcatccattatgtgtaagattccctgctcatcaggatcctgtattcacttccattgccatatgttctcagggaaaattaaaaatgatatttttgctttcaatattggagcagagtacaagtcttaatgcatactacgtgagttcaggagacctcacacaatatacttcactggctctctggaagcatatttactgaagttaggctgccacctggtagatgatttgcagggtagctactgcagtgccaatctgcttccagcccactatcctaatgcctggaaaggggtctccttgattgactacatgtctgttgccttccatatttattgtcatgaaaaaacattacacatgaaaaaattactttatttccagcatttagcatctgatacttgaaacgggaaagatggagcagcctccccaccttctccgggtacacagcagctgtatgtgtcctgaagttatcctttcaagaaagaatgaggatttgaatgagaggtctgatgaaacaaccgcactgccagtcgaatgtataaaatcattttaaaagccatgaattgaaattcctactaacgttcttaagctatttagagcatatctttaatcattcttgggattatttacaccaatctatccattttccactggaaatgtccctggaaacccactccccttaactgccttggttggggatttttatcatctcttgcctggtggtataaagagctctgtgcctgggtggtatgaataacttctcattgacaaagattctctccttgaccaaatgttggttgggctctcctgagatcttccatgatcttccttggagagtgcagttctagcaacaaccctgctacgtcagtttcgcccatcctccatatctgatcaggttcctccacctccatcagcctccaggtgatgtgggatcccctcggcctgcctttagcaaaaatcctattaggtcaggttagccagaatcctttttttcccctgatgtttcctctcagtaattttctatccattgacccccaccctcctccttggctataaattcccacttttccatgttgtatttgaagttgagcctaatctctctcctccactaccaaaccgcactgttgtagccccccttgaaaaacacaagtcatccttctcattctttatcaagtgctattgaataattttttattgataccatcacagcttccttactgctcatgagaaatgtgaaggaagtcacatcttatcaatagcctgagtctacacatatgtgctcagataacattatgagggctggcttcacgggcctgagacctgtgcagttgcacagagtcccacacttagaaggccccatgcttggcttaatgctctgctgttgccctcttaaaactctggacaactctatctttgagcttatgttttgcgagtgaaatctgacaggtcaatggagcatgtgcagagtgaaggagatacgcacaatccacattcctctgttccttgctgcctcgttcacatagagcatttgcaatgccctgatggactcatgatgtgttgtgggagttgagtgagactcaagtcagtacaaggtaaatgtgttacgtttatgactgagtaagcaggcgtgctggcagctccaaaagaccacactttcccttcaagccagaacttgctttgaatgaagaaggtaatgaccttctgaaaaacatgaagaattgaggagccctgtcatctcctttcttactcaggttagccaatcagttaagttgaaaatgataacttagaaggaaaggaaaagtcagggcaattcatggttccatttgctttaattcatttctaactcaccaataagagaatgttggtagaatatgtgcatatcaagaaatcaaagaaacacagtggaggcggttttgcacagtgtttctcctgctgcagtaagaacaaagcatagggaaatgcatgagctatgaaatatgaactgtattatttcagtgattctgcaaacaagttaaatgctcttatatttgcatttgaatctgcaatagcacaatacacagataaatagtaaaatctgtgctaacaacttaaaattttaagttttctttacttagaattatattaaatagtatgtaaaaaacaacactatgacgagttgagagcaagacagtggaagaaaggagaaaagccttagtatttttttagtacctttaaacgcattttcccatatgcttttttttttttttttttttgagacagagtctcactctgtcacccacgctgaagtgcagtggtgccatctcggctcactggaacctttgcctcccaggttcaagtgattttcctgccttagcctcctgagtagctgggactacaggcgtgcactgccatgcccggctaatttttttgtatttttattagagacgaggtttgaccatgttggctagactggtctcggactcctgacctcaagcaatccacctgcctcagcctctcaaagtgctaagattacaggtatgagccactatgcctggtccccatctgctttttgaacaacagatcctaaatctgcattttgcattgggcattgtgaaatatgtgaacatgactgacctcaaatgaccactgtgatgattcaataataaggtacatgaaggtcccaggcacacataggatatcaagaaatcctctcctgcctctcccagacttcattccaccccactgcccctctctccctcttcatgtctgcaatctttttgctcccatcaattatctccactgtcaaagaaatccacaaccttttattagcctgttttcatgctgctgataaagacatactcaagactgggaggaaaaagaggtttaattggactcacagttccacatggctggggaggcctcagaatcatggggggaggcgaaaggcacttcttacatggtgacagcaagagcaaatgaggaagaagcaaaagcagaaacccctgataaacccatcagatcttgtgagactcactcaccaccacgagaacagcatgaaaaagaccgcccccatgattcaattaccttcccctgggtccctcctataacacgtgggaattctgggagacacaattcaagttgagacttggtggggacacagccaaaccatatcaaccctaaagacaaagtctgactatcaacaatccccggttcaaaagccttcagtagttttttaattaatttccaaaatctgaccatcagcaatccctggttcaaaagccttcagtggttttttaataaatttccttctccctaatcatcacctgtaagatcaagccccaactccttggaaagcatgttccaactgtgaggatctccttgacctaacttgaggaccctgtctcagccacttgccttagatgaggccaactgagtgaggctctgtatcctctgagactccatagtagctttaccccttatcaaaacaggctaggattctttgtttttcagcatttgtctttctggactgggagcaccttgagaacagagactaaaccacattcttccttttttgttgcattgggaagctctgttcctggtactcataaaacaggtgttcacaaatggaggtcagcatagttagtaaagcgtaggatttcctcttaatattctaagcatgctctgcatttatttcgctgaatcttgtctttagaattgtctgtgacaaaaagcgactacaacacttttattcaactttcatcataaagcatcactggcagaagtgatcaatctaccgagtgaatattttgatttgtataacctcatttggaataagaacattcaagaatcagttcctgagctacagtcatgctcctttgtcctcatcctgtatattaatattaaatactttaagaacatatcatggcaaatccttttatgaaaacaatgaaaccttaacttatatttttatatctctaaatttacatatggccttccccacccctcccccttaaacatagcatataccttgatttaagagaaagctatagggaccaacttattcctctgtagggaaggggatgggggtggcgttcacatataaaaggaaaatccacccttttcaagtgccactgcatgtgacagcacttcagagtcatctttttacttttcagctgttaaactctgtccatcctataaacttgagcaaactaatttccttctccctaattaagcccattgccatatttcattcactcaagctttctattaaatgaaacattattttcacttataaatgttccatgatgtgttcctagtggcttctaattggggacaattataaaaagataaatcagaactcatcagcagcagctgtcatgagcatgtccccgttctgcctctggtgcccacgtgtttgtttaaggcgccggggcagagcaggacccggagtgagccctgatgaagcagctcgggaaattcgcaggctgccaggacattcttcatttttaatttgttgatttaatctggctagagaggaactgacaaaatcctcatcacctaatgtgcttaatggtctaaatgaaatgagttggtggtgttggtttagttcctcttggacccatttctaagtcatacaagccatcgatacattgctctaacaagcccttctctccgaaaatgcaccacagaagattagactttggcgttttgtatagattttccaaaagcatcagaaaaacgaagtgatgaaagagtgtctagcaagcgggttctcgcacccctcaaagcacaggtcattatcaacctaggggaaaactgcaactgagttttccttcattttcttttcctattcaggaagaagcaactagaaaaacaaatgtaatttttgtttctttttagctgtaattgctggagttaatcttcattttcactactagaaaataaaggggccaggtgcagtggctcatgcctgtaatcccagccttttgggaggccgaggtgggtggatcatgaggtcaggagtttgagaccagcctggccaatatggtgaaaactagtctctactaaaaatacaaaaattagccaggtgtggtgtcgcgtgcctgtagtcccagacacctgggaggctgggacaggagaattgcttgaaacccggagcggaagtttcagtgagctgagactgcgccactgcactccagcctgggcaacagggttagactccgtctcaaaaaaaaaaaaaaaaaaaaaaggagttttttttttcctttttaccattaagagttagtataaaaaacatagaaaggagtataatgttggaatgggacatgaaacaaaaaaaaaataattcttccaaagtcagggtagttcaaaaataatgatgtaggtgaggatgacttgattaaaaaaaaaaaaaaaaagagcttacagagaataaaaagcatgtttcctttcctttgtctcctttaatcttcaaaatgcaggaaagttcccaaaacatcaaatcctcttgaaatttagaattttaattaatgcactatcctgggaaatgactcaattttcccccacagtgattagagaaactggacttagaatgtcaatttagtaaacgtatgaaaacatgtgtttctgtatttggtcatcatctactgtttaattaacatactcatacacgtgtatacacattcacatcaccaccaccaacattattccttttgccttactttggaagttgggacagtattttgtgtcagggaatagagaacagaaatgccagtatttaaccctagggttagtatatggaaaatgcaatcttagtttatctggataatctgagctatgcataggggtcataccttatatctcttttttgtttttcttttcaaagattcaatcgagaacccatcaggctaaaatacgggttgtgtatttcaaagggattgagcagtttaatgtgtctgaatctttaaaggatatcataaagatttgaaagaaacaatgaatctatactgcctatggagaattagtcagtagaaatatcatcatataaaataaatcatatcgggcagctattctttactgaggttatatcatttagtagaggatttttatggactttcttctttttcctgaccctcttttggtggaaagcattctattgcttgcatgccctgagctggtattctacgacttaaggtgaaagtcacataacactcttagaggtgaactcagctaaaacaccattaagtccatagaggtcaggaaagcaacctggttggttaaacaggtctagttagttaacctagacacacttaggtcagcaatacatatgatggattaaagttagccacgtatccttgccatttcatccattaaaaagggatgtccatttttctccctcgccttgtctctggacttgccagtgatatgttgagacgtaaaatgcagctgaagtgatgctctgaagctttctagcatcttaaggcaaggcttaagagatcaacagctgtagattcccttcatatgaccgaatgcttcttcttggcagccagcctccatataaggactttggctactctgctgacaaccatgctgtggggaagcccgcgttagccaggtggagagaggggccacatagagaagcactgaggtgacagacgtgtgagtgaagccctccgaaaccttcctctgagccctgcccctacagtaaattgcctcagttattgccatatggagtaaaagaaccacccagacatgccctgcttgcattctagacccagaagctctgggcaagtaacttggtgttgttaaagcggctaaggtttgggctagtttggtaaagaatggtagataaccacaataacacgcacagcacggaagcactcctttgtcatcaacagtagcaaagtgacttgtaaattcgcatggtatattatatgtctgcattttattttgaagaaaagatacttgtagaaacacagggctaaacatttacctatctgcttcattgcttcctgggtaaattttctattttatttaattgttaaataaaatgctcaatggactagatgcactccatactatcattttctgaggttgaggcttttttttttttttttttttaagttaagggcttaaggactgttactttgagaaaaattgtagtttgaaatggaaatgatatacaaattataaattaatacctggcaacacagaaagtgttgcaagttagcataaattggccatatgaggacatgggctgaaaaaaaaaaaagagacccaaattgtatgaaatttaccagggaagacatctgggcagaaatgtggtttgagccagattttgaaagaaatgatgggataaaattagatggcagaatggagggaaatcccaggggagtgttggcatggccgatttctaacatgagataaagatgaaaggagaatcaaaatcaataacttatttaattcagtttcatattcctagcaaactactacagctaggtgtgcatgactctgcagaatataatccagcctgtgaaatatttcttttagttctgctgtggtggtgaagcgggaggggatgagggtgatgatttcaactaaacagtgatatttgagaatctttcagaaagacagagtatcttcaagaggataagccaaataaaatgataagcaaaagaaaaaaattataaggaaatgaggaggcactgctggggcacttcgttttggattcattactataactgtgtgtatgtgcattttttgcaacaacaagtatctgaatatcttacgtttctctaaaggggctgaaatctgtgatttaatggaattttataggggaaaaaatctgtaaaacagacacaaagtgggagtatatttactccacattaagtttttcacagaagtcattttaagaccaccaatctatgttaaaattatttactagccgggtgcagtggctcacgcctgtaatcccagcactttgggaggccaaggcaggcggatcacgaggtcagaagatcgagaccatcctggctaacatggtgaaacctcgtctttactaaaaatacaaaaaaaattagctgggtgtggtggcagaagcctgtagtcccagctacttgggaggctgaggcaggagaatggcgtgaacccgggagacagagcttgcagtgagcccagatcacgccactgcactccagcctgggcaacagagcaagactctgtctcacacacacaaaaaaaaattatttacttatttactataacataaacaagtgctctatatcattggtcattaaggagatgcacattaaagccaaaatgagatgctgatgcacctgatgcacatccacttgaatgactatttttaaaacaattgacactaccaaatgtcagcaaggctgttgtatcaggctattcttgcactgttaaaaggaaatacccgaggctgggtaatttattaaaaaaagagatttaattggctcatggttctgcaggatgtacaggaagcatggtggtgtctgcttctggggaggtctcaggaagcttccaatcatggcagaaggaaaaggaggagcaggtgcatcaatggtgagaacgggagcaaaagagtgagaaaggggtgtgggtaggtgccacacacttttaaacaagcagatcttctgtgaacgaagagtgagagctcactcactatcgcagagacagcaccaagccatgagggatctgtccccatgacacaaacacctctcaccagaccccacctcctgcattgggaattgcaattcaacatgagatttgggtaggaacaaatatccaaactatatcagttgtaaaggtaccaaattcaaataggtggttgtgtaaaactgcccaactactttggggaaaagtcggggagtttctttaataactaaacatatacatacccaatgtgccagtggtttcaaaccaagatatttccccaagaaacaaaaagcatatatttacaaaaagacttgtaaaagaatgtacttagtagttttattcataattgtcccaaattggaatgagcccagaaactaatcaataagagaatgaatcaacaatctgtagtatatttatacaatagaaagctactcagcaatgtacaggatggaactgccaatacatgcagcagcatggaggaatcccaaagcttcccgctcagtgaaagaagacttatacaaaataaaacatgccattgattccattcaatatggaattcttaaacgagcaaaactaatccatggtaggaaacaaaacaaaacaaaacagagcagtggttgcctttgagagaataaggtggggatttactggaaaggacagaaaccaacttcctgggaagacagcgtaatattctatatcttgacagaggtttaggttacacatctgcatgcatttgtcaaaatttgttgagtggtacccctaagactggtgcatttccttgtgtgtaaattgtacctcaaaggaaaaaatagggactgaaagtaaatattaaaatatagttattaatatgcacaataaactatttagggggatgtgtactgatgcctgtgactttccacgaaatgcatcaacaaataaaatggataagcatttggaaagagggggtagaaaaaggggtatgtggtaaatcaagtatattaaactgctaatggtagaatgtaggtagtagagggcttccccttgtcagattctttcaacttttctgtatgttttttacataattaaatgttagaaaaggaatgcctcctatattaatagtataggaaaagaatgactcccatatcccaggctcaaacatgttgtgtagtatgccagaaagaaaaggccaaattctccaagtaaatagattatgtaatcaaatcaaactggataactgcaaagaaaatatagcatgcacaagtgtaacatacacacaaacaataattgaaaaaatgcacgaggttgtttttctccaataataatccaaataagacattttactttattacagaaatagagatattcagtgtcacgagataaatggctaccttgactgatactctatttacagattagcaaacgttttcttttttactatttatttatttatttatttatttatttatttaattttttgagacagagtctcactctgtcacccaggatggagtacagtggcgcgatcacagctcaccgcaagctctgcctcccaggttcacaccattcccctgcctcagcctcccgagtagctgggactacaggtggccgccaccaagcccggctaattttttttttgtatttttagtagagatggggtttcaccgtgttagccaagatggtctcgatctcctgacctcgtgatccgccctcctcggcctcccaaagtgcagggattacaagcctgagccaccgcgccccgccgtttgacaaacgttttctgtaaaggcaccgctatttcaggctttacaagccctaggtctctactgtagttactgaactctggtgtcatagggcaaaagcagccacagaaacaacctaggcaaatagatgctgctgtgttcccatacatttttatacaaaaacaggcagctgatttggccctctggctgtcgctggccaactcctattctatttgactgaagaacattcatattaaattcctcttcaacctcacatcacagattttatagtatttataatgcaaatattggtttcagatagtataattcaactaggatgtcaaacctcaagtcttccaattcaagggactttaggaacacagttctattatctgaaggcttttttacaggatgatttttgggttggggtttgctttggagcccagctcttgctttcaaattcactgggtgtcaaatgctcacatttcttggttgcttgagtgcttactgatggggactttagtactcatgtataatggcgaagataaaataacagttgtgaatataactaggagcgttgagataactggaataggagaaagacgacggcagggcagagttaggtgcctctgagtactacaggcaaaagtggactccctttgcttcctgagcgcttgctctcgggggctggcacagtgggagaaccaatccctaccaaggcacaatccctacccttcaggaatatacactgttgtttggaagaacaccagtgggcaacagacgaatgggagaaagattcacccattacaaagacctttctacagtcagagctgtctgagttgaattttatacctgaagagagagaaaaatctcactatccctggaagtactcaaggagaggcagaaagatctccaaccaggctatttattagagcaatttctcaatgaggaagaaccttctaagtccagaatctgatgtataaggtcacaacttacaaattcaatgtgatattggaggagagaaaatacaagattttatagattgttcttagtgacagggccttgttcctcatcatgcacagtattttgaagtatttttacatgtatctacttttttctttatcgagaattccgcaaactgccatggttagtgacttcccaaagatgttccttactcttcccttggttttgactgattcaaaaagaatgaaacatttataaacatccatccctgtatctcacattagaagttaaagcctaagctattttatttagaacaaaggatttcaaaaatttcacccaggatatttgctgacagttttaaaatgacacaaatggcactgattactttcaagctcttttagtttcctaatatttcccttttgaattgaaagataaattcaatgaaaatgaaataactacagcacctcagtttattgacattttggtattttattagttaattagtcacgccttaaaatgttaacttacaaatggaaaggaagagtatctaaaaatacaggccaacctaatccactaaatctaagtatgctaaagacatattttcccaatattgaaataaactcactagtttctctgaaatgttctggagtaccaactggaaatataaaagcactctaaaaacccaatagtatgctttttcggcatatgcatttgtcactcaagggtaaaatttacttaattattgttatgtatttccatctttttaagactgagtcaattaggttacctccttatgagtgtgagttaccgagtttcagaaaccctgcatattcatgacagtaattctcaaatccttgtaaaagaaataaagttggatttaagatattcataactttcccaagagagcattttctaataagggaacaagtaagagtttggatgatctgtcatcatctttatgtgcctaatctgtgcccaccacggtgccaggaattggaggggaaaagataacagtgttcctgccttccagatgcatgagaatccagcaagcgggcacaaagtctaagatttgacactatcagaaagagtgttgggaacgattttgtgtaagggaggaaatggaagaaatgccaacggagagatgatgtgagaactaaactgtgaagactgaggggagtaaataagggatagggatgtggtttgagcttgaattgggcataataagggaaagagcatttggggttgaaggcagacatgagtgtgaacccaaagagtaagtttgggacagagacaatattctgaaatgcctggagcaaaggaggtgtcttcaagaaggaagaggagaggactgtaatcggagatggtcccagttgataaactggggaacccaaatgtcaatatttggcatttattctgaaaagacttgggtgcctttggaggtttctgggtactaggctgtcctgcttatagaaggcagtgagaagaatattccacaagcaccctcacacaagcactgcaagctcaggggtggctaggcctcttctgaagtacgaggtctggcggaggggcagttccctgcagggtcagtataggctgttatgtgttatcttaactcagcattctcagggtatgtgtgacaacatgggagaagaacctgatgatctaacctaaactgatgctgatgagagtcttcgttgggaagaaatattaagaggatctcagatgtacacaaaatggccagctgtgtattgtggactggatatagaaaactaggcgaagaggatcgtcatcttcaaaggactttcaataaggtaaagggataccaattacaaaaatacaaccacaaatgcagattcaattatatatttccatttcttttgttcattcattcaatcaacaaatacatatgtattcatgtccacaatgtaccaggccttcttttaaatgctgaggattcaatgtcaacaatacaagcaggcacagtcgtgattatagaatcaacgtgggtgaaaaggatgggctgtctgggaagcagttgttagggagcttccaaattctaatatatgaactacacgtggtgttgagaaaagcagatggtcccatattaaaaatctgtacctaatttcagagtcacacttgataaagggtctgagtttttaaaggtgattaagttgactgccatctttggcattagatttaaagaatgtaagaagcagcaaatgactaagaatgaacatgattattaatcttcatgatctacagtttatgaaaggaggctatttggatgtggacaagattaacacgttctctgaattatcaacaatgtcctaattacttaggccagttgagattagataatttaatcggtatctagaaaaacatgatttaatcccttccgaaagacatgcttcgattttaactttattagcaatagcaggacagtcctacctaagggacttacttcttttatggaaagtctaaactacatggcattctccccttcattatttatccctttcgccagggcaagtcaacatagcgattaaaaagtggctactttaagttacatatgttcaatgtcttaaagtacctttgagttaaatatccaaatgttagttttgagatgtaaactacactagtaccaccgatgtgtacctaaaacaagcagcagacacgcattctccgacatatcaaatttacctggcagagagggcaggaagctcagtaacctctcatttcctgaaaaggccaaaaccataatccaatgcatggatgcatgggtttctcaggcctctccaaccaacaccacgttttcacatcttttaatgtgaaagtcaagccttgtcactgttcactgttcagcatgcttgaattgtcatcaaattaattccttaggggtagacctagacagcagaggggatgccttggtcagggagaggagatccctgtagacagtagtggctgcagagggtggatcttcggtccactatttggccagaaattctgggataccctcgttagtcataaagaggaagtcactttttccctttcactcctttagttttctgttaatggaagaagatgtgataaataaatgtgaatagtttcttattaatagttggagttatagtcggagttatagtccaaaccacgacttttttctttttgaaacaagggtctcactctgttgctcaggctggagtgcactggcacaatcatagatcactgcagcttgtaactcctgggctcaaacaatcctcctacctcagcttccccagtagctaggggtacaaaactatggttttggcccattcaggaactgggatgttactgagctagctgccctctctgctagctatatctatctatctatctatctatctatctatctatctatctatctatctatctatctatcttatatatatgtgtgtatatatatgtgtatgtatatatatttattttttttttagagacagggtcttgttatgttgctcagtctggtcttgaatacctagtctcaagtgatcctccctccctggtctcccaaattgctgggattacagccttgagccaccaccatgcctggtccacactgggacatttcttaagagagatgacaaaggaggggaatttctgccaatagttatgcaggtacaacttgcagaagccaggacagttctgagaaaatcagacataggtcccctccctgtaattaacacacttctaacccagaagatctcattcttaatattctaataaaaatattcagatgataaaatttgtccaactaacatattccttttcatctccacctattctctcattaactttaatgtatactaaacagtgtctagctgatgtgtgaactcgctcatggcatcaaaattctctgtgatccatgtttcaccttatcttaaactcaaaaataaattatgatgctttaattctcctcaagttcaacgtggactttcctagtcaactggctgtagagggctttaattgtgatatgctatgatcctggtgtgtgagttttagaaaactattttaataagacaggcaatttaccttgagaatattggaattcttctgaaaaactccaggcaaataaaatgtatctccaaattcttaggtatgattattgggtaagaatagattgactataaagaatccccaaatgagaaatactgggaaatagtagccttgtattcagaaattgagaagactaaagtgtattttgatttcctactactatttgaaaattctcataataccagcattataaaatatatgtatcagtgttcattgctagaataatgctagagggccaacatatatatttgtacatagttatgacaaggtagttttatgttggaaaaatctaatgtatgaagaaatatgctccttccccaaattaaaatttaactttcagatggcatggatagagttatcgctgaagctctattatccataaaattgtcaaactatacttttgcttttatatgctgagtttacacataatttgaatataatcatgcagaaggagcatacttatttgttgatgtcttagtatctttcacaaagagatataaactatatagaggatattcatagttgcagaaagacagagttttggatttagaagaatctacttttgttatctaaagagctgaaaacataatgtattatcattacattgattttttttaaagaatgatagttttgatgttaggcaacatttaaaaattatatggggatcatatttggtaattactttttgttactgaaatgtgtgtcacagcattagtaccaaatacactcatgatattttagaatttttcttacaactctctacaattttgcaatgtataatttcacttgccccgaacagagttgatataaaaactgctcatcaggccattttattattgagcttatgtttataatttttaaaagaagaaaagtgttcaattctccaatgtgggatttttttttttttttttttttttttttaaagacagattctcactttgttgcccaggctggagtgtagtggcatgatctttgctcactgcagtctctgcctcctgggttcaagcaattctcctgcctcagcctcctgagtagctgggattacaggcgcccgccaccatgcccagctaattttttttttttatttttagtagagacggggtttcaccatcttggccaggctggtctcgaactcctgacctggtaatccactccccaccccccaccccacccccttggcctctcaaagtgctgagattataggtgtgagccacttggcccggtctatccaatataggattaataccctgtctcactgaacttggaagctcctgggcagtttctcagctcattaccctgtctggagggaagtgcatccatcatactgtcttctccttaatcatcagttatgtgactattaacaagatattttcgccaatatgtgcttccattagcataaacccgtgccttaattaacttacgcttttttccatctgtaactatctgacataaaaattacagtagcaaacaggcctgtgtggcttttctaattttttccaaacttgtcagaaatgacattctttgatgcgcctttaaatccagtttctttttattacttcctaacactttttaaaaaaagaacgaaatacatatttatagaaaaaatttagaaattccgtagtttaaaaaattcacatcacttataattctgtgagtcagagataatccctgtgggcatttcattgtattttattccactattatctgttaacatatatttattttgcatcttattattttataaaaataaaagcttactacttttcttactagccactggcttttttctctaactcagttttcaataaaatagtacatagatacagatatagatatatttttagtagattaaattagaatcccttgtgaatacaccaaagttatctaattagtttgttgcagattttgcttagtggttcagtattatgaaaatacaactaacactgacagaacaagtaagcatataaaattaactgtgttaatgttgatttgaaacattttatacaatcactacaaagcattcatttactcttggtaaaagaaaggagagttagtttgaagcaactttttctttattctgagtactgaaaaagtagttttgggaaataggattagctttactgaaggctttcgcagtgctccaagggtgaatagagggtgcaaatcagacacattggattctgctttgaatccaagttcctactgaagtgtaaggaaagagactttactcagcatgatcttgagggcacagtgggacagccaaccactgttgatataaaattccattttatgagattgcaatcattatatatataattatatatgtatataattttatataatatataatgattatattataattttatataatataatgattatattataattattataaatattatatatatttattatatattagtgaaaagcactaaaattaataagatataataaatacatataataattatatataaaataaatatatataatatatattacatacaccatgaagaatatatttaaagagtatattggtttctattggcattttactacaatgagtacacctcaaccaaacccactgatatgacccaatgaaaaggcatcagttctatgaaactggtatacaacacaggtcacttttgtttattacaacaaattcagactttgattttgactttaaatatgtttgtgtggtgtgtggtgtgtgtgtgtgtggtgtgtatgtgtgtgtggtgtgtatgtgtgtgtgatgtgtgtgtgtgtgtgctgtgtgtggtgtgtgtgtggtatgtgtgcatgtgtgtggtgtgtgtgcatgtgtgtggtgtgtgtgcatgtgtgtgtggtgtgtgtggggagtgtgtgggagggtgtgtgggggggtgtggcatgagtggggggtgtgtggtgtgtgtgtggggggggtgtgtggtgtgtgtgtgtggggtgtgtggtgtgtgtatgtctgtgcggtgtgtgtgtgtgcatacatatatatgtgcatatgtcttcacacaagcatgtgcagatagatacaggctaagttctctagttaaaaattctttcaaaatgttatctttactttcttctctattttgatgttcttactctcttaatgtttacattcccttaaggtatgtatggttaccctaagaagaaataaaccaaatgtgacatttaccagcactctaaataatgaaacaacaacaaactactctgatatagaagaaatatttttttcacttggaaatcacatgaaatcaggtccaaattcaatctctgctatctctcaaaagtgtgaacttgagtaagattttaaaacactcagtgagtttcaggttttttctgcaagatggcattataatatcaaacttattgggtggcataaaaaaactaagcattggataatagtagtttccttccacttaatccttttatttcttactgacaccaactgttatttggctgcttaacaacggcacaattttctttgtacatatggatgaatcaagtcattaattactctccatcagcagtgcagaatgttggctttgtttaatttcgttcagaaacagtcactgggaagaagctaagtgggctacctcggcattgacttaatgccaaaattcaggagcattaagacacttagaagtaagtaacagataactcaactgactgaatgcactgtggaagtgatacaggtactaaataaattaattactgggctgctggagaactggtgtcatcggatcattgttggaattgatgtagagaatacacaaagcattttctcttcttcagatgttcatactccaaaaagtgctaacaaaaacatgaattagctccacaattgcaggcttcaatgagccacgaaaaaacaaatgtgtaacctcacatagagaaagaaattctctaaaaatctggtcattcaaatgctcaacaagtataaattcactagctcttaggcactggtggctgttaagaggaatgcaaaaataaggaagtataagatgaagggcagtctgaccaacatggcaaaaccccatctctactaaaaatacaaaaattagcttggtgtggtggttcacatctgtaatcccagctacttgggaggctgaagcacaagaattgcttgaacccaggaggcagaggttgcagtgagctgagattgtgccactgtactccagcctggataacagagtgagactctgtctaaaaaaataaaaataaataaaaaagatgaatggtgtcaatgtatttgaagcatagtaaagacaaataattgaccagttctgggcacttgctggcccctgggacctgtggacaggaaagtgtcgataaagccttgagctgtgctgaggtcctgtggccagcactggcacccagggcctggattggggtatgtgatcagggcagcgtagccatgaggggatcagctgagggcagaggtggcccattcaggcccgagtgagtgtgaggggcttgcttgtcctgaaagccaagaggaaactgcctcagtttcctacggctgcagtaccaaagtaacataaactgggtgcttcataacagcagaaatataatgttctcggcattctggaggcttgaagtctgaagtgaggatgctggcaggaccatgctctttctgagcactccacaggaggatctttccttttccctgctggcttctgctggttgccagtaatcctcagcactctggcttacagatgcatcacttcaatttctacctcctgtcattacctggtgttctcctctgtgtgtccaggtgtccagacctccatcttcttataaggatattagtcatattgggttagggatatctcatcctaacttgattacatctgcaaagcctctatttccaattaaggtcacgcacggtttcccgagattaggacttcaacatgtcgttctaggggacacaatttggcccataactggaactaaacggtgggttgagtgtccccttctcctgcaactgtgagagtatcgggagtctccaaagcaaagcggctcatgccaggtgcctccagagggactggaggcctggctttgccaccagctctgcgtgcttctcctcacccatgcctgggatttccaccttggaaatatccaaaaataagactgcatcccagtgaaccagcagaaaaaacgtaccctaataaaagcccacttacggaggctttcagccacagggaggaaattttgacagaacaatcatatagcggggctggtgaggtgaaactgctggaagtcagtagtgagtattctacatcacatgtggagtttcattaagcagtaagttctataaataatatggaaaccaattttctaaagtaaaatgtcagtttgaaatgcagtcattctcaacaattaaacgtaaatgtaacacagtatttaaatagatatttggacacagacaacatgtatcagataccaaaataaggggtaaacctagatacaaattttttgtttgttttttgttttgagatgggactctcactctgtcacccagggtggagtgcagtggcgcgatcttggctcactgcagccttcgcctccagggttcaagagattctcatgcttcagccccctgaatagttgggaccacaggtgtgcaccaccaaacacaactaatttttgtattttttagtagagatggggtttcaccatattggtcaggctgatctcaaactcctgacctcaagtgatccacctgccttggcctcccaaagtgctgggattacaggcgtgagtcaccgtgcccagtactagatgcaaaattttaatgaaatcggtagcttgacttacagtagtcattagtgatgctagcaatgactccagttcttctcctcggttcatgggagggtcgggatctcctactccagtagcgtgaagagtggtcaggtgacattctctgagcaatggcatgtgggtagggctgttgtacatcacaggatgctctaagagccagcctatgatttgctatgctcacaattcctctgggagatgccttcacatgtcttcaagagtgtggagactatttgaggtgacaaaggggtctcagattctgacttggagctgtaaaaactaaaggttgcaaaagataggttgcctgcatgctgcctgagggcctgaaggagaagtgtctgtgctgggttcagtctgtaccccacatctgtggggaaaggaatgtgaatttctggagatcaagagagtgattcaggggtaagatgcacctgggccggcccctgcagagagaagatgagttacagaaggagcaagtggcaggctaggagacagcatgccacttgagcaagggggccgtggataaaagtttctcaaagatgttggtcacagcactaggagcaggggagtgttggtgttgggcgcccagcttacagtagtgccaactgttctggaactttactgctcctctcaactctctggtgtctcttcttccctatccccccacctcagtcctcaatggctctaacatacacacacacacacatacatatctctggagggttctttaacccccttcccgggtaacaacaacaacaacaaaagtcccttctataagacaccttatctgtcaggcggctaaggcgggcagctcaattgcggccaggaatttgagaccagcctggtcaacatggtgaaaccccatctctacaaaatacaaaaattagccagatggggcagtgagtgcctgtaatcccagctacttgggaggaaggggcaggagaattgcttgaacccgggaggcggaggttgcaatgagctgagatcctgtcactgcacttcagcctgggcaacagagggagatgccgtttacaaaaaaaaaaaaagacaaacaaacaaacaaaaaacaccttatctggagggagtgtaaatagctgtaactttgaatgaaatcagaagctttgactatgataagggaataggaatgataagtatcaaattgagacaatgctttaaaaattaaagtaactatttatttattacccaaatattcaaaatagtgaacaatctatgtggcataggcaccaatcaacaatagacaccagcaatgtcagagatggccctggaggccacctgctgtgccttttagttgctgaaacttaagagagttgggagactcagagcataagggagaatctggatggcctgtccctgagggcggatgggggctgtgtacacaaggcacgtggctactgtccacccagacagaagtgcattgctatttcaacaactcaagtggttgttacagcctgagtagcaggggccaaggaaggagtttctcccactgaatacatttcaaagaatagtgggaactgaagaaaattgctttgtgatcacatcccatgaatcttgactgcttgatgtactagttgtgtatattaacaatgtaagctgcttagagagggtttgatatgcattcatataacatactcaattttcctgagaatgaagttatagaaactcggagttgaaactggcccctaaatcaagccttgggcaagtgttctgcgaagggagagggagaatcttccgagtggaggaaatgaaggtgaaggatgagtgggtgtgcagattcacacatttgtggtttttccccaactgcacacatctgaggattagctgtgctgttcaattgttactgctgatactggttataccaaacgatttacacaaaactaatgagaatgtgtaactttggtaatgatatgagatgtacaatattaggttggaatactgaggttatgaatttatgtgctgaatttgttatataattactttaaattgtttaaaaatttagtttaaattactttaaaaaattcagtagccaaaaagaaaaaaaatttcagtagccaataaatgtgctacatccatccttacccacaagccaagaaaaaaacgacagagtattatcatgatatttcaagtctttcggggaggttatatttcattgttttattaatgttttattgtctgtctgtgtgtgtgtgtgtttgctgttgtcgttttcaaataaaataattttgttatggtccaagggctactataccaatacaagcaaaagatctcattttggttttcacagttttaattacttatattaaggtattgaaaatgtttgtgtttacattattctcttgcctgaaacatatatattttttgaacaggatctcactctgttgcccagggtggagtgcaatggtgtgatctcagctcactgcaacctctgactcctgggatcaagtgatccttccacctcagcctcccaaaaagctggaactataggcgtgcaccaccaggcctggctttttgtgtttttttttgcttgtttgctagtttgtttgtttgtttgtttttgtagagatggggtttcactatgttgtccaggctcgtcttgaattctggggctcaagtgatcctcccacctcagtctcccaaagtgctgggattataggtgtgagccactacacctggcctcagaattttttttttttttaatcctggagcttgggctcagttgtgaataaactctaagaatgaataaacataaaagaaacacaattgtctaggtatctaaaattttcatttgctgtgaatttcaatcaaaacacaatttatttttcttgctaattatgaggtcatataaataaatgtttttcattgttgtctaaaaatatcattcctttatttcaaggttatttacagatataaatgtctataagagaaacctacgcttttgtctcactagcatttcattgtccctgtatttgaaagcaaattaattgatcaactgtttcaaatgaatagtgaattcatggtagaattcaacatcgttaggctttgacaataagcacatgtggctgcattatcctagccaaaaaccacattgttattggctgctctgctgtccaacaagatttggatcagtctttcatcaagacgctagttgtctcctacctaacatgaacgcttagcaggtggtcctataaacactggcagccatctgaggatcacaggggtggaggcaggggttgcatatcatggaataatgacagcagggggcacactcaaaaagccccccatccatgttgtcccctcaaaagaagtaagataaattaattacttgtattcatttctctgttacttgaagatgaaagaatcctgatttcttttttagatgtcccttatttctatatgaaattttataatttattgctcagttacctataatctgtctccttaactagaatgtaatctcattcagagtgaagatagtttctatctcgttgactgctgtactcacagtatctactgccgtggctggcacacagacattcagtaaatgttgactgttcataagaaagctttccctggatcttctagataaaatgtcagtccaaggaattcatcatctgtacagttgctagacactgtgatctgttacagtttcattccaagaagttctgaaaaagccccactatttttttagaattagaataaactgagtgcaagaaaagcccttttcggacttagcaagggctggcttgtctatactgaactgttcacattcctcacctttctcagatcttggcttcaatggctctcaacttatgtatcattcgtgtaaaatgggttgcttctgacatttctctaccatgtagtaaatcccactgctgagatttccttgggctgccccacatgagaaacctggatctgtcaaaggtgctattggtaggttctatcataaaatctatagaagctgttattccatatgtcaccataaaaattcccaggactcgagtgttgagctgtatgtcacaccatgcaacagaacagtcgtgccttcagtgagggtgccaatgggtaaaacttaagtctcttaaaaatgactcacattgatgaaggatgttgtattgtcaattatccatgcacccaatatcttaggacaggggaagtgaggccagcagatcctcagctttgtcccactaatactcagtgcacagcacgcttctttgcaggtcctcatctagctttaagacaaaacaggggtttctggaaagagactgatttcaatcttaaaaatgcgtcccaggctgggcgtggtggctcatgcctgtaatcccagcactttgggaggccgaggcgggtggatcacgaggtcaggagatcgagaccatcctggctaacatggtgaaaccccgtccctactaaaaatgcaaaaattagttgggcgtggtggcgcatgcttgtaatctcagctactcaggaggctgaggcaggagaatcacttgaacccgggaggcggaggttacagtgagccgagattgcgccattgcactccagcttgggcaacaacagcgaaactccatctcaaaaaaaaaaaaaaaaaaaaaaaaatgtgttccaaagcagccattttatgggtagtttccttcacagttttggacaaaaaatatgttcaatcatttatcaattatagagtgaatttggtttaggcaacctcttttggtctatcaaatcataacatgcaaatgtagaaattttaaaaattataaatttatattttatataaaaattaaccatatgtcacaaccaaaggtatatatataaaatacgaatataaaaattaaccagagacactgtttttcatgtgtgtattgttggtgtatgtggtatctgtcccgtaacgtctttgtcaataatttttcccatataatcacctatttaaaaagttatatttaacataagagttgaaagcttctaggcatcacattaccccaacattaccctattgtaccagagctctacctagaaccaagagctctaaaaccaaaccaaccacaatataattcttcacctccaactatgtgtgcccaaagacacaaatgtgcaactgtcctaggaatagtaagtaatacagatcaagcatcctcatccaaaaatccaaaatctgaaatgctctaaaatttgaaatgatgttcaaaggaaatgctccttggagcattttggatttctggatttgcaatgctccactggtaagtatagtgtcaatattccaaaatccaaatctgaaatctgaaacacttctggtaccaagcatttcggataaatgatactcaacctggattacaataacatcagactaaaataataaattctaatgacacattatttattatgaaaggcagtttcaatattactatttacataattcgcacgttcaagatctgtttgctaaatcctataacatgcctatttttaatttgagagaagaaattgactaagacattcatactgaacaacacatgcgaataacacattctttcattaaaaaacaataaatgtagtggcatatgcttctacttagcatcatcctttacttgtttatacccaaataaacgcagctggcaaccatggaattccaaagtccactttcctctgctgttttccccaacagtggtacatacgttgcatggtgattacaagaatcatccaaggcataattttaaattttaaggctaaacatgcttcaggaagaaactttctgaaaatggattagcttactttaataatgtcacatgtctgcacagataagaattactacagccctctaggctaaatatctatataggtggataggttgcaaagtcaggctactgaacatcaataaaaacggcaaatgcaattcaatatttgctttttttatcctggtttttcaactattatggtggatatagttttatcacaagtccctgaattaacgaagagactatattggtaaacagaaatgaatttcatgctccacaaagagaaaatgagttgctatggaaaatataccccaaagtaagaataaaattttataatttctcttaaaagtatcgaaaaaataatttttaaaaatgtgactggaaacactgatgtccagagaagagctaaacaggtgtaaaagtgctccttcctcccaggaaattcactttctgcagctcagctcctttaaaacacacagagctctctggatttcagggatgaataccattacctcacaatgtttgatttataattttttaaaaatcaaaatacagatagatgctgagtgacactaagattgttcaagattcttttcattctaactattcattctaggtagcctgttcacaaacaggcattctaatctttacccagtaatttataaaatatcggctggtttcagaaagaaaaaaaatactctggcatagaatctaaacttttgatgtagttcatttaaaattgaagaattttgaaatttgaaatacacataatatgtgcgcacatttgtctgaagtacataggtttgcgatctatcctaatatatgtatatgacactgatcaattgtagggtgaagaaaaactttctccagaaaaatcttacatcacactcatcagtgttactcattgatggctacagcgatgagttcctgttgtgtttgaagtactgtatatttgcctctcagactttcttggctaccctgacaagcaagtggcatcatctccatgtcacacttcagggaactaatgtgactcaccaaagaccacagagctagaaggtggcaaaggcagctgaagtttaaaaccaagtctgagggacttcaaaacctgtcccctctgcaagatgcctctctcctaaaacacagcttctaattcttaacagacacaactattctattaataaatcattagcaccatcccatcaaatgtgagatggtggcactagctaatatcagaggttgacttctaagactaaaatccatgttatcaacaatgacatatgcggctgcagcactagaagctgtcccaatgtttggcaaaacacatcagctcttcttggagccagggtattttaaggaagtgaaactatgtcatttccagagttattgagacctactcaaaatttcttttccattttcccaaaataatccaatcactggaaattttttcattgcttattgtaaatcataggaggtttcagccgaaatatcagggactcagagtatcagactatcagaaagcccagaatcattaatgacaaatcagaagagatttctatctgaaagtctccattttggtttgggtatattcaaagaacatataacctagtattatcagccatgatatattccccaaaaagaaaacccttattcaaaacacattcagaattgcatttgtgtaatttaggcattttgctttgcatcagataaagatgtaacatgaatctcttttttttttgtgcatgtacacttgtactcttccttttaaaacttattctattagtttctccaggatttatactactcttcttgaaaatcatttattacacgataatataactttttaatagaaatgggattgttttatgaagatttgaaactcattctcttatggagtgttacagaaatacaaatttattctatcaacattaacactttataggatttcacatatttaaaaagaacaacaggcagaattaactgttcttagcagcaaattatttactttgttcctctccacatgagttttcctatattttctataacacttcttagatgacattaggactctacttataaaaacataatagggccaacgcggtggctcacgcctgtagccccagcacttggagaggccgaggcgggcgagttacgaggtctagagattgagaccatcctggccaacatggtgaaaccccatctctactaaaaatataaaatttagctgggcgtggtggtgtgtgcctgtagtcccagctactagggaggttgaggcaggagaatcgcttgaacccgggaggcagaggttgcagtgagccgaaatcacatcaccgcacttcggcctggtgacagagcgagactccgtctaataaaaaaaaaataagtaaataataaaaaattaaattcattaacataatatttgtatatgttcaaaaacaattttattcatacaaatcaagtatttgtttagagggattttttgattggtctgcactatgcactcacaagacataatgtaataggatattcataacagaaagttttttttcctttttttttttgttgagacagagtcttgctctgttgcccaggctgcagtgcagtggcacgatctcagctcactgcaatctccacctcctggtttcaagcaagtctctctcatgcctcagccttccaagtatctgggactacaggaacgcaccaccatgcccagctaattttttgtattttagtagagatgggggcttcactatgttgcccaggctggtctcgaattcctgagctcaggcaatccgcccatctcagcctcccaaagtgctaggattacaggtgtgagccaccgcgcctggctttttttttttctttccagaagagaaatcatttggattctttcttaaaaatcagaaaaaaaaattctgagtattagaaaatggaatgctggcaaataatttaactcttttttttttttgcagtgtaacattgaagttggaagtacttaacttgttcaagttctaaggctggacgggacagataggaacttctgggtttttggttgttcctttgggttggcttaggaagaatgcatagcactagatcctttaaaccattcaaagactgatagtaaaaaacgccaagcagaggactgaaaaatggaactgaagtaggtatagaaagctactttattcagatggagagtagtaagagaaaatcagtatcattttccatttgtgtttccaaggtgatgcatagtgcaaagaacgatacttattttgccaagtacagtgaaaatactattctctgggccccaacttaatgtttttctaattcacgtaatcgcatggtgcatacactatgatcatgatctttccattgtgggtggaaataatttgttcaaaccatgtgtatctgtgtgaagcacaaacagagctggtgcatccctacactcatcatgggactgatattgactttatttccaagtatacaccagaaatttcagattaaatggcaagacatgaccttttatgtctcttttcagaggcagcttagaaagctctctgggagtcaattcctcctccttcctcccttctgcctcttagttgttgaggtgttggtttaaaatcaatcattttgtcattcaagaagtgatcatacctccctaacaggagagaaaagaagtggatgaaaaaagatgacattttactttagataatggcaactaatgcttataaaagaaggtttttttttctgctcagaattaaagtaatcatatataataagagcattttgttttccatccgaaccaagaatgcttgctcaggcgcctttgagaaataacacaagattacttatgctgttagattctgtcagcataaatcttccccaatggtgatgggaatgcatttatttatttatttattttggaaaaatgacatctttcatatgccatgagaaggactactgctaaattaacacaattaaaggcagcagaacttttatccgtttctacaaattaatatgtgcactgcagagcatgcacaagactgcacattcaatttcagtctttcctcacttgggccaatatctacatattaccatcacttatttatcatctaatcgaatcatctgggcaatagattgttatgggttctgctacttcttgatgtgccccaagggaagaagggttgtgtttggttttcctccctgcgtcaaggagacaatgttggttttacccacatataatttttttttcttttgcctttttgatgctttttttttttttggtgtgcaaaagagggcataatggagacggaatagagaatcattttaaaaacaccctctagttttacctgatatttcatttacagcaacacgagttaggtgtagatttctagtttcacatctgtgtccagacacaggtgctgtgacccagcagagaactacgtcacgtgagttgaggggatacttcctgtgtcctcagttgcacacatctatatttcaaccccaatacctgggaaggttgcctcaaacatgttctgttattcaacatttctattataaattatattttccaaaagtacatccagggtgaaggtatgggaactatcaccttatttggtgcttttgttcttggctttaaaaaagggaaaaattattaaaaagacgatttaaaaattattaaaagataaagctttcaatatattgtatttttccattgaatgctgctaagtataatttattatagtggagttttaatatgaaggcactacttatttttctacataaagtggcaaatttaagattgccacattgtttatagaggtaagatctaaatgaaaatctagaactctggtcttcatattctgaagacagtgatttttatcaccagcagcataattgtactaaattgtctaaacttgttcattttgtaaactgtaaaataacaacaataataaaattaaaaacttgtaatagccacttaattggtgtcaagcactctcttaagcactttccgtatattgtctcatttaattttcaccttatttatttcttttttataacaaatctttgagagtgaggtgaggtggctcacgtctgtaatccttgcactttgagaggctgaagtgggaagactgcttgagtccaggagtttaagaccagcctgggcaacatagtgagaccctgtctctacacaattttttttttaagttgccaggcatggtggtgcatgcctgtagtcccagctactcagagtctgagggaggaggattgcttgagcccaggtaatctcaaaacttggaattttctagaagtagaattgctatatatatcagcagcatgatagagaaacaatattaattattaaatttccatgacaattgacttcagtcatcacattaaccaatgacatcctctgtaatattatactatttttaagacaataagaaatgacctcatttgttcaatgtcacagagccagtgagtggcagggccaggactctccactccatagttggcattttttctacttcatcttcttaagaaatctgtatactccttgattcttcattgtcagaaatggagataaattatcagtagtgcctcagggttgtgctggattattctccaaaggcaggcatttttggccatctctctatccatgcacaggacacttgtgtaggatccagcagagcagatttctgccatcatcatgggtgacttcaagatccaacaacatggcccatcagttctttgcctgcctctaactcattccatgacagctgttgactgcagtccatgggctctcctctgattgcaaccccttctattcctaactcctttagaaactcaacaaccgtgatggctgatgagacgcaagacactgaaatcttacttgcatgggctctgaagtctgacccttggacttcagctcagttccagctctgccacttactagctgagcatgttttcatgacatgataacagtatggatctaaagatgttattaagattaaatgagttcatatgtgaaagagccaaaacagtctctagcatttaggtactgcctaagaaatagcatcttactaagtcgttcaactcctcacctctccaatctctctagtcctcaccaaggggtctactcaggaaacaccctaagttttgcttacttaaaagctaaaatatatgactgtggatatgtaagaggaagacaggcccaggggaacatgctgggcaacttccatgacagttgtttcataaacagctgaggtatggattgggtagtttatacacacaggatgggagtgaagtccacaccagctgatggattcagagtaagtgtgccatgagaaaactaggaacatggcaatcctggaaaacagaagcaggaatgagttgtccaaagtccatttctacataagcctcatggctgggcaactttcaggtggacccttgaggatgtgaaatctcctaatggacgctttagtgcctgagcagacacagttgggaaggcagaggtggaaaccaggaagagcgcaaatcctgcatctctagtccattatttttctgaatgagaccaggagaacagaagttctacaagatgttaatagttgcaccctattggtccttcagttctacttccctcttggagattcataaggtacaactttagcagaggttatggtgccggtctaactcaaagatttgttttttgttttattttttgagacaaggtttcactgttgcccaggctggagtgcagtggtgcaatcatggctcactgcagcctggagtccctgggttgaagcaatagagcaatagatcctcctgcctcaacctctggaatagctgggactgtaggcacgcaccaccaccacgactgtttcttttctttttttttttttggtagagatggcattttgccatgttccccaccctggtcttgaacttctgggctcaggcaattttcccacctcagcctcccaaagtgttgtgattataggcacgagccaccatgcctggcccttaaggacttcttataaggaatcaataaataaggtgaaaattaaacgagacaatacacagaaagtgcttagcagagtgcttgacaccaatttagtggctattacaagtttttgttattattgttgttatattaccatttacagagttaaagagtttaaaggatttagtacaacaatgctgtcgatgatgaaaatcattctatctttagaataggaagaccagagttctagattttcatttagatcttacttctgtaaacaatgtggcagtctgaaatttgccactttatgtagaaaaataagtagagtcttcatattaaaaccccaccataggagactctactcggaagaattcagtggaaaggtattgttttgtcttattaaatacaatatattgaaagataaagataattgcttgttctgcccctttttaaagccaagaacaaaagcaccatgtatggggacagacttaaagttgcctgacttttcatgctgctaagtacgtctgttctaagaatatgaaatgttttcaggtagttcttttatttgtctaccaggcaaggaaactatttcttccctatataccatgaattccaaaaacctgcagaaggacattttaaaatatactttatttaaaacattaaaactaatgacaataaaacttttgtatatttctacatggaaggagttgtgggtacacttggcagagtgcatttagtcaagattgtatttaatattttatgattctataagtacatttaggtcaatgtcaagttgtaagtacctacaaatgaattcagaacctacattcttcacatgtctcacgaacttgtggtcaatgtactgatagtgtctgatggttaatgcctcaagtaatctgattaaatgactattcttatattgcaaaattcatacttagaattttgatgaagctgaacctttctcacacaataatatttgcctatcatgttgacaagatcacccgactgggatggaaagagttcttaaacccctttggtaacagatttaatggtcctgtcttcaatacatgatgcccgcaacaatccagtctacaaatacactcagagggagcctccaacataggtgagactgtggcaatatgtgcccacaaccccaccaaaatcttacatctcacccagatcacgggactactgacagaattcaaactatctcaggaaaaatttatccaagaacaaagagaaaacagatgccctatgagagaaagccaatgggagaaatgcaaagaataaagcttggaattaacatctaatttctggcatccattgtaattgtccagccaatttccaaatttgatgtatatctgaataacctaaatgttgagacactagatgtcactcatattttaatactgagaagtgtgtttagatatgagaaccaaaaatatgcaccttctactgttctctactatgctgtccccactaactgagtgatgctctacccccattgggggcccctgtgcatttctctgcttgtttttggatctggcccttgctcaggctattctagtctgggtgatctccttccagtaccccagggcctttgcgcttgccaccctactactttgcctcagatacagctcactccctttcttctccctggagtgctctgctcaaatatcactttaccttagctgactactgcacgttaaattgcactctggccaggaactgtggctcatgcctgtaatctcagcactttgggaggctgaggtgggcggatcatgaggtcaagaaatcaagaccatactgaccaacatggcgaaaccagtctctactaaaaatacaaaaattagctgaatgtggtggcatgcgtctgtaatcccagctacttgggaggctgaggcaagagaagtgctttaactcaggaggtggaggttgcagtgagccgagatcatgccactgcattctggcgacagagcgagactctggaaaaaaaaaaaaattgcactcctcccttcactttccccgctagtcctgcttcattgttctttctggttctttattttctttctcccctcactagatgtaaccctcatgaaggcagggactttgtttttttttaaactggtgaatcttgagcctctaaaagtttgtggaacaaatgccctgaataaacgtgcgctgaagggacagaaaaacatagataagtaaggcactgtcccatctcatgtgcatgtggaactggaaatgcatgcagaatgccgagagaacacagtacaactcggtccaaacccagccctttcacgggaacctgagagtaaatgtaactgcaaacccagaaaatgaaaattaggccaggtaggactatttgcactaagatgcaaagacacctgggaaattgcttgtgaacttcttgatattagaaataggcatgtctcaaactagtagagtttcatgaactcggtggtagacctttgcttggggtggtctaacgccagagaccccagctgaagcttgctgtggatgtgtcacctctgtcccttcaatgtggttgacctatgcatcttgagcatgttgtagctcgaatgagcaagaatcataaactcatggactttccaagctggaatggattttaggcatcattcagccaacacttcttgtaaacaaagaaacaaaagagtgacatttaagaaaatttcaaatgtttgcactcacgttcagggaaactactatccaataagtaattcaagattagaaagaaataaggattgagacattgattctcagagatactgtgcagcatctaggtaaattctgggtaaagcttaaaaatctacacaagaataaagttttgttcatattgctgtttcactattagattttaggtggtactggataacctaggttatattgagtcttagggtctgttctgaactgacaaaataccatcgaggaggaaaacaagggtaggaggtgatcaacaccccaggtggtgaccagatcacagtggtttcagggcctccacagagggttcctgagatttggtctcagtgctcacaaatgaatgtccccaccccactataatccagggatatctaaacacacttctgtgggttttgccccagcataccaagcagagggcataattcctggccaagagcaaagactgaggatcagaaaggtcatagttccaattttatggtctaggttctttattctttgatttcgatgacctcgtgggcataggacttgggggagctgccctctctcctataggcctggcctggctttctggccttcactgtggatttgacctattataaagcactgatacacccctgacatatcacatctcccctcaacttgagccctggccttggtctcttcagcctccctgcctttgctgttgtggcagcagagaggagtccgatagtgtcattagtggcctcaggctttagtcttagatattatgggtatgtctatagaagaaagattctattttttttttccccagagtaacagaagaatatagaaacaggttacgatgaggagaaagcatcaacaagaaatctaaagctaaaaagcacaaaaaataaaaagtaaatttaaaaatataaatggaaaataaattccattagttggggtgctcgaaagtaacttacttttatgttatgtgctgttgttgttgtttttaataatttttaataatttaataaataccaactaagaaatgagctatcactctaatctatgtgtttcttaacacttgtctgcagcaaataaaccaccaccaagaaaagaaacaagaaaaaaaggacaacaaaatgacctatcagaagctgcctcggcctcatgtggacttggcacggatgccctcctgtcccacatctgcagactcctcagtcttcatatcaaatgtggaccatccatcaatcttagtcctgcatttaaaactcattaaaaagctgtttgccattcccttcaaagattaatcacacaagtccaacataatagctttgacaatttaaatcctcccattttagcatttcatttcaagtgtactgtaattatattgcttctggctaacttagaaaatatattcaaataataagcctacttttggtatatgatacactcttaacactattcctcatattcattatgtagaaaacttgaaaatgtacttagaagcgtcttcagaggtaagagtaatctattaatccatccatccatctatctcttaaattgcacagttatataaatatgcaaatgttcatccagggagacaattattctttgagtgctttggatttttgtacaataacttccttatttttagtttgtgtttgtattgaaaaatttacaccaaacatctcagccatttgctgtctcaggtttataagcacatacatgatggtaatgtgcttctcagttatgtggtcattaaccaggacccttgtttgtggctactgtatcctagtacattagagaggaaaatgctgcctgccataatattccatgcccccatgttctggcttactccttgccaagagtgcggtatgataaattcaaagcacaaactctttcgcatggatatacagatacctgagagagcacacatggggtgcttcattaaaaaaaaaaaaactttaaggattctttatatcatgacgcaaaaagcaaacctactcactcaatttcttatatgcttttaatgacttaaaaaagcactgggcaatggaggcaggagtctatgaactacaggtccagctaagctttgacagctgaggaaagcgtcccttacaaaaaaaaaaaaagatttcatttgaaaatgagaaagacaagtttctggtttcttttttcattctcaagtgattagtgaggcagggtatagagatagccaaaataagtgttagtttcaaagcaattttaattgattattttgtgttaactcctgttaattgatgatgaactagaaccaaaatttacttccaagagttcatctaagtgatatgaataaaaattaaattctaagtaggtagtagattttgttcattcattcatctgatatttattgagttcctacaagtgcctagtcctctttaggcattgaggaattcagcagtgagccaaacagacaaaaattcttccatttgtagttgggtgagacagataaacaaaataaataagtacataattctgtagcatgttagaaggtgatgaaaaataaaatagggacagaaagtgtcaagggttcagctctgcataaagtactgtgaggggtttcactgagaggtactaaggcatggtgatcactgggaggagagagtcctgggcagaagaaagggagcctgcaatgttctccagggagaaagtgcccaaggttagagcacctgcagccctggggtgccaggcagcaggacttagacttagtgggggcaacagggctccagacaactagggcacagtcattgttagagcttccatatttactctgagtatcctcagaggccttgggaagtagggagtgaagtgatcagacttgtgtttttaattattatgctgatacttatgctgagaacactctgctggagaactgaagccagcaggctagccatggggcagagatatacaggtgagagcatggtggaccagggaggagagaaggtggtgagaagtggttgatcctggctagattatgaaaatgtgggtgacaagattggctattgggtagaatatggggtttaagagataaaaggagttaagcttggctcctgtattttattaactaaaattctaggaatataccatgatggatttgatgtgggttgttcaatcattgtgatcatatttattttaaattcataacaacatggaagaggaaatgccttcctcagttattgtgagtatgggctgagatcccaaaatgatctctccttgcaggctttgtttcttctagcttaaaggatatttctctcttcttcccctccccctagcccaagattttctctttagacttcctaatcttcataactgatttttgtcttttggaaggcacattttccttaaacagtcatgttaagaataactaagatattttacatttttgcagtaattgttcacattgttaataatctgcataacttttcctattatgcagtattaaaatattttccaaaaagccccagtcttttactatgcatacctatccagagttttccttgaaatagcacagaatatccaaaactgaactttttttttttttttgcattctcttcctgtccctattgttattttcagaagttgagcacagttaatgggttgctcagaattattgtggatagagatgcaatgtttgtgcaactggtaaaaatttgaaacataataaatgcagcaactgtacacctaggcattctcacatgatcgatgtcccaattttgaaatgctagaattaggcagacaaacaaaagtgacacagctttcctgtcacctttatttttgccagactgactcgaatgaagatcactattgactgtggtgttcctgatgggtaattatttcagcaccagctactgaaaaactcatagctataattcaacatctgtttccccttccaaaagggcacagaccctgaaaatattaaaaccatcatggtgactaaataatcttagcaagttggtccagtttagactctccaaatatactggcagaaagatgaccaactccatctggagtttgctattatttctaggaatttccttgtaagattgagggtgttgcagtaatttacttggcttcctcatggcagaatgcagttgaagacaacagtcaacttccatctccaaggtgcagatggccagttctggataacctttcctaatggcagactttatggaaacagaccagtggtacaactaaaaacgaacttcatgaaatttttattttctaacttaaaaaaacaaaactacttattgaagaggtggggttttcactctgtcacccagactggagtacagtagtatgatcatagctcactgcaaccttggactcaagcaatcctcccacctcagcctcctaagtagctgggactacaggcacataccaccatgcctggctaatttttaaattctttgtagagacgggggcttgctatgttgcccaagctagtcctgaactcctagcctcaagtgatcctcctgccttggcctcccaaaggacataaaaccatttttaaatacaaaagactgttccattgtacagtcattcacctaaaaggtagctcatttggaacaactactaatctccgctgagttctaagccttttttcagtatcccaggacttatctgtcaatttactactaagttccttctgatccattttctttgaaaaaaatgaaaaatatactagtgtcctccaaattctataatcaaatccacactagactatgatatataacagaagaacatctaaaaactgaattgttaatgaaaaactagtaacaagaaaatgtaatctcttctctcttccttttttaaaaagttaaatattgtcaggaatcctcttccattctatttaaagtactttaagaaatcatgtctctaaaaatgacaattaaaaaattatcaacaggagggcatacctcatgagatattgacaagatgacatttccaaggcccacattagtgggggttctgtaggaccatcagtgggaaagtcactgacgccatctcctgccttttatcttcccctcccccaccaaatcagttccttttgacaaactcattttctgggaaaacgatgttctatgtgatggtcagcttcccacacatgcgtgtactgcagcaacaacatcacacaggtgcaattcaccatgaaagaaatctgtgctatgccaatcttcccaggataacaagtattgtgcagtgtgggctggacacagcaaaagacctgagccaggacagctcaggacatggaaatgcccaggctcaaaggtggtattgctcacaagggcactcactgaagccatacaaaaagctccttcctaagccagtgcaccaggctggtgcccataccatcatctgtaagagatccatagcgtggccctggatgtgcagaaaagtgtgtgcagagccagcacaggctgtgcactggagcaaggcccctggggagctcagctctcccaggctggcctgcccgaccccaggcgtgatgggcaagctccgctatgtgcttgcttcatctctcctcttccacttcctgcatggtttctgctcgtcctggttgtatctggaatgggttggccctgagatgctctctgtccttctcccacactggggcaaggctttgcttatgtcggaggctgagaaggtccctgccatttttgagggtcctggagatgaacggttatactccaagtgcctgttgtttacatcgggcctgattctacacagaatattcaatgagtgtcaagaatttgtggcatgttctggcctttgaaatataattttgtttgttttctctagggttgtgtgtgtgagtcaaaataagtacgtagacttaacaaataaatatgcttttactagattttaaaagaaaagggtgacttgggcttctgggggtaacattttacttagagaaattttaatgttatttaagcagcagttttgggtatttattcccagtgataagggtggaagtccaaaaatgaatcctaaccacttagctgtgttgtgcaaccaacattcctgtttttcttctacatgcagaactatttaaaacttccagtaaatgtctttcactaacacatacatagtactttagggggcataaagataaatacaagtaactttctgcctttaaatttagttcaaaaaataataggataaaaaatatgcattagcttttagagatatcgtactgttcttcctcttctgactaaaagtgtttgtaaatttcttcttcttcttttgctaatttcaactggggagttaaacgtgtgtctgtgtgaagtcccaatctgcaagtgttactgtaatctacatcaaaaactgcacaggcagaagggcaaatgagactcaagtacaaataacagaaaaactgtattagtgcagaatttccagggagacaatcctaagattaaggcagtccctagcccatagaatagggaatcatagaaacttaagagctagtaacccttggtatcgcagtccttaagcatcagtcagtccttacagccaatggagatgaaagcaagaggacaaaagtgacttttaaaaatttgtaatcataaaacagaaaatcattaagatgaataataaactcatttaggacacttttggttttaaaaatgtcagctatgggatactttttaatcaaagcaaacttactcaggataaaaattcagggaaccatttcaagagttccatggtatcagccccaggaagccacagcccatccacagagcagcaggttcccagatctctctgtagatacagtatccaatatgtctgtcaggtcctgaaacgtccaaagggtgctcggacaatactgcagatactcaaaccctcctgcgaggctttaacgttaatgactacacttattcatttctagaaattctattttttcctttttcaaattttagagtctcttattttctcttttcattcagtttcctctagtaacttcaattcctgggttgctaatcactctgttgaaattgctgattattcatggtgactcactcatcttgtcacctggaatttttaaatctgagctcattttcagtggggtgttctctcctttcttgtgggattcttgcacgatcaactttgtggaagggcctgaagagaagagtcacatttgcctgtgctgtggccctaagggtttctacataagtctccagtttaaatttttcagcttgggtttctgcaggtcatatataactctctacgctcaagcaggtctggagtttgggtttctcatgggagaacgttttcctcacccaagacccctgagatggcaagttgctctgctgatctcaaacaagtgttcagggagtttctagctctttccacagctgaggctgccctttgcctccagtctttgtgcagggatgccatgccagcttcctctacatccagcctaaggatgtaaaacaaagttgcatgtgatttctccatgttgggtgcctgcagatttccttttttccccctggaaatcagatatgtattaatatttttgcatgcagattgtaatttattcctgacctctgaagagtttctggtgtgcaggaagaagatcagccaatatcagttcagtcacccacattgttgggagttgcataaatcgatatgcaagagagtacacgaaatccacaatcctttaaagttactttcagcacagaaaggcataacactgctgcatttattggagcaccagggccctgaaacctggatgcacgttcagagaagtcagtccgtcagctgacactgcttgttacaaacagatgatgatcacatcacaggggctgacaaagaaaggttctaagtattatctgctcaagaccagaacacccagagccacacagttaaggccagcttctcagaaaattctccacccttgtagatgcccactcaacactttctcaacataatttatttttcttaggtaattttaaatattcaagtatttttccttccttttataaaccttttccaatgctccattttcatcttgaaagccatcatcgtagatttttccctcctctcaccacctggcccaatttaatcagggattaagtgctattaattccactgctttgcaccttgcttcctgcctccatttagtctcactgctgttgccttcgttcaagcccttgaccatgcctcctctggcctggtctgagtcttcacagggctaccggagtgcatatcctatgactcaataccttagaggctccaaatataattgaaatatgttctaaattgcttagtacagcatataataattctatgctatccaactccactctcgccccctccttctttataaaacacaccctattatcaggatagttttagatttatagaaaaattgagaacataggccaggcacggtggctcacacctgtaatcctagcactttgggaggccgagacaggcggatcacctgaggtcaggagttcgagaccaggctgactaacatggagaaacctcatctccattaaaatacaaaattagctgggcatggtggtgcatgcctgtaatcccagctactcgggagactgaggcaggaggattgcttgaacttgggaggcggagatttggtgagccgagattgtgccattgcactccagcctgggtaacaagaatgaaactctgtcttaaaaaaaagaaaaattgagaagatagtacagagagttttgattgtcccatacctagttgatcccctattataaacatcttatattaatacggctcatttgtcacaattattcagtcaagaatatgatcactgactaaagtccttggtttatttagatttccttcatttgtaatctaatgtcctttttctgtcccacgaccccctccaggattccacattgcatttattcatcctgcctccttaagctctccttggctatgacagttcctcaagctttccttattttcaatgaccctgacggttttgatgagtactggtcaaatgttttgtagaatgtcccactattaggattcatctgagatttttctcgtgatctcatgattaaactgggatgataggatttggagaggaagaccacagaagtgaaatcacattttcatcacaatatgggcagagctgggtttcaaccaagatgtctaagtatctaagtccttttactttagctattatttgatacaaagtatatatatatatatatatatatatattttttttttttttttagatggagtctctctctgtcgctgaggctggagtgcagtggcgcgatctctgctcactgcaaccaccgcctcccaggttcaaaccattctcctgcttcagcctcctgagtagcggggactacaggcgcccaccaacatgcccagctaattttttgtatttttagtagagacggggtttcacagtgttagccaggatggtctcgatctcctgacctcatgatccacctgccttggcctcccaaagtgctgggattacaggcctgagccactgcacctggcccaaagtctataattttaatgcattttctatcttttaatgtagtttttaattttcttgtcatacatacagattttatagtctaaaaaatgaatgtaaacacatttgaatgcttttctgctgaattaaaaaagtttcttcgattgtttctttaacaaagagaatcaaggactgattatactcagaatacactgtttcctacttttaaaaaaatcacagtgatgttatcaacgtttctaaataacaaattctagtaatagaataatggttttgataaaggtatttaccaacagtaaatgctaaacaaattgagagcacttgatactaattagtgtgtcctctctatctgacaggcatagcttgactatgacttttaaaagctcaggaagttcattctataaaggccaaaaagtggtccattaaatatcatgacaaaatcattctgagaaaaattgatacagaagcttgctgtccttgtcaaggcttaattccacataggagttaccaatgccaaaaagaataaatatcactctccagaagaataggaattaggtttaatatggcattaattcccaaagtgaagccaaaaagaatttgaatttggtacttttaaaatattactattgttaaagtgaataaatctatgtctggcttcattttgtttttaacacaagctggcaaaacttcttgtcttccctgttaccatatatagaacaattcagcctttattttcagaagcgaacactgtcatattcaaaggtatcctaaacaacagtttaatttttgcctttaaaattaagtatttaagaagcaagtggtgtcatcgtgtgagcctttcattttatataagtacttgttcatcctattttttaaattttttgggggggatcctcacttaatccttataactgttggacaactttacacttaatagaatctcaactgttgtaaattcttcttttatagccaatgagataaccacgaatatctttcaataaaattatctcaagccttgacgtagctttgtataacattcctggcatcagtaccatataggtctaactattttatcattttacttttataattgaaataattttacttctcattaatcttatcctaaaatattttcgtttcacccattgatttttccagacaaacttcagattaattttcttcccagattcttgcctcatccctaattaattgcctttaaatttgaattttattaaatctatgagtgtatttggggagaacttgcatcttttcaatatttagtatttacgtttttgtctttttactcaattctgtaagtttctgcatttcaatcttaggaaattttggttggaataacttctaagaatgttatagtcttgagatctttgcactgttaagttcttagaacttatatgattaaactttgtaaaaggttcctatgcattgttagaactgatattgatttttatattgcagtatattttctaatttgaaaaagatgtataatatgacggtgttagactgaccagcaattatatgacatcaagttcagcacagagagtgaaatggataaaaccaaaatgtttcctagtctcgtctaagaggagagacctttactgattaaatttgagcagtgtcacctgtcttcaaaaaattatttgggcatggtggcgcatgcctgtggtcctagttcaggagtctgaggcaagagaatcgcttgaacctggagtaggaggttgcagtgagccgagatcgtaccaccacactccagcctgggtgacagagcaaaactctgcctcaaaaaagaaagaaagaaagaaaaaattagtgacaggtccaaatattctgtagaaaatacaaatcggattggcagtcctcaagagctaaactaatggaattcattttacagccagaagctttgactataagacttaaggagaatggatgacaattacattctcaaagatttaatggcacccaactgaagaaggccaactgggagtggggagagagaaaatgcaaaatcagtaagatacaagtgtggctggcagtatcttctagcccactcctggcattgaatgttcatgttgtttattataagtattaggctttccctaggccaaataataaagacataagcaacacatggcatataagggcaaccagttggctgagaaggggatactgagtgagaagagaatatttaaatttagatgcggcagcatcatcaatggtttccagagcagtaaaaaaggcctaagcaggttttctctcactggtgctgagaagtcactgaaacactcaacatacactcaacaactacaggaaatggctccatcgctattcccagaaaagatgttcatatcaaggaaaagttaaaaacccattctagagcacactgagagaaggacacagcaggtgtgtccacaggcagagcactgcaaacagaccaatgggtgagccaggaactgaggagaaagttagcaaggcaccactggagatactaggatagaatctgagaccagagcatccaagaagagcttctgtaggatccctgctattacaatggggatgccaggcctaatctgcagtgtgcaaagaagctgtgtggatcttagttaaacaaatgtgatgaatttgaacactccccttcctctcaaatatttttaagcttccgcatcatcttgtgaccatgtttggctgggatttaaagaactctttctttcttaataagcagtaatcgagagcctgaagcatggcatctatgctgtttggaagagagggtccacaaaaggagcacctgtatatgatcattatttggtttaaactgacatttgtctggagaaaaaccttcaacccttttaaccacagatttttgcattccacccatgtgagattagcaaaaagaatacaatatgatttatatgattaaaacttcaattaattatgtagataacaatttatttatttaacaatttaactgattgttcggcccacctccatgcactggacaaggcactgtgacaccttctcccaactctcccaaaatgagcaaggcttagcaaagatcttctaatctagttaggggcaacagaaaagcacttaaatattgtaatagaaaaataatgtttttgttataacagtaagaatcaaggtttaaaaatgatattatgagagcccagagaaaagagacaataatagctaattggagaagagagaagtaaacaagcacataagagaagatactttgactctggggcagctttcaaaaggcagaaggaactggtgttttctttaagggtaaatcagaaagagggcaccaagacagaagacaccaacgcaggtgtctccttagggatagcaacagccatggttttccttgaagcaccattgtgaatactggataggaaaaaaatttatttttcgcttatgaaatacttttgaaaaccatgatagctgaaatttctcaagcttgatgtcattatatgcattcaaactgagccccttagattgagtcccattagcacagcaagttgcctcttgctattttgcagcacttgtcgtcattattaccaattaccttccatggtacccttgaggttctaagcacccgccctatgtacacctgcccttcattggttcactgtgctagagccatacttctgtgacatgtcatggccacccgttttcacatctgctctgcaaagctgaggtgtaatcagcagaactgtgctgcctctgcagagataattttctgaactactaatcagacttctcaagaaagtccttttagctagaggttataagtcaagtgtgtctcaggtattaccgccattctcttcatactgcaggcaagtcaatttgactcacaagctttatttcacattcatagcctgtgagctacactgaatattggcagaaagtgagagaaattagaattgatgatggttgtatttggccagcaagatcgaggggctaaatgacttgtcaaagcttggtcaagtagccaggttgctaggaatttaattcaggattttggatactcaaggagcagtaagtaattaattttttctcccttttattcaccaaactccctaaaagtgaacaattaatggcataagagttcaacatttcttgtatgccattttgaatcagtttgggttcaatagcatttattatgtacctaatttgagtgtgcaaaacacttcattagactcttgctctcaaggaatttagggaaatcacacatataaaggatgaactctaatcaagacaaaaggaatatccaaacttggatgtgctgattgcccagtgttagtgaagtgaatggtaaacttgagacacagaagtcaagttggttttatatcagggtgcagttctcaaagagagtcagctgatgtgagaatgcagagactggcacaatgaaacctttatatgccactttttatatttaaatatagggtgactttagatattttatgtcctatattcacataaagaaatgaaatagaagacttcatgttggtaaacctggatggactcttaccagatgattctggggactaatttactagttttgttttgtttgtttgtttgtttttctttttgagactggatctcattcggtaacccaggctggaatatgtggccccatcatggctcactgcagccttgacctccccaggctgaggtgatccttctaccttagcctcctgagcagctgggactacaggtgtgcaccaccatgcccggctaatttttctatttttttttttttttttgtagagatgggatttcaccatgttgcccaggctggtctggaactccttgactcaagttatccgcccacctcggcatcccaaagtgctgggattacaggtatgaaccactgcacccagccgggactaattaactcggaaaacccacttaagaacttgtaactctatgagtagacttacattattaatgacttttcagaacctccgagtgtctttaaattcccactgtaccattctgtgttcacctgtaattaccaatgagggttattacttggacaatttactaggtgccaggcaacatgctatgtgagttatatgcacgatttcactcaaacttctcagtaacaatgcaagataggtattattattcacatttttagatgaggaaatggaggtccagatggcttaggaaaattttcagtgattctatggccaggtggaggcaaaagtaaacacaaacctggctgattcatatcacctttacatataaaaaactccatacactcacacgcctaacaatcttccccatacaatcagcttcctacaagtttctcttgcagtaataataatatctatttgctattcagtatggaaatatgcccagagaaaattatttctggatagagcaagaaacatatactaaatgttcatgattattattagaatgaaattaatatacagcccaaaacacttaaaaatgtaaagtgctatataagtgcaaagtattttaacactccttacaaaaaataatacttgacagcggcatactgttgaaatcatggttgtgggattagagtgatttttcacttcctatttccctccaatttatttgtaatattgcacagaaagggagtaggtctctgttatctttgaattatttgccagaagtaaaacacctccctttttatacaaagatcccactttaacataaaaaactggggattcacagttaagaacacttgacaaagaaaataataggctctcagtcacatttttctgagttaactggaataggctgaatgtcaagaagaatgagactgtgttgattgtctattttgtggattcagttccattgctttacgggcaggtcttttatagcccactgttttattagcaggtcatgatttatcccacaattatcacggcaattaactcccatgaactattcattattaactctcaattttacatggcctattcttagaaaagcaactttttttgttttgtttttgtttttttaacaaccatatgatggtagtgttagacacagcagacatatacctgttagggagactcaacccaaggaaaaatgtttatgaatacacatcacctattttttttttttggtggtgttgtttttgttttgttttgttttgtttaagatctaggatcttaatctgttgcccaggttgaagtagagtggcttgatcatggctcactgtaatctcaaactcctgggctcaagtgatcctcccacctcagctgcctgagtagctggaactacaagttcacaccacaacacctggctaatttttaaattgttttttgtagacacagggtttcactatgttgcccagactggtctcaaactcctgggatgaagcaatcctcctgactcggcctccaaaggctctgcggtgtctgacaacacactcggcccaccttgcccatcttgaccctaccacaaaactactctttccaaatgtgtccctttgctatggttacaataatctatgagggattccttttcatgaggtgatggcatccatgtttccttagaaaagttgggtggtaaagaagagaatgttgttatgaatagcggaccaatggaaatgatctcctgtactgcgtatctgatttttagggatttaagatcaagcaagcaaataaatatggctgatgtcaaacagtgagaagttgttggaagtcatccagctttgggtggtagagtttaacctcaaattcactcagccaaaaacaacaacgacatgacttggtaaaaattctttgttgttaagcagtctactggaattatttttcattatctactaatactagactctcactctacacttcttctctcatatatatgcatggatggatataagtatgtgtgtgtgcatattttttcttctattctatgggagacagcaattcgttaaaaaatttctcccactttatcaatttgtatccattttttcatgggcccactgcttttgctgtgcttgggggacctatacatttgatatctgtttttccaaagcagtttttgtaatacagctgattgaatgtaaaaatcctgtagtttacccatggctcccaaattgctcatgtcccttgcactttcataaactactttcatttcctgcatgaaatctgtgaaatctggcagtgtggctcttagaagatgggaattgctggagtggtggcttttcagccttttaagcaccgtgtcttcaaagcactttgtcaaaacacatcataccagccacatctgttcatttatttgaaccagagaaaacagcttttcttttaagatcttcttcaatcatgcatattgctgcttaactatttcccaaaggtagatgccattgtccccttggcagcctgaacttatcagtgacctataataattatgcattttatttcagtcttgtgaaatttgccctggtctttgagtattctaggtctggaaagcaatgttagtcatcaatgcaattaattttaaacttggaaaggcttcacccaatctggtaaacttaaatctgaatataaagaaattcatcaattattagatttaaggttaagagacgtcagacggccactgtacattccatgtttacttcacttaaaatttcactgttgtcagaacaaatttaacaatagcaacatttagaaactactagaaagggttctattatattaaacaccagagaggaaaacataatttaacttaaaaaaaattaggtttggggtacatgtgcaggtttcttatataggttcacttgtgtcatgggggtttgctgttcagattattttgttacccaagtactaagacctgtacctattacttatttttcctgatcctctacctcctccaacccttcaccctcaggaatgtcctactgtctgttttttcccctcttcgtgtccatgtgttctcatcattcagctcccacttataaatgagaacatgtggtaattggttttctattcttgcgttagtttgttaaggacgatggtctacagctccatccatgttctggcacaggatatgatcttgttcttttttatggctgtgtacaattccatggtatatatgtaccacattttatttatccaatgtacctttgatgggcatttaggtagataacatgtctttgctattgtgaatagtgctgcaatgaacatacacatgcatgtatctttatgatagaacaatttatattcctttggttatacacctagtaataagattgctgcgtccaatggtagttctatttttagctctttgatgaattgccacactgctttccacaatggctgaactagtttacacttccaccaacagtgtataaacattcccatttctatgaaacctgaccagcatctgctattttttgatttcttaatcatagccactctgactggtgtgagatgatatctcactggggttttgatttgcatttctctaatgatcagtgatactgagctttttttttttcataagatagttggctgtatgtatgtcttcttttgaaaagtgtccatgtcctttgcccactttttaatgttttttcttataagttggtttaagttcttataaattggttaagttccttatagatgttgaatattggatctttgtaagatgcatagtttgcaaatattttcccccactctgtaggttatctctttactctgctgatagtttcttttgctgtgcagaagctcttaagtttaattagatcccatttgccaatttttgcttttgttgtgattgcttttggagtcttcatcatgaaatctttgccagttcctatgtccagaatggtattgcctatgttgtcttccaggatttttatagcttggggttttacatttaagtatttaatccatctcgagttgatttttgcgtgtggtgtaaggaaggggtccagattcaatcttctgcatatggctagccagttattccagcaccaattactgaacaaggagtcccttacccaatgattgtttttgtcagctttcatgtttgaacttttaattcaccaatgccacttggagcagccttggttaatcacttcttcatgattgaaggtttccagcagtaaaacacagactgcactaactgtatatctcctgtgtgatcattttaagtagcttattacggaactttcttctcccacatgctgctcccatgatgtaagttaggtgcttaaagaagaacacagataactcccttcaaactcccagtgtattcttttctaacgcgattcagtaatagctctctgttctgatgaaattactttgacatgtttctgttacctaactccccccaccaaacatgcttgttctatgatttgaaaatacatatatgtgtgtgtgtgtgtgtgtgtgtgtgtgtaagtgcatataattagaggttataatagagtttttctttctgtagaaaaagagttgcacagagacctaggcaggtaagttcagtgtctagaaggcaggtaggaaaaagcgttgatgtcaggtgagctgcacatgctggcaaaacctgcaggatgtagaaaggcagggaaccatcttgtgttgtttctttccaaatgttactatggaaaatgagtgtagagggtagtcacccaagagtgccctgccaagccctgctggagcttgggatgaaaggggaaatgggctcctatatacactcatcgaagcacatgacgatattttgaattaactggaaaaagttaaaaaagaaaaaagctctacaatcaaaaagcatgattatataaagccccacatagtccaagctctccaaatgtcatcatcaacactcataaacccattggcaggggactcacagccaattgtaagtgacataataacaaaaaggtgcacaataacgtgggatcagaaaacaaacacatggatgcctgtctttattgaaaaatttgataccttgctcctcatggattgttttcctgaattttgatttttataaatattccctaaaaatatgacttgatggactacaattttggttcccccataagtcttgcaccttcaacaagtttctcaccaatctcaccctaatcctggctctatcagccagcattttaaaaatagtaacaataaaataaaagagaactcagcctgggcaacatggcgaaatctgtctctacaaaaaattagccgggtgtggtggcgcaggcctatagtgccagctacttggaaggctgagatgggaggatcacttgagcccagaaggtcaaggttgcagtgagccaaggtcatgccactgcactgcagcttgggaaacagaatgagaccctggagagagggagagggagggagagacggagagagagagaaagagaaagagacagagagacagacagacagaaagagagagacagagagagagagagaacctaaaaggaattatctgggtgcctcacacacaaaggaaggttgagtattatttatttgtaatagtcatatttgtgtgaactgggttgggaaaaaaaaattgattcctgtctgtaggtgaaaaacagaaagagttagaaagccagtggcccagagagtccaaaatcagacataggaattgccaacacggacagcctgtgcaggccccagaaggccccatttgagaagtttttaattacgccatttctttcttaattcctttgcacaatcttttgcaaagaacagcacacagccttgggtttggaggaaggtacctgattttctgctactgcctctctgagttttaggtccacgcctttgtaccagttcaaaaggtattctagagtctaactttctcccatcattgaagtcggactcatatgaacttgattatgccgtggacactatggcactgacctcaataccgcaggaattggtgttttgcagtttcccagggtccttcctaagcacactgctattcatggcatctttctggcagctccccagtctggaaggtttacatccctgataaatgatgtctctatggataggaatctggatagtgaggtctcctggtgaaatgccctccaccacctacacatacaaaatgaatgcaaatattctgaactcttccccagaaatattcaggattcagtgaatagaggtcttcctgaatgcattagtatattcattcactgaacaaagaatgactgagtgccctttatatgctgacactgttctaggtgctgggaatgaagtagtgaataaaaacatcaagaatcgccattctcaaggcgctaacattccagtgaggaagcggccagcaagcagactcctgagaaggacacacggcacctcagagagcagcgtgctagagaggagaacaagcgggaagggcattagagatggctggaaggagggggatgtggttttaaattggttggtggtaaaacactgtctccctgagaagcagacatttgaacaaagacttgaaggaggtgagggagtgagtcaagaaccaggagactgttgtagcaaatgagaagtccgtgatgctggaacttgactggaagattcagtatcagcaaggagaccaaggggctggtgcagaaccagggtgcaaagcagggagtgaggggagagagcagggggcaaggagttggtgtgagagggtcagcaggcaaaggggaggagaaagaagacggcatgtgtggagccttttggggcactgagaggaactgggcttttctctgagattgaaaaccacagagaggcactggtcagagcaataaaatggctttggttttcattgatagcctccttctggctgctattgaggtgattttgctcctatcaaaggcagaagtggatggaggacagtagtggtggcagcagaagaggcagaaggaattggctgaattctgggtaatttttgatgtcagagccaatggggtggatgaattgaatacacatgtgataacaggtgacagtcaaagataatacctgattttcacagttgagcacctggaagcatggaattaccatttcctgacctgggaaaggccactcaggaagagtggattggcggtgggtgaggttgaaagttcactcttggctatgaggagtgtgacctgtcagtgagacttcagagcagccatgtgagttgggtgctgtatagggctgtgcagttcaaaggagaattgtgggctacacatctggccgttggcaaagaacagatgacatttaaagttagagggtacccaactggaagacctgtttcacattgttgcccagtgttttaaaagaagagatttgtgtacctttcaatggagcatatgaccttcaattgtctacactggccgccaatctcttttgctttattcctatcctacttcactcacttgcgaagcctgcagtcttgtaagctcctcgagagtaaggatcgtgaacttcatggttcagtgatgcatgtttttggcaccgagtctgttctcagaaagtgacaaacgaatgaatgatttctggtacagaaaatgcaatgtgctcaacaaagtttaaaggaaactgaactcccaggagtatactggaagatcagagagtgaagcaggaaacagactcagaagaaagaaatgtaccagaataatccttttactgccaggcagtcccaagggatggaaaactggattgggatagacaagtgactcaggtgggagaaactgagaatgacaactgaaagcaggcatagtcatagatattagaatcagtcccagtcaacaatagaggcacaaatttgttggcatcacaagctggctccccccagccaggctgtccagttgcacaccctcaaggttctcgtagcccaactaatggccactccacattgcacaaatgaatgaagtgctttcatgtgtccttaactatgactgagctgttctccaggacctgtctgcccatttcagcccatctcactcaatattcaacgatctagccgagtgttctgctcctgtaacaccacctccccatcaccacgtcatacaaatggagagtctgtccatcatgttacgcatagttgaatttggctccgaatctgccctctggcttccacagcactatgacaatgcctaggtaagagttagtaaatgtgggttgtatttgatgtcacacaggatctaaacacagagaactcacaaataagaaagggtcattctgtcacataaatgtgctgcatccaaatatccctttagagacagcacatttctgtactaagaaaaacacatttactaagagaagtgtttatatttatgcactaagaaaggcagcatctatatcctgtgggaagcagtccatgcatcccaaatatgccccccatatatacccaagacaactatatcttcgcagtttacaattaaaatgctacatactacattctgttattttaactattctagaatataaagaatggcagaaagtttccatatgcatcatatggagcaagtatgaactcattaaaccatcaaattatcctatttatgaaaagaaaagtagattctatgtaaaatagcaaacaagacagaacagtatacaaaaagagctcaattgtgctggaggaatgctcatagagttggcaatcttgaccgtcatgaagggtagccatcctgccctggtgggcctgccaaaactttctaaaagaggtgaaagtatgaaaaatgtaaaaccttcactatttatttatacctgattatatcatatacttaggaaagtccaaataatcaatagaaaaaatctttaagaacaaattttcaaaaaaaaatgtggtttcatggcaggttacataatatacactgaaaatcaatagcttttctgtaaactggcaaaaaatgtacaacatcattgggggaaaattcatggtagcatcaaatattataatatgcctagcatagacataacagaaaaggtgaaagaaacataaaaacaaaatgtagaattgttattggaagagtgaaaacaaaaggaaaacattttatgcaatcagtagaaaaaatcatgtttctagatgggaggacacagtattttttaaatgccacttcttaacagagagagagagacagagactgtgtgtgtgtgtgtgtgtgtgtgtgtgtgcgcgcgcgcgcgtgcgcgcgcacattcaatgcaatccccccaaaatatctattttaattctttttctacttgaaaattcaagtctaaattaatctcaaagagaacctgaagaaaaccagttttgaaaaagaaaatcagctatcaaaatatactctaaaataaatagcctgttagtagtacagatataaacaaatatatcaatggaacacaaggtgtccagataaactcataggcatatgagagcttagtaaaaaccattatttggtaaacaataatatttaacaaatgataagtgttaggaaaattatgtaccattttggaaaatataggtctctgtctcatatgatattgtacacttttccaggaagatcaacatatttgggagaaacaaactccaaacaagaaaatgaatagctatgaaaataggcaaaacgtataaggccattatttttattttataatctttcattgagaaaggtctttctaaacaagatgcaaaaggcaaaagttataaagaagagtaaatcaaattaaaatttcactaagtccaaagatatcataaacaacttaaaatacaaaaggagactgaacaatttttgcaaagtatataatgaagagttgataaaacatggtataagaagccctataaataaagaagaaaaaaacacccaatttgtaaaaatggccaaaatatataagcaggcaactcactaaaggagaattaatacaaactgctcagggatggaaggaagcagcctccatttcagaatgaccaggggaatgcacattgccaggaggatgagataatatccagtagatcacactgggtgataaaatccagtagatcatactaggtgataatatccagtagatcacactaggtgataatatccagtagatcacactgggtgataatatccagtagatcacactaggtgataatatccagtagaccacactaggtgataatatccagtagatcgcactaggtgataatatccagtgctaatctgcatggggcctggatgggatattctcaccttcaatacttgttcaagttggcagaaactttcagaaaatcaatttgccagtaactattgaaatggaaagtgtgtatagtctttttttccccccaaattccttatccaggaaggaagaaagaaggtaggaagaaagaaggaagaaacaaaaggaggacattggagggagagacaggggaaggagggaatccaggaggaatgaaggaagagcagagaagatgggggagaaacagagggaggaagaaggggaaaaaggagagactgagaaaaaagcaattcaaaaatcatcactagtttatcttcagctataatgaacctaaatagtcttcatagtattattacaatgtgaagctatctttcttcatctctaatttgggaaaattttaccaaagctgtatatgaaataatttaaaattgataatataaataatcacctgctgagtagttatgttttatcctacttgttgctgctaaatagtttgaaatatagtttatatcacacatagtttatttgaaagcagcttacatatatagtaataactcaaagctttggacatatgtaaaatgtctattttaatgtctgtacttatgttcacataaaatgatgttttacctggttcactgaaaatacaaaatgagttacatattttttattcacttttgtattggtaagattttattttctttgctgaaacctccatgaccaaacactgactagaagatataaatgatcatgtcaaaactaattataaatagatcaactacggcaaaacttttatttaaattccttcttactatatactcttagcttctacttaataaaatgcaaaacttactaaaatgcatgttctgtaccttagcatcttcttaataatacatacacacagcgacacaaagtggttatttaaacaatgcaaattcttagtgtcatgttttcctttatgtccagaaatataccaccatttttactataatttaaaaatctgaccatatggtcattttttttaacactaccctagtagagtttacgtcttgtaggggcaaaaaatattaaactccaaatcacatgaacagcccagtgataaactgataaccacactgcaggaaatgcacagagatccatgaaggtggcatgtggcagtcagagtgcagtgtgctcgtcagagtgcacagttacatttccagggacgctgtgagtctttaaatgcagacaccattaaaaattaaattatatatgcttataattaaatcatttatattaaaaataagataatattttacattttactatgatttatgcttttgaggttatttttatcttttgtgtctatggtgaaaatactataatgtgttactttgcctctctttccaactccatgcgacctcatgttggtagcttgaaattgaccacggtgggagtatttagaccacagatacgagcaaagactacggatcagtggcttttttttggtcccagagatctagttgttaaacattttccagcataccattgcaggaggctgtatatcaggcagcagtgatctaacctgcagatagcaggtatgtcaagatgaacagggaagatgcagcagatgctgctagttgtccacccacactcattctcagccactgttttgtttgtggtggcaatttgcgcagctacaaaacctcatatcccagcctactgcctatgatctaaacatctgattatctaagaaaatactgacttacttagtatttcttaaactgcagtagatttcccattatttatatactttcaaaaactgcctttaaatttttttataacgtttatagttagcctactttaaagtaataatatccaagaatttatggatcagatgtattatgaatggtttttaaatacccactaaaatatataattgttgagccaggggccaccagcaaccatgtcatgtcatatctcgctacttctcttgccccaccatttgagaaaacactatctaaatacagttatttctctttcacatcgtagataaagaacatgttaaccaaaaatgcggttccattacatattttacgtttttgaaattgctattggcttcatctttttcatgtaaaagtttagcttcttaagcagcttaagtaaaaacatgattgaaaagaatattttaaaattaccaaccgaattggtaattttggtatatggttttgtgaattataacacatatatagattcatgtaactagtagcataatcaaaagagagaagagttcaactacctaaaaatttccctcatgcaatcctttagatactccctgacaataccccaaaccctagcaatctactgatctattggcccactttccatcgttatgactgtccttggagaatgccatactaataaattgtcatatactacataatcttttccaaatgtcttttgtcacccagcataatgtctgtgagattccttgaagctgttgtgtacatcaatagtttgtccttttacattgctgagtagtattccagaacatggacgtgtagagtttaagcattcactagttgaggttattcaggttatttccagttttggactatcacaaataaagctagtataaatacttgtgtgcagttttggtgtagacacaagttttcatttctctagggttaatacctagaagttggattctgggtcacagggtacgtatatatttatatgaaattgccaaactgttttccacagtctatagtattttgcattccctcgagccatgtataagaattctacttgctccacattctctccagaacctagtactgttctgtttttaatgttagccattgtggtaagtatatagtgatctctttgggttttcatttgcatttccccagtggttaacgatattcaacatccatgtgcttagttggcatccttataccctctgagattcagtgtctattcaagtccttccattttaaaccacagacctacttctttttgaccatattcctagataaaatttgtaagacataaaaatatggctggattccacagtttgctagaatttcttatgctgtcaactcattttcctttcaaaaattcaataaatgtggtctgaaaattattgaataggaaaaaacgtgactagaggagctttccaacacacagttttacttccttggagtgaaatgaaagcagaatgggttgggagatgcattctcctggataatgtaaccaaatatgcagagaagttaatgagtaataacacagtgattggcacacagctgcccacataacatttacattcacataaatttattctccatacttgctcactgaggtgtcctaattcacatatgattgttattcattttatttataaattttaaactagatttattattaggaaagcatttatcatcggcaggcacagctgtgtgtgaaacaacaacttagtgaatgcgtacgagatcgtctctgtgaatttcgttctaggtttattgtatttattccaatgcctcttgcctccacctgctctagtaatggctcagattcatattctagaaagagctttgcagccagcccagtaccactcctggcccacactgacagagggtaaaatccctgatgtgaattcatgctgataggtggtgcaggcaaacctcatgataaaacaaaatctcagcttctcctgagggtctaactttctgtctttattgttttaacatttggctttttgctacacagagcttgcaaccacatttttaagaactctagtcaatgagattttttaaaattttcatatgaaaataatgatgcacatatttttgaagccagacgctgacagtcaaagaatcagaaaatggttcacaattgtgttttacatactaaaaacgtaatatattttgagatgtatgctgagctttatcctttatgtgctatttataaaacataatgttaaaataaaattaaaatgtagtttccatagctataatttatttcatagcttttgaatgtacatgtatatttatcacacatttactctttggcaaatatggactaggcactaaataaaagatctaaaagatccacaaaatgccagatgtaatgagaactactcaaatatctcaagacatttcatttgaattttatattcaaattattgtgcctgactacaaatgttggccttaagaaataaaaagaacatgcacctgtacagacacatgcacacatgcacacacacacacagaaacacactatgttttaattttggtttttcattgcttagataatttgcttagataatctgacattcttaaatattaatgaatatatcaggattgaccacagttcatcaaaagccttcaataatctatagtacacttaatctctcgaatgagataaaatatgccaaataattgctcatcaaaataaaagtagaaggcctggcatggtggctcacccctgtaatcccaacactttgggaggctgaggtgggaggatcacttgagctcaggaggttgaggctacagcgagacgtgattacaccaccacagtctagcctgggtcacagagcgagaccttgtctcaaaaaataaaattaaaaataagaaacaaataaaatcacgagactgtttaggaggggaactgtaaccataatgaagaaatcaaaaagcaagatgaatgtgaccatctgcttccagatttttgaaaacacagagtgaagttttagaaagtctgaagctttcaaaattccatgataccagttatgacacggattattattaccacctagtatcctcctgtcctggttccagttgctttcccagtgacacatgtccacctccaggctcttttggggaggtctccataaatgatggggttttggatgtttactgggatggcccatttattttaagaagtgcaaacagttcaatagtgcttcctgggtaccacacacaaagtgctttcttttttcccatgtgttatctcattcattcctctcatccacaccaacaggtaggtacaattcttaataacatccccattttatggaagagtaactcatgtgtcgagaagttaaataatttattccaggtcccagcactaggaaggggcacagctgggattccaactactggcagtctggctccagagtttaaaatcttaaccacaccctgcctcctgggaagacagaaatgcaaagcatctcatatgcagagcagaatgtcaaattctacttctacaaaggaagttctggaatgactgaaggctcatgcccgtcatcacagttacatctcctctttgcaagtgctctggttcctcgtcggtgagtgggacccttgaagcagttattgatgccaaaatggagagatgctaaagtgacaattctgatttctaagccgatacccagtcaatgttttaaataacatatctgagacagaatccagtgactcagcaactacttgtgacgcattctagttaccattgaacatttggttctctctagacactctgctgtcaccaaaacactgctatttcatgcatgaaaacttgcttagcaaaaatattttcaagaagaacaaggacagctgtcaaaaatcatcataacctttgcaatgtgaggaatcataaaataagctgctgggtaatctttaagtgtgagatggaaaccgggtatagcattcaaagctcataacacagaatactaccatgcacacatcccatatatcgctttatgatgctaataaaccacacatgcccatgtggcttcacatgaactctgcaactaccacatggggcaggtaaacggcattttactggcatgttctcagaaaaggtgaaagcatcaatccatggttactaccctgtggcaaaggagcttttagactggtgttctcgcctttacaagatgggcaacattcttcatttcctgaggtcttggtacaaggaaggttttattcagtagtgtgggtgtgtcttacacatatttgtaagtatgtgtaaatatcagaaaatgcatatgtagatatctgtacatatgtctatatatatgctttctgtgaatgattttcagatatctctttctacagctatatatatatatatgtgtgtgtgtgtgtgtgtgtgtgtgtgtgtatgtgtgtgtatctggactttctttctcctatcagccattattccatgaaaaagaaataaactaatacaaagtagtaaaataaaaatttctatacatattaatagatatatatgtctttattcactaagaggtatatacatctttcattaataaagatatatctatcattaataaaaatatatattcattaatagatatatacatacctatatttattcatgcaattattcttcatataaatattaagaaaaggctgggtgtggtggctcacgcctgtaatcccagcactttgggatgctgaggggggcagatcacttgaggctaggagagtaagaccagtatggccaacatggtgaaaccctgtctctacttaaaaatataaaaattagctaggtagggttgtgggtgcctgtaatcccagatactcaggaggctgaggcaggagaattgcttgaacctgggaagcagagggaagattgcgccactacactccagcctggatgacagagctgcagtgagcccagatcctgccattacactccagcctggatgacggagtgagactctgtctcaaaataataataattaatctttattcatgcaattattcttacagttactgggtttgaatgagtgacctgcgtggccttgcttaaatgaccacatcctggcctgctgtgtggaaagcaaagggatggggttatgattccatcagtacctttcagtctcacctgcagaatccctgagtttgaagtatcagggataactgaggtacaggggaaggaactgagatttcaggctccacaacttcaagcaactaaaactccatctcttgggttaaactataggctgcacttctgagaaagatttcactaggaattctccatcaaagcagacgtgaaaatcattgatcctgaaggttccttagagctgtacacttctgccattgaattaacttaatgtttaaatgtattgtaatcttataaagaatggcatcttcttatctatacatctgagcaaaacacaggcaagcacaatattgctgctttaatggagatatataattgtctagaagtcatgtatactgggctgtgatttatatatcaatgcaagactttgacaagagctgttgccttacttagattaatttcagttaactgtcagtattcaacaatagttaaattccatttagcagaattctaaccttcagacttcattttatcagaatcaatgaggttttacttaatgtcttatttcagaagaacatgctattcttttaagaaaaattttgaatttggctttactaattttctctataaatattttcaacataggaaaaaggttaaggatatgaaaaaggttaatttactattattgtagatttgtagctgcgataatttagaattatgaattaatacttaaatataaatttttagatacataacattaaagagatgtcaaatattacagtgattaaaaaatctttttattaaaaaatggtagaatttgggtataaggaaaattattgaaatttaaaggactgttaattcaatatctatccctcaggaacaaaagatctatttgtggtccttaagaatatagtagttgtcacaatatcctgattagcaggtttctaaaccttctagtgaataattattacaatcactgctaatagattaagtgaacttcatgaacattttctcactctgatgatagggtcaatttgttgttatataatcaaacatgatggaccttttggtctcacatggccaaagagaaggacaattttcattggtaacagacattttttgaagttcagttttaccaatcacttactgcattcgtctgtttacaaaaaaagagagtgatttctcatctgtaaatacctattataatatggctcaagtaccaaacgtgtgtgagtggtatttgaaagaaaaaaaaatttgaaataaaataaatacaaataattttcaaagaggtgctgccaccttttggttgaactcccctgaagcattcgctcatttctgaaaatttgcaataaaaatgagaaatgcttgatgaaaggactgtgaaaatatgagaataataagcaattccattatgtcagtatttcttatttggatggctcccaatacttctgataggtttcagaaaagaataattgatatgaagtggtttttccaaatgttagtatggcagtagaaagatccacttcagaaatggagaaatgttccatgctttattgaggtcagccatattaatgctatgcctctgataccaattgagtcaataaaaaagtaatttttattgtattgaacaaaagaccacgaaagatcacttatactttctgttctcagtattccattcagactcaaatctttcatttcatcattaattatttctcatatctgtgaatatcctttcaccaatgccattctctagatataggaggggtcaactttctcctcactgcttgacttacaagttctttaaaattgctttccttcctaaggaatcaatttgccttagtgtttaaagagcagaagccccttacgaaatcattttgccacagtgtggctactttagttgtcatctgataaataattacactaagagtgtgcttcatgatttttaacaactgtatttaactgactctgacttgaaattggaagtcttttttcagtcaaatggtcacctttattaattatcgaaatatgtggaatgaatagaaagattagtaatcatttactaaatgccaaatacttcactttaaaacctcatcttgaggaatatttagtagcattgctgatatttacagtatttcttctatcccctttaaaataattatttattcaaattaataacctaaaaaccaaaaacttgcagtttccaaaatgcacctgtagcctaaaagaatcaaagctaactatgtgagccacaggctaattctaaaggactcaagtcaactgagatttaatccagtttttgtactggcgtcaaccttgaactgcccttgagtccagatacaagctgagaccatcacttccccttgagatctgcatatggggactttggactcttggcttattctgggcatcttcacattccaggaggcagtgcagggcttccatcaacgactcttctttctcttgaacttctgcattcccaccactccctctctcctgcctctggcagaacaaggcttgaagttcagctcttaagtgacttttgcaacagaaaatcaccgaagttctgactccagcagctcttgctgacatctgaggagggtgaggacacctaggcccaatttcccagctcctctctgctcccactccccccagtgacttcttcacaacccctcaacccagtggcccgaaagatgcttctcccacaagaggacctgtgtatctggcagtacctcaagtcattgctatgatgttgttataattcttctcctttcctcaccccatgctgtctcaggtcttttccatattttctcacttgatatcctttaacatgcttattctgaatcgggctacactaaatacaagtgaacacaatccccccattaccttcccttttgtctctccttacctggataaaatagcaccatgaatactctgccaagggtatttctaaagtgcattcatctattgctgttgtaaggcatgaacaaacagtagaacccattgaaagcctgtgtcttgacctcagaacagtcaggaatgagtggtttcaggtgcaccaggccagggctggaacctcactgcctgtcagcacatgctgtgcagctctgctaccattcagaactgtcacactgagaacatgtttggcttccatcctaaagatcatttaggtcatcaatgttttattgtaagatttcttcacaggactagtccaattagagctgctctttatgcacatgacgcagaaaataggggtgtccagggcagcagcactggttatattgcattccatcagaaaatgcacttggggctgtggagtccccctccaccctaaggtaggagtgtgtatgaaatattacacatgtacatggtgaagttgggaaggttctacataatcagggaggcaaagaatccctcattactgtcagtaaaaggaatttgccacaaatttggcaaattttgcatctacttgcatctattgatgcattatattcctaaagccctacactcagtcagttgttttgaattccaaattcattttcccatagaaacagtggtatatgttagttccaagttctgcttataaggttcttcaacatcaaagaacactatttggattacactagccataaagcaggactggtgacatggtgtgagagtgggactgggccccacacctgggagaagaaagagagccagcccctcctgagttcctgagttttgactgcctgatatcggcatattactgggctaggtattgtgcatccattatctcctcaaaaatttggtcatagttagggagtacagggttagtaaacagaagctcagaaaagccaggtcccttgatgaaggaagaatgaaggtctgaccaaccactagagctggggctcagactcatgtggtctgtctgtgtgtctctaaagtgagaaattcattccatttgaacagaggaagttcttcctccagggttctaatcatattgattcactcatgtgactactttttttttttaataccataccaggtatttccaatatcaatggaaacaaagatgtcacttctgagtcaataatatttgaggtctaatgtgaaaggtggatgtaatctacccacataaagaacgatgcaaatagaaattatgatgggtgctgcaggaaggagtagggagctgtgagcacagagggggctatgttagattaggtggtcatgaagaccactttgagagtggcacttcagctaagacaggaatgatatgttgacatccatgaggcaaagaatgatgtgcgggggggtgggggggggcaatatgtgcaaaggccctgaggcacaaaagaacatgaggccttttaaagtactgaaatatctgctggggatactataagggagtggagagaggagaattaatagacacaggcaaaggtgaaataagaggcttattttctagacattgacttgtgtgtgtgaatcatccacgaatctagtgtgtataagtcagaaattactcataaattgggcaagaaaaattaagaagataattatatgatgtagggaaatggttttgtgatgaactgtactatcatttagcaaatctgtactcctccccaccccactgccatggaataggctttgtgtcccactgactatggactttgccaggtaatgtgattcagccaatgggatgtgagaggatgtgacatgaggcatcagattttctagccaggcagcacatgctcctttaccctgggcccagaacaactgcacatcaaaggggcctgaaccctgtctgcaaagtagagtcaaacccagtgaatgaagtgcctgaaatcaggactccccagccaagaactggcaaattggaggtcaggcacaatgtgcatgattgtgagtgtgcaaataagtgcctggcattcaaggcccctgagttttggggtggtttgttgcccaattttactgccacaataacagactaaagaaaaattttaacattaaaactagccatcactctcccccaccccctcaaacacacatacacatatgcatttgcaaacaagcacacacacatatcaactctgcccagctcatcaccaagttcgacaaaacaacaggaaaatgatgattaggagtcagtgcagcatgggaaccttgatcatgaactctaacactactaaaagatggcttgttaggccatgaccttttaattgaatgaaaaccaggctgctaataccaatgacaccactctagacttcctcataaaacaattattcagaatattttcaatgttctgcaaaattatttcacttacaacaatgtagggtacaagcaaaacatgatggcaaaaaagaccttcattaactagctgccatatccatgagctcagttttcagcttatggatgctcccatcttttctagcagcttcccttccatacagccaataaaatgctggcagttaaagctgctgctttggcccttcgcgtatagctagataatttttatattgcaaaaatgcttcccaattcttaagggtttttttcctttacttaaaacaaattttttaaagcatatcttttaacagtgaggttttctacatagactctgggacgacaatgaaggtcatctaagagaaagaaaattgcattgatatattcggtcactgtataagtggctcaagcagtctaagatctggatgtgtgtttttttttaaatgtatttgatggcttttgaacattctcatctcctaagaatttgaacacattaaaatgcagacttcatgagatctggaatcctttcttctgtgcagggtgttttaaaaataggacaattaaatttcttgttcttagatacataggtttatagaattttccagctaaagaggcttcagaactcctgtattctactatatctcaagttttgagggaataaacacctttgaaaatctagtaaagcctatgaactacctggccagaaaaaatttcaagttaaaatatggtatatatttacagggagcaaagcctcctgaaacctatctatggataccagttcacgatcctctgaaaaatagctctgatcttgtccacattctagatgaggatcacttttcctgccctgtccatctaattctgcattgccctacaggcttagtggcagccaaaatcctgacaagaggccagacaatggcaggattaccatttgccaacttgtttctggtttatttgaagcatttcataaacatagagagattactgaactttggtatatccattaccaagctccaatatttgttaacattgtggccaccttgtttcaactatccttcgtttttggctgaagtatttttaaaaaatccaaggcatcctgccatttcattcatgaaccctgcagtgtgcatccccaaacaataagaatatgccattatcctgattaatagcaattctcatgccaattatcagaaaaccctatcacctgatttcaaattcatataaaaatttctcttgtctcaaagttttttttacagttggtttgtttaagtcagaatccaaaaaatctgtacatttaatttttaaatttatcttaaggctcttttacttaatagtaccttcctaaattctctttttattgatttgtgataaaaagaagtatttttttttcttgaagaatctcccacattctgggtttgccaattacttccctgtactttcatttagtttgttacttcatcccatgcatgccctaaaatttggcaggtagagataagtgatctttattttttgctcaatcctatttaatataaaaagggagtgagggcctgtaagaatccccttatgaagagtacgatcaatgaagggcatgtttttatgtttcaatctgaatttccctcatctctgctgtaagatgctgtttcactaattctctgataagaaacagacctttcctgtatagacaccctctatgcctgcatattatcctattctgaagagtaggtaggccgtaataaagcatattccaaatcttgccctgagacaatatgcatgggagtgtctggcacaatccctaacacatggcaagctcttaaatgttagctgaagcttaaaataaagctcatttctcactcaaaataactaaacatcagttattaaaataaataatccctttcagaattgaggtaaagaaaattctttacaacccatcataatataaatcaaaatgttctctgtattgaaatggaataagaatacctcttcctgttcactgtcatggatgatgttgacttctagccaattttgtgcttatctgatatccaaagactgataataaaaacaaactaacaacagcaccaaaaatacctaatcaaaaggcagcagacccagaatacaacttaggaaggcaaaatcagtatcttagcagggttgcatattattgttgctgaaaaatgaatattccaggtaatcatcaccatgctgtcattccacacattgaccagtttattactccaatagctacatattctaaaatacacatactgaacaccacgctgtgaagtatgcatgctaaatgtatctcagagtagattatgattttatgtgaagaacataaatagaattgatttttttgtattctctcagaatcaaaatctgctgctcagaaaatatctaaggattattattactatatagacaaaacctaatggaccctgatgtaaagattgcattagccagaacattagcatgtcagctataaatacctcttaatttgtaattaatcaaaaactgctttatagtatctcttttattgaattttcttgttgtttaactttttgtgcatctcaagcatattttaacactccttgaaaagagactactctagtggagttacttaaagaggacagggtttatctaattgttcattctcttattagatagcctgtaaaaacaatatggttacaaacacagctaatgctagaaaaataaataaaaaggcacagttgttgtcctcaacagacttacttctttgaatctctcttccacccattcctgggagccaagggggaagccccagagtttcacatgctccaagaacaagacaggagccttcaggattatctctctccagatatgatccctactcctgcgagaatgagaatgacattccagaactgtgtactcctggcaagagttcccacactttacaaatgggaagtgactactgggtctctcacctgaccagtgaccacccaagctcaacaaaagcagaagtcactgaaaccctgcatctcaacactgagaggtccttataacataaatggaaagtcagtgttagtgcaatccaattcaacaaatacttattgcaactgactgaatgtttacgttgtcgctccccaaattcatctgttgaaaccctaatcccaatgtgacagttactggaggtgggaacgctgggaggtaattaggtcatgaggatggagccctaatgaatgagattagtgccctcataagaaggggcaggaggctgggcatgtggctcacacctgtaataccagcactttgggaggccgagacgggcagatcacaaggtcgggagattgagaccatcctggctaacatggtgaaatcccggctaacatggtgaaatcctgtctctactaaaaatccaaaaaattagctgggtgtggttgcaggtgcctgtagtcccagctactcgggaggctggggcaggagaatggtgtgaacccagcagacggagcttgcagtgagccgtgattgcgctactgcactccagcctgggtgacagagcgagactccatctcaaaaaaaaaaaaaaaaaaaaaaaaaagaaggggcaggcgtgctctctttgcatgtgaggacacaacaagaaggcagctgtctataaaccaggaagagagtttaccaagaactcattcctgccagcactaatgttacacttccaacgtccagaactgtgagaaataaatgtttgttgttgaagccacccattttgtgaaaatttgctatgaagtccaagctgactaacgcatttattatgcaaccactatgtgctgtgcatttttctaggtactgactgtatagcggatgtacaaactgttacctttcttcatggaaattcaattcaaggagtgtagtgtggaaaacagaatcctatataatccttacgatttgtacctgctgatggttgctttgagttgggagataaaagactggtcaaggaatttaatatcagcacatggttgagaccattcatgtctgtgaattacttataaataaaaaatatgatacttaaataaattattaatatatgtgtatacaatgagactcttggaagacatcttccacagcagccctcaccaccaccatctatcttgagctctttgaaaataacttcctgtgatttttatccctgttcataacaatcaccacaaagaatccgggaacatttggtaccccagactatcatcctcatagggttttgcacatccccttgtctaagattttccaccctcaccaactcctgaaacccttcccctgtgacttcttggaaagatgaagaaggaagctgtcaacaccaaaagaatttattaaagaaaacactatgaaagaagggacctagaaatacatgcaaaaattaaggccaagtatacttcacactatgagaatacaattaatggaaatgtaagtacatgtacaaggatatgatttgtattcaacatcaaataggagttctaatgaaagctttcataatatccacagtcagcatatacaaattaaattgatgtgtggattattatattcacattagaaactatcaatgaatgaaactgtatgtagcaacagaaatgaggctaaacattgcagggatggagtcttgatttcataggggtcagctcgcatctgccctttccacatcttcagattgcatctatccccttcgcagtcacatgaagacagcctgcaaatgcactcgccatgcaggggagacacagcttattaaagctccttcactattaagtgtctgaacaaagtaagggtatattgttacgcttagtgagggctgaaagtcctagtttcttttcatatactgctcggacaaaaacaaactatgactctaaactcttacttcttctaggctattatatttagcttgggaatcttgttctcaattgaaagatcaatggcctatgtgaccctcaaatgtctccgttgaccaaggttttcttattatttaaacttctgctttcagcttttattttgaatgaatttcgtgagctgccaattatgtgataataagctttaatcaattaatcaatcaatgcatcttcataaggaggtatcttatgatattgtttgtatctaaaagcagcggggttgtgtaggtttattaccactgcctaaggacagctttagtcatgacggtgcaaacataccacacattcactcaaactccagagtgatttaaagagcaccatgaattttgccattggattgagcattataatcttttctttctgtaaactggtttgttcatacttctatacattacgatgtcttgtacataccttgtgatggttacttatggaacaaaacaaggatgttataaagaagaagatgtagcagaaaacatctaaacctaagtatgttttcctatgcctcctttcctatctctgatcttgggagaatgagccattcagaatgaaggacaacacataaatcatttacaaagaaaaaaactgcatgaaatatattaaatcagcatttccatttaagtggctttactgctacctcattctgaaagataattatcaacgtacaaaacatagagagtgctaaagaatcattatatttatcaccgacattctctggaagctagactgaatttggccattatttgtagcttttacatgtgaataagataaccatgaagagtgcagacagggaacctgatgctcctctcctaaccccaccctctccaggggaccaaatctactccttggataaaggcatggtcaggtctaatgctgttgctgctgctgctgccgctgctgctgatgatgatgacgacgatgactcagcgtaatgttagaaatcattattaatcataaaagcaagataattccagtaactaaaatcttgtgttttttaagagttaagagcccagtctttaaaaaaattgtatatgtatataaaatttcatcatgtccctgcaccagctaggacctgcttcagttgagaatcctcctatggtaacaaagaggcatggctggcttccagttgatttccccgcctgacaattctttcccttcacaccctgagctggcatccacgagggcttcccactccttcggggccaagatggttggggccaggccagcgattgggcatggaaaagtcttcctggaggaacggtgtcacggcccagccttggtgctctccaatgtggatggctgtggggagctgatgcttgcctttttcagatacatttcatgggtttccttgagaggctccacagggaccatctgacagccactgcctgagcctgggactagggcaacacctctctgttattccttccccacatcctactaccgagtgcagctttagagtgtgacagtgaccctgtagccttccttgctgaagattcctgctattggcaggcctcttgagcaggttccttttcctgagaacctggtaagcctcccatccacagagaccccacatggcctccttttgtcctggagtctgaagagccattctctcccctggggccctctgctgcacatccacatcagctaatctcctgcctggaggctgctgcgggcatgagtcatagcatgaactggtgaaatatttctgttaaaagagttggtgcttttataaaaactaggtcgaatgttttggaaaggcactatcaaaaactgttaacatttaagaaaaaatacgacaaatgataagaggaatcattaaaaaaaaaaaaagtcgagaaagtctctgtatgcaaattgcttcacaagttaactccaagataccctgctctttaaagacgccaaaactagaaatggctgaggccatatcatgggtggagtttgcctaggagagaagttgagaaaatccagtcagcagggccacatgcttagaaaaggcacgggctcctcagcaaaatgctggtaaataaatcaacactcacagggtttatgttgaaataaaccgcttaatgtttgcaagtaacacatttataattttgtctgaaacaagttttccagctgattgacaatctacccaccattcctcactctataagaacaagcgcttctgttttgtcatgttgtctcctactgtcaggttgtagagccagaaaacaaaaaggaaaaccaaaaatcctaaggcagaaaacaaaaaaacagccccctccttcatttggcttctcccatctgcccatatcttttttcattcgcaccccaagttctaaatatcttagtttacttatatctccatgcttgtatttcaaaatccctcaaaatgtcactagaggccagtttccatgaagctaatgaattatcccccaaattacacaactcagcagctcctcacgatcctctgtgactgacttattttctggagtaatgacgcaggcccccgtcatttttctatggttcctgtgccagctgcgttgggttttcctctcttcgatggcatccattcattgctcaaccacaagatccttccctgcagcctcttctcttcctcttgctcataacaccatgattaaatgtgagttgaaactcacatttctagggtggtacccatggtgtctgtgtgcatggtgtcacagctcgggacactgcacttggccactgacggaggctcaggaaaggtttgtaggataaattgctaacttcccaacctacactgttagccttgactcctccccaagctccagacctacatattagggggctatcataggagattggccaatagggcaggctccagcatcagaccacctcggttcacactctgtctccagtactagcaaattggaaggctttgggaaagttacttaactaagacgctttttcttacctacaacacagggataataaaatagagatttaaaaaataagcagtatattgttttgtttactttttatgccaaagctttattattattaatattcacagcaatccttcaacacaggtcagaggatacaaaatagccaaaatgtaggatgaacaagtctggagaggacagcatgaggactatgatgtgtacaattatactacatttggaatttttgctaaataagtagattttagctgctcttgctacaaaaaataaaggtaactatgtgagacgaagcgtgtttattgattccactatagtgaccattttagtatgcatatgtgtcccataacaccatgctgtttaccttaaatatacacaattcatttttttaaaagataaacatttattgtaaacactatgaggcatgcccagggcttggcaaagtgcctgatggctagcaagccttccacaacaggtagctttgcttaaccacttgctagataccagctcactcatatcactctaacacctcaaatgtgtccaaaacttaatccattacttaaactcaaacagtatcttcccttcttcactaataaaatcaacccagctttagcgatgcgactggtaatcaatttctgaattgttttctacttccccctcaacccttacatcgaattagttgtcaagctttacctctccacgtactctcccaaatctacatattaaatcttatatctgatcctttcttttcacagtctccgacctacttcagacctcatcacctttcgcagggaccactgtaataggctcgtacctgggacagtacacaaggattgcctgtagagtgcttgcccataatacttctctttcacctccaaatacacccttagtatggctaaggatgttcctacataataatggctttaaatgactgagaaacattcaatggttctttacgaaatgaagaatcaagtccaggcttctagctctatgtagagtaagctaagagaacaggccaaatggaaaaataccaccacacatgatgatggtcttgtttaagctatacaatcaagagcatactttgtagagataaggctgggaatgccttctgagagaagtaaatgcccctcctccatcacccagaggcagaaaggaactgggcttttgagtggggaagggatttcctccttcctccgttgcataaggttggtaccacatgggctcctaggtgtggtgatgaagcacaaggtgcccccaccatcaggctgctgagaagtctggaaggggatcaagagcaacaagcagacagctctgagagcaggtgtaagccatttcctccacgggtttcctcctggtctttataacactcagcttttaatgatctgtgctgtgggaaaccagacagcacagggtcctgtcccacagcctggagttggaggacaagtggctgtgaacagcagaagaaatacggtcgtgtgcagatcacagcacgagcagccacagatggctggggacccaaggagtcttaaggacaaaaatggagtggcatgttccaccgtcctggcgaggaggtcccaggcacaatgttccaaaatactcggtgggaaacctcgttgaatgggctgaactccagcaaataaggacaaataaggctcgtgttgtgaggctttggacatacaaagaaatggattttttttttttttggtcggcattagctgcagagaaaagcagcagttacatgattcactatatattacatctctgtcctaaggtctgggattttatgttacggttgttaggatttggaattactttaatgaaacaatgttctcctatcgctaaggaattattccatagaaacaattcagctactgtaaacagctggtctcttctctggccaaaataattttgcttgtaaatatttcctttacttatggacaaaaccagaagtctgttttgtagtaacggttctctcttcaacacactgcatttgaagacaatgtttcaggctgatgtgggatctgactttttcccttgctgttctgatgatgctctgctaagcaaacaattgccatgttcccgagacttcaggttgaaacaacagatgtagaggtagggaggtgaagtgttttccttctgcttctgacacgataatgcaaacgagaaaattcatttcctttaatgtagcccccaaacccatatatcaacacattatcaagtgaaataatctcttttatgttgcactctgaaaaacttttaatattcatgtgaagataaaaaaaaatacttggggttagaaaaaaataaatgtaacatagaaaatattcccagggccgggtgcagtggttcacacctgtaatcccagcactacgggaggccgaggtgggtggatcacctgagatcatgagttccagaccagcctggccaacatggtgaaaccccatctctactaaaaatacaaaattagacaggcttggtggcaaatgcctgtaatcccagctacttgggaggctgaagcaggagagtcacttgaacctgggaagcagaggttgcggtgagctgagatcgcaccactgcactccagcctgggcaatagagtgagactcgttttcaaaaaaaaaaaaaattcccaggatacaacacagttttcaagtcatcaaattacagagccagtaatattaatgtttgtatggaagagaataagtagacttacaattaagttgcagggactttaataagatgttaacatgatttaactttgacacaggtaactttttgatacttttgaattttgtaaggacaaaacccaatcaactgctttaaaatacagaagagtactatgaagatcaaataaccaagttttaataaaaaggaacatgtttccagaaattctaaggtctagcattcttgcagttcccctaaggcattgcatcagtgaacagatttgagttttattggctaaagggaacaattctctgtaaatacaggcatttagacttataaaaggtgcctataaaacagatagaagaagctggaaattatacatgttgtggaactataaaaaaacccatttaaaagccatcccataggatgttttataatgtttatccagttcaaaacagctttatatttcccatttttcctacataatagtaaactttaagggcaaaaaaggcaaaaaaactgaataatgaaaaaaaggaaagtaggagggttaaagagcggatcacataagagaagcttgaaagcaggagaatatttacatttataggatacagaaattgagcattacggaagagaccacaaagtaaaacaaatgagaaatttaaacaaatagataaaaggtaaataagaaatgagtatccttcttttatacatgtataactcataaaatctctgaactaggaaaaatcttaaaactggatctagtctctttacttctctttcggcagaaatgtggttaaattttaacacagacacagctgtaccaaacaggtgctacggaggaatgttttcggatttcacaccttttctacagagagtttcccctccccacaaaggcagaaatgcttactgtaacttttaggaacagaatcaaagcttcacaaggtagaaaaaagcaaaaaacaaatcgttattatttttcttttagagacagggtctcgctctgttgctcaggctagaggacaatggcgcaatcacagctcactgaaatctcaacctcctgggctcaagcgatccaccctcctcagcctccgagtagctgcaactacagacacatgccagcacacttggcaaattttttattttattttatttttgtagagatgatgtctccctaatttgcccagggtggtcttgaactcctggcctcaagcaaaaatcctcctgctttggcctcccaaactgttgggattacaggaatgagccactgtcccatacccatttttttaagccctaaattttactctaagatctaaacccttggcaactaaaaaatatgatctttgattacagaaataaaggcatcacttaaaatcttgttaaattacagaatctcaggccccttcccaagctactcagcctaaatctgcatttaacaagattccttatttctacactcattaaattttgagaagtacaatgagtttgtctaggtatcacttctgacaacgtttaccttgtggttttatttgtacagctgaataaccttaatttatacctttcttttattaactattattaggactctctataattacacatatttgtaggtggcattaaaattacataagaaacataattcaaagtaacagaaaagcaaacacactcaaatttaaaatgcatttgaatcgggcacaatggctcatgcctataatcccagcactttgggaggccaaggcgggcggatcacttgaggccaggtgttcaagaccagcctggccaacatggtgaaaccccgtctctacaaaaatacaaaaaattagccgggcatggtggcacatgcatgtagtcccagctacttgggaggctgaggcacaagtattgcttgaacccaagaggcggaggttgcagtgagccgagattgagctactgcaccctagcctgggcaacagaaagagactctatctcaaaaaaaaaaaaaatgcatttgaatagaaattatttctctagctttcatcaccatatcctgaaagaggtacatacagcaaagactctacatgacaaaataggaaacttccataatgcgtactatgtccaagtatgctaactgtatgctaatgaggccttgcacagtaaaagccctgtggcatttcatgttgtcttgttgagagttgattggggtaattctttcaaggaatcattactctcagcatttctgtcatgctttctcagaaagtgttaaaggtcatttcactttcttaagaaaaaatatctaacatttaatgagtcacagacatatcattctatttggtttctatctgtagtaggcaaacatcaaaatcaaagttttaacccaggatgtgtccagaaattagagtaattgatccagagtcctggctctggggaagatgagcgatggcagggatccgccttggtggtaacaaagaggaagccagggctgggaggggagaaggttgtgtgtggccaaggttagtgagtggggagccaggacaaaaacccaggacccctcacatcgaccattcccattccattttcccctcatttgggggtgatgtgtccatttggggacatatggtggatgtatcttctaatttctagctatgcactgaaaacatgcatcttatcccaaataattattatttttttattttatcctacctgctaatttcccctttatatgtcaagctctgaacttgaggcaggaatactgagaagaaaagacatctgaagaaatcctcccccattgtgaattctgctgttccataggtttctgtccgtggctgcctttactctcattctacatcctcacacagttttcccgcaggtgtcatataccacctatgcactacaaacacgcagctcactatttcaagatcttgcctctcttttgtgccccagactcatacttctgactgcccttggacattaccaaagaatttgttttcagctaaaaatcattagaacaaacctattttgcactctcatgaaccagattttctttctgaattccattctcatgcaatgggacaaagactcctttattcattcgaattcattcaaacagaaacacagaaggatcctggattgatctcacctctccctcattccccaaccaatatagcttcttgggcatatgacctacgcagtctcattgggccccacactgagaagaacaacacagtgtttgctttaatgctctgctgttgccatcttaaaattcctaatatttttgaacaaagggctccacaatattcattttgaactagaccctgcaaattgtatgactggttcagtcctcaaatcctataaattgtgcggttagtcctgcttctctataatccgtctctacacattgctgctggaattctcctaaatctaggcagttaggatgtccattaacaaaattttttaaaggcaaaaattctgcggcttatcaatttcccacaaagtgtctttgagccttgactgcaatgaattttccagcacaaattcccatgcatcttgattttcaactgtaaagggcaacctgccctggttatcatgtatttgtgccaatattacatggactgaaagtcaccacctcctttctatatctgacacactctattcatccttcaagcttcaattttcccaatgtggcatataactcttctctgccttccatcactctccctaggtaggtccagcacctgtggtcaacagtattagcatggtaagtgatttctagctgatttacatagggctccaggggaatgagggaagacctcctttcagtccaggatttcttctggcaacatcttcgatgaggggaacagctgagacaacatgagtgtgtgactgcatggtacattcattacactggctttgagcaaagtctgcaggagaaaagacagatgctcccaaactacacatccactcaagtatacatgttcaagttagtttttcatacaaatctcacgtccttcctttgttgactttattccttctctgcaccatgaaacttgcccatactcctttccatatcttcatgaaggtggcaggaagtcacttcaaatcacagctgacttcattttcattgctgtttttcttcaaaaacatgttagtctgcatcagagccccactgccaggcacccaggagtgggtacaggggacacatgcagaccagggtcaggagtagcccagccccattcaacagcattccagctgtgtgcacaactcaatgcatcccttccatgagctgcaagacggtgcatgggccacaagtacctctccttgttttgcttttctctctaagaaatcagggatctcaattcctgacctaataccatgcttgttttgcaaaccagtttcaactaataataaacaatgttgtccttgacagcagggccattactgctgtttccaaataccctcaagatactctcacatctgtttcattagacaggctgcaaagggtttgatcaatgtgatcaagaaaggattagcatttacttctattctcaggttcctacgctcacctactttcactcaatttttcttcctttctccatttcactttacaaattgtgattttcactaataataattatctctattacagaaaaatagaagatgggcaaaaatatgtaactgaagatccctaagtatgtattgatgacttaaatatctttttgaatttgattttctagcaattcagttgtgcggctgttaaaaaaaaaatctctttaagtacgtcttaatttgcaaatgtgcctaactacaagtgaaccactcatttaacagacatttaatgagtctacactatatagtatgtgtggtctagagacacatagccacacctcaataatctaatgagagagagagataatattaacaagtatttgtataataataggaagtatatataagtatcaaatgcactgaagacaaacatgcctttgactccgcaattccatttctatatatttataattttaaaaaatctaacaagaaatgggccagcctgggcaacatagggagacttcgtctctacaaaaatttaaaaaaagaattagctaaatatggtggcatgtggctgtggtcctcccagctactcaggaggctgagaggggaggacgcttgagccaaggcagttgaagcttcagtgagctatgatcatgccactgcattgtagcctggacaacacagcaagaccctgtctcagaaaagaaaagaaaaagaaaaaaaaaatgtatgaacatttaggtgcaatagtttcaatatacacatatatatataagacatatatatatgcactatataaataaagatttaaaataaagcctaatacctggctacatatccaaggtaatccaggtttaaaaaaataatgttctacaaatatttgccatattctggaaagaagctagttatgttcttttcctgacagctggctgtattcatttgatggattttgagttattaatatgtttaagagcatgaatgtaatacaaatatttaacgatttaaaaatcattttctgtacgtataattgcacaacacatttcatgggtgatcagctgtcaagcttattttactgtgtcctttaagctgtccaaaatataaaaatttcttcgtctttaaatgtcatagtgtgacctcaaaaagcaatgctgcatgaatgtgtagtgacagttgacacacaggaggtgtcattttaggcatctgcacagaaagtacaaaaacatacctctaaagtacccatttgcttcgacttggaacttttccctaagatgcaaatatgcatgtgcatgcaccccattccccccaaaaatcacatgcagtgatatttctttcttgagacttagtcccgctctgtcgcccaagatggagtgcagtggtgcgatcgtggctcactgcaacttccagctcccaggttcaagcaattctgtctcagcctcttgagtagctgggattacaggtgcacaccacatttctataaaaacatgcaagtacttttttgcatcacaataatgaaaagaatgtgttctaacgtttgtgtcacataatgagaacttgaaatggaatcaatcaaattttcttaaaggcagggcaaacaaacgaaaacatgcatcccattaatgcacaccaaaaaaaaaaaaaaacgcatttcctaatgaatgggaggtgcttttctctgcagaagcatcatggtcatcagactctgagtgtgtattttctcaacgggggtaatacttcagtgattctcctcaaatatcagtccattcatttccctctataataaaagtgacactggaaggttaatgatgtgaaactctgcagacaaaatgaagctactatcctctttctgctgacaagaccacagtaacgcaatgtgacaaattagaaagagaggaatagaatcttagatggagattccgtttaggatgtatttttcccagcagtgcctccacttgactaggtagtatgtaaatgtgcataaactttttaaatttatggttaagagggttcatgatgttataattaagggacagactaggtcaagttataacatattctataccatcccataacatatctttgaatttctttgtatttagtaatctttgaaatggaagcaaatcacgaagtatgcaattacatgatttttgcaacactacaaagtatgctttttatgaatctcaacatagaccacattaggctttaaaatatcactcaaatttgaatttcagcagaagtgcatagaaaatttaaatactcaaaggtacaattttctgttaaaaggctcaaaaacattataaaatctatcataaagtctttagctaatgaaaaatttgttaatagttcaattcagttaaaaaatatttacctctttgggaagctgagggtggaagcttgcttaagctcaggagttcgaaaccagcctgggcaacatagcaagaacccatctctactaaaaagaaattttaaaaaattagccaggcatggtggtatgcacctgtagtcatagctactggggaggctgcgttgggggagactgcttgagcttgggagattgaggctgcagtgtgccatgaatgcacactgcactccagtctgggtgacagagcaaaacagtgtctcaaaaaaaaatttacttagtttaagtgcaataattgcattattatcaaatatgaaatagggcaaagagtaactaaattgtcagagtcaccacaagttttttattatctaattataagaaataacatcttgaaacaaatcataacaactaagattgagaataagacaaggatgtccactctcaacacttctactcaacatggtaaaggaagtcctggacgaggcaattaggcaaaataaataaataaataaataaataaaaataaaaggcacccatataggaaatgaagaagtaagacaacctccatttgcagaagatatgatcttacatatagaaactgctgagaattcagaaaacaatgtgttgaactgataatcaacttcagtaaaattgcaaggtacaagatcaatattttaaaaattgtttgcatttctatacactagaaatagacaatccaaaaatgaaattaagaatacaatttcacttacaatagcatcaaaaattaataaaagcaaaataagtgcaaaatgtatatcatgaaaataaagaaaaagaaggaaatgttaaagatctaaataaatataaaaatggtccatgttcatggacaagaaaagttaatattgttacaatggcaatacttgcccaattaatctacagatttaatacaatctctatcaagatttcaggtgttcttttgtttgtttgtttgcagaagttaacatgcttacccaaaaattcatttggaaatgcaaggacacagaaaagctcaacaatcttaaaaaagactaaattttgagaactcacacgtctcaatttcaaaatttgtagttgtttatgtagttactaccatatgtttatgtagttactactatataaattgaattctgcatacaaaacatgtatttcttaggcaagcatattatagaattactttccaatatcaatacaaattccaatattccagatttcaggaagttctagttgctgaataagcaacacttaaccattgtgtttatgttccacacgtgatatgtgacgtacacactgctaaataccaagcacaaaatacactcgaatcatgcaagtatcctcttatctcttaaatcactggcttaatttggccttccataactttacatctattttaactactctgctacaacttacacttattaattgatgtaaaagaaaatattaaaaagccaggctttaatatctgtccccaacaaaatcacattacttgcatacaaaaaggttaaggtaattctcaaactgtctaaattcttctctctacaatagggtaacactaattcaagtgattctgctacttaagtaatttttaacacctttgttaaagtataattgaaaaattaaaattgtacatatttaaggtatacaatgtgatgctttgatgtatgtatacattgtgaaatgaccaccgcaaactaatatatccatcacctcacatagttaacattttcttatttcttaagaacatcacacaccggggcctctcgggggtgtagggggcaaggggagggagagcattaggacaaatacataacgcatgcagggcataaaacctagatgatgggttcataggtgcagcaaaccaccatggcacatgtacacctatgtaacaaacctgcacattctgcctgtgtatcccagaacttaaagtaaaataaaaagaaaataataataaaataaataaataaaaataaaatacataagaaaaaagatctctcctttcagcaaagttgaagtacacgatgcagtattattaactatagtcatcatgctgtatattagatcttcggacacagacaaatactgcaggattacgtttatatgtggaatctaaaatagtcaaacttacagaagcagagagtggaaaggtggttaccgggcattggtggaacggggcaatggggtgatgttgccaaagggcacaaagttttagttacagtcacacgacgtcacataacaacattttggttaacaatgggccgcatataagatggtggtcccatagaattgtaatgaagctgaaaatgtcctattgcctagtgatatcatcttgttgatgctgaccttatgtaggcctaggctaataggtgtgcttgtgtcttagtttttacttaaaacatttaaagagtaaaaaaaataaataaataaaagtaaaaagcttatagaataatgatagaaatatttttgtacagctgtacaatttgtgttttaagccaagtgctattagaaaagagtcaaaaagtgaaaagaaatttaagaatttctgaagtaaaaagttacagtaagcctaattacagtaaggttaatttattattgaagaaaatgttttcaataaattgagcgtagcctaagtatccagtgtttcttgagtctacagtagtgaacagtaatgtcctaggccttcacattcactcaccactcacagactcatccacagcgacttccagtcctgcaagccctgcatggtttaagtgtcttatacaggtgtatctttttttaaaaaaatcttttatattttatactgtatttttactatacctttactatgtttagatacacaactacttaccattgtgttacaactgcctacagtattcaatacagtaacctgctgtacaggtttatagcctaggtgcaatagactataccatataacctggtgtgtagttggctagaccactaggtctgtgtaggtacactctacgatgttcacacaatgacagaattgcctaaggacacatttctcagaactcaggacttatctctgtcattgaatgacacatgactgtacttaagtaatgcaaaggtaatagaatttcaacacaagtacgtccactggctctcctttttttccctatttcctctccctatctcaacacacacacacacacacacaaatttaagtatatggaggaaaaaatggaaaaaaatagctccatgtgttctccctaacatcatcattgcatggatgaagttaatggaggttcagtaaggttaagtgactagttcatctcaacatgcctagcaaacaaagaattcaaactcagcctaattttgtagactatacacttgatcattcttaatagcaacaatttacagcttctttttaaagcaaaacttttcaaaaaagctttcacttctttgagtaccatttacctactttaattggacttttgaccccttcatttcattgaaattgactttgctaaagtcaataatggcttccatgttagcacttccaataggtcttgattcatcttacacatcttcaaagcagcactgaacccagctgacagccttatctttgaagttctctattcccagccactgtgacttaaaggctctatggtttacttttcattctcttttgtgggtttttttttttttttctggtcaactgctaaatattagagtgcttcaggcctagacgattggcgtcttgtcttctgcatctctagtttctcaagcaaaacaagatactgtttaatattatctggattttatttccttatttattggtttatttttcatctcctcataccagtgtataaacttcatgagtcacaacagataggaagtgttttctaagtgtctgttggataaataaatggaaggaaggaaggtaggtaggtaggtaggtagaggtataaattttaatccctcctttctgagaaaactgtgattttacctgataaggagtgactgttgaaaatatctctatctggccaggcatggtggctcatgcctataatctcagcactttgggaggctgacacgggcggatcacctaaggtcaggagttcgagaccagcctggccaacatggtgaaaccccatttctactaaaaatagaataaaaaaaaaaacagctgggcgtggtggtgggtgcctgtaatcctagctactcgggaggctgaggcaggagaatcactcgaacccaggaggaagaggttgcaatgagccgagatcacgccactgcactctagcctgggcaacaagagtgaaactctgtcttggaaaaaaaaaaaaaaaaagaaagaaaataaaagaaaaagaaaatatctctatcttagggatctcttttgcagtaaggcttggatctgctttgtctgcatgctgcacccctcagtattccacattctaggccaactgcccctcaatggttgactccaagttattatcacagccctgccaccaggaaatcctaaaatcaacctagattaaagagaaaggcctggtcagctgtgatacttgctatgagtgcaaatgttccacagatgaactaggtcatgctggatttagccactctctcaatgagcaggaatgccaaaactcatgggggcagagtgaggtgcgtaccaggcctaaagtgactgcgttctcagtagaggatccctttcacaagtgtttctgagaagctcactgtttattagcatcagaccttgatctcaatcatagcaacttgtcacccatgagacacgcccagccctcatctcatttcttttgagtcctccaggatgctgcctagattggccttgaattgtggccctcatccaggcatttggctgccttcacccagtaccagcccatcacctgtcatgcctcctgctttccccagccagatgggcagccccaatttcttagcagctcttgtggagaagctgtgttatttcaacaaccatatgccagagcttagcacctagcagtttgtgataaatagacttaatatagtcaggatctctgtttaaggagaaatgctaatgatgataaagatttacattttgtgatgcaacaatgtgattatataaacctaaggaaacaaatgaaaataaatcacgttgtgctatttggtttacagtttacgtgatacgattttcattgttttccgattttctatattttgtattttaagtcataggaaaatagaggggtaattcgaattttcaagttgaagatgtgcttattaccattttagaaatataataaacattcatatcaaagggaaatttggcatgtcagaaaaatgacactaagtttttgtttcaaaatgtggccatatatttcttaatgttttttaccttttaatagcaccttcaattctacattctcccccagcgatcacaaagtcaaaaacatcctattgtaacatcaaggcacatatctgaggactcttctctctaactgagccttctttattattcttgggcaaattatttaatctattttagcctcttttcccatcatcattctcacaaagggttagtgatagataaggtaagagcttatctttcacttaccttagagagttgttctgaagactgaatgaaataaaccaggtgaaatatttagcacactgcttgcttagtgaatgctcaatgcatgtttgtcatcatcattctcaccaccatcattaaacatatatacatagtcaacatttaacttgggattttctcagcattcttcaaaacagtttaccacagatattaatattctggttctaaaacagtatccggcaaaaattaggcatttagtaaatgtatattaagtgttggtcacatattatcttctttggtagctttactgaggcaaagaccatgttgcatcccatctgaggctagatgaagtatcaggagcagcaaagacaatcgatgctcgttgagtgaatgatgcatagccgatgttaaacatccattaggaaataacatagagagctttgcattctattacaatgacaggtgacaatggatgcactcccaacgagaacaatttataacctctcctttcttgccttttgctgataactgattacatatttgaagatcattgctgcaacctatatagtctatccagctgtatgagaccagcctcacagagcaaacttaaagcatagtgaagggagagatctatcctaaatcaagcagacacagtgcatgattattggctattaattctgtggacacacagcgtgagaatttaaattcataaacattaaataggtaactgttaaatagagagcacttatttaatttggtcacttaacatactttctgaatctctatgtgttagaagaaagattgtaaattttccatgacaaacgtgataaaagtataatttatttctcaatttctgtattgcatggtttagtagaaaggaccctgggctggaagacccaggaatacagccatagccttggctttgtaattttcacaagtcaccttacattacggctttagttttcatctgaaacctgtcagttcccttccagctgtaaaaccctaagtttctaataataaccccatcatcaaaatctggtgttttgttagtatcattctcccaaagcattgccgcagactacaatcaactctattatccatgttagattttaacgttatacccgggctctatctacagggagacaatatcaaatcagtgctcacaatgatgatttgctatacccacgcaactccttctccatgcgaatgagaccttctctgtgtaaattgaaattgcacatagagaacagagatatcataaacgagtatttcccattcattctaatcacagttgactcatgacaagatggcagacaggaccatagcaggtatcagactgcattactcaggaccaattaagccaagttattccatatagacacaggtttttttcttgaacgatgaagggaaagacagaaatttttggccatagaaaaatttactatgataaatactgtctcaacaagctacacatacacatgtatttttgcaaagaagcacccatgcgtttgaattactgttaaagtcaagttgctgtgtgaaaactgggacactttcagcatatattctccaacatttctgatatcaagttacagtggagctatttggcatggttggatgcgatgggctggcttccctatgccatatgctattgaatatgcaagtttttctacaaaagtttccataactgatactaatttcacacttaatccacatatactagctatgctggaagtttaatacataatataattatggaggaaacgatcagtctttttccaaggcttgttccagccctaaagcaaatcattctgcattatctgtggtaatacgtggaagcacaataatgttattttgaaataacatgagatttttttttaagattctacagtttctgatttggagttgtttctacacttttaaaaacttcatatttttaacacaaaaacacaaatgtaacataaggttatggtatcatgtatatcgaggcacacttgcgtaaccatcgagtctctcaacaatgaatgatcctaaattcctgcactcagaagcctccaatgacatctttgtattttatgactctacactggaataatcacaaacctacaaaggggcatttctcagatgtgcacaggtttagtggttcagtacagagtactagaggctggagtccacgtttcttcagagaagaacttttgatgaatttactacagtgacaatctcagttcatctccaagtagaacataacaagaaagacaggtcccttcactgaggtctgaaaagaactaatgcaccggggacttcctgcacctgctcttatggctctcttttttctggttggattgcctcctcttcccttatcgaaactctgcccccttctcagccagtcctactcactggtgcccttgaccactctgccctggccagggcttacaacaatgagcccatgttgctgtgaagcgggtgcagggggtctgcacgtctcattctctccatctatggccttcagttctggtgctctatctgtgttgctgtcacagtgattcctcagctaattaatcccctggttatacaaactcaaccatgtttaaaaagtgatcctcataaatcatcatgggcagaaatgcttgttaaggaaaaaaggccttctagggctggctccttttggaactatctcagataagggtaagagggtgggcaggaggtgggctgtgaagccctaaagcctggggctggaatctgtgatcccctcactgcaccccacacttgccccacctgtgacctccaccttcccacgtcccctccacaggactcttcagcctttgcagacactcaagacagcgtgtgccctttcacctcctaacaaaacagtcatttgaattgtttccctgacttatgacgccctgactcaaacacaatcacacactaaggcatgaaatctgaaagtacttttgttgtaagttgcagaatgaaatgcttttgttctttggctaatggaatttcaagcatcagcaaacagtggatttttattgttcttttgtgtctagaaggaccagtgaagagactctccagtcctccctgggttaatggaggctgagtgaggacgctcctggtgacacagggaaccctgcattaacacagtttctttcccccaacaaagccctgctcaaaagaattttaggcaatttgaagacggatgctagaggcctaaggaaggagataagcttctgtctgttcccctccaggagttcctgtctaaaagagcccatctctccttgttttaacaaagtacctacacactttaacaaaatgattgtcaaaacaaaattaatgcagttccaacgtttactggtgataatatacactagagcttgtaacgtacattcaactgtatacgcatcatcacttcgttttgcaaaacttattttgtttctcatcatgcaaaggaagcaaaccttaaaaaaaaagactacaatgttgtccttttacttgactcaaacatagcatataaaaatatgctatgttcattgatccatagcttactcacaattctcaaaattctttgtatgatagatttgacaaggaatttaaatcgaatatttaactaacttttactaatttagaaaagcaggctgtctgaagaagccgaaagtcatttttgtgtttattgtaagataacctttccccagtggcagccagcaacacatctgcattcctaccttccttatgacacactcactatggagagctctagggctttttagctgcagccaaacatccatgcttgagttacatatcaaaggagatttttcatccttagcccaactcacagcacttagagcacaatgtgctgaatttttaacaggaaaccgcctctttgtgtagtcccttccccaggaggctcttgtcaaaacatgtgatatttcagagttcaacttcctggctgcacaaactgatacattgtctttttgtaccatgagtaacattttcaaattaaaaaaaaaacacataatcatatttcatgtcctcaaagaatttaggaagaggttaaatttaaacattttgattcagatctcagcctttgtaaataaggatacataacattccatcacctacctatgagaccacagaaatatcaaaagctaggacaagaacagcagtactgtgaaccacacacagttaaaaagcgttcattgtccaacaccacaagtaagttcagcagttctcaaatagcatccatccctgcccagggccactgtctgtgtgtcttcccattctccccaggtctgcagaatcccaaaaatgtgcacatgaggttaactggcacgcctacacagtcccagtgtgagtgtgtgtgggtgtgtgtgaaaggtgcagcgatgggatggtgccctgttcagggcttggtggccacctggtaccctgagctgctgggataggctctgggccacccaagtccttgaacagaaataagaaggtaaatcactatcttacttgtttttttgtttgttcgttttgaggcagagtctcgctctgtcacccaggctggagtatagtggcactatcttggctcactacaacctccgtctcccaggttcaaggattctcctgcctcagcctcctatgtagctggaattgcacgtgtgtgccaccacacatggctaatttttgtatttttggtagacagggtttcaccatgttggccaggttggtcttgaactcctggccctaagtgatctactcgcctcagcttcccaaagtgctgggattacagacatgagccaccatgcccggtctatcttacttgtttttattaaactttcctaaatgtatggataacacacattcatttcttgttgaatattagaagcgttttggtcttcattcagaagtttggtgatgtttttgtgaccagaagccgccatacaaacttaactcttgtttataccaactcgcctatggtgaaattggttctgtcatatgttgttttgcttcaagtcgcagtttccggaacctatcgatgacgttaagtgtgcacctgctgtgtatgctgccttgttttaggcagtgctgatcctcaggcctcacttccaggtgctggcccagctggctgaggacaggggcagctggtgccttcggtagaatcacgccagccaccacttgctagagtttgccacacgccagccctcttctaaacatgtctaagcattttgttatgtattaacacttaatcctcagaatacccctgtgttttaggaactatcagcacccccactttatacataagaaaactagggtgcaaaattaaaaccaaaattaccacttgatccagccattccactcctaggtacacacccaggagaactgaaacagggactcacactgacacctgtacaccagttttcactgcagcccgaagtggaaggacccacgtgtccatcaacagaggaatggaagaagaaaatatggtctgtccatactgtggaatattatttaaagtgaaaaagaaaataaaattctgatacatgctcaatatagatgaatcttaatgacatgctaagtgaagtaagccagacacagaaggacaaatactgtatgaatctgcttacataatgtacctagagtaggcaaattcatagagacaaaagaaaaagaaggtggggttgggggagagcagatggggagttacaatttatactttcagttttggaagatgaaaaaattctggaaatggatagagtgatggttgcacactattgtaaatatacttaataacactgaattttatacttaaaaattattaaaatggtaaatgttatgtatttttttaccacaataaaaaaaaagaaaaaactaagatgcaaagaagtagaatacagttctccaaattgtcaggcctacaaatggcagagtgtggcttagaactcaggcaggctggcgccagaagcctcgtccttccctactcatgcaaagatacactgtgccccacagtacctctttcaagtctccactgcatcccgcacaaggccttctgggagcctgccctggaatcccaccccctgtacccttcccacccatccacctctaggcagaactcaggctcgaggtctccccacctttgctccatctcagccccttccctttatctccaagctctaaagctccccttagatagaagcaaaggtggagtcaatggcagttccaaggcatctctgagactttttatcagttgttcctctagtgatagtttctcaccaagagcttggtcatagcatgacactcctctaagctgctgtgtcattatatttaatatttcatataaacctgtcttctaaattttactgtatactcttaacgagaaagggtgatcttatgctttatgtttccctgggcacttaacagagaacagtggacacacaggcgtgcaataaacattgtgtaataaatgtcttcctaacagttaccccagggtgtagtcaacataatggcaatggtttatgacttgggtacggcgctgcattaagggtgtttttccaaacagatttaaacagatttctttggaaaagtaaataaactagaataatatcataataacataacaatattaatagagtcaatttaaaaaacccatgcagtatgagcactcatataaagagagccacatttaaaagctcgcgggggacttatcaatcaatgtcattttcacaatgggtccccaagcctgggaatctcatacagggttcagaaagaatgaacatattgttactactgcagttgtacttggtgtcaaatgacaagatcatccatcaaggaggcatcactgtaacttggagacaagccgcacaggtcacaggcacagaagcttttggagttgagataattttcacagacttgaagctgtgctcttaagtaatggctttctgggttttcatttgtatactcactttgtgtcaacaagtaaaacacagcaacccatgaaatgaagagttcttattcccagtagttcacataaaaaaaaaatgaaatttcttattagaaatattcaagagttcgtcctccatgtcatggagttatcaaaagtcaaagtaattgaaatatatcagagggactgggacagccttgaacagagtgggaaacaacatcccttggaaaataccaaaagggaggtgcagagtctggggctggtgtcaggtcctcagggaactcttcctccaatgtccagcttcacactggtgccaagccctgcccaacccaatgtaagcctgcaccacagagtatatggccttggggagttggccgtgctggcctttctgagatgcacaccttacaccctggagtctgaaccaggggccacaaaggaagtgagcagcgacctagctctgacagaagaaggccttccagtggggcaggcacctgccctgacctcagcaggcactttagacttccccttttcatcagtggccaggtggccccagaggctgctgggatggagcagagctgtctggctgggcaattcatgttgtcggcttcaagagacacacttgagtttctgatcttctcacagaggccggcgttgacaggtatggagtgatgaaaatatgtgggaagggaaccccaggatcacagtgtgctaaccaggacagactggtgccggcaggaaatagcaatgcggaaaacagggacacaaggccatatttttccgtcattggctgtgaagatctaggaaataagggttgcttgccactgaccaaaaggaaactgaaatgaagtcttgatcaaaaggtagcactgtctgcctcctacttagcataatgctctattagctgtgcaaaaaactggcaaaaaacaaaacaaaacaacaacaacagcaaaaacagagatattgtgtttaggaatgctactaaatggattatttaatttcagttaaaaaattcaaatgctttataaaaccaaagcgtcttccaatgaagtacattttatttgcagatattcagaaaaggaaacaaaattcttccatagttcataaacaagaaatacacactgtggttctacataatttgagccatctttgatctatttttaactctgccttggcactcaagaaaaactcacgggaaaaaaaatgattcaataaaaagcaatatcctcatgggaagataatcaaataaagcttagtttggaaactggttttgtagtttcctaaatacaaagcatgcagtggatttactacatctttagcataactatgaatatgaatggggtctccagagctaacccaagattatgcagatagtttaagctttattccaggcaaaatttcaactagatttagaaacattttcataaaaaagggctgtaaagagattaatggtattttcaaacaatctaaaatcatggatttgagagatcttgccttggtttattgtctttaaaattactcagaacaatacacacttgggtatctaaaacagaattatcaaaatccttttgtactgataaccccataattcctatattatttagaaaaagtaatttatcttgaaaattacatattatatgctataagattgctttttaaagctgtactttttctgagcttcaggcaatattgtaccttgcagtaagcttagtttccgaaaccaaaaatgttccaatggaattggcatcctagattctccttgactgcaatagttcctttgattttaactccataagtgctcacctcaaagttttcattatcaaaatagttggcacaactctactggggaagcaaagatatgatgaggattccaggatgactcataatatctcgatacataatgagtgtaccaaccaaaagctccctttagtaaatagcaataatgtcagatggttagaaatgggtaggagttgaataatcctgcctcgataaccatcacgcagcttcaaagaatggacttatagatccaatttggcctcatgatcaagtattcgttacccagcaaatgcaaaaggtctcatggcctgtgtgtgtgatttggggaagtccccctccctgctttccagccctgggacatctccgtagttaatttccaggaggtagaagaggctcactccaaggtggatgcagcagtgttttggggacaggcacagccagtcttcaagtcagttcaggacaccaagtcctttggaattggggtgttgtggcatccacagggcttcagacctccaggcctcagcactgcactcaaaatactagaatgtgttattttctggaatctgacatcccagtcacataagaggggcagagccttaacaatatttctgatcacatatatatcttaatgccactcatttcgtctacaactacgtgtttctagcttcccttttgtacttagcaaacatgatggtgtggattttggtaccaatttttgaagggcccagggatcatacttagattatgaactcttgactggggttttttaactgctgattatccaagcctacagtaaaaaataatgtgaacttacaaacgcacacaaaaagcagcactctgtttacactgtagtatctttaaagtcaattgctctgcagacaatacaacacacggctttgtctcctgcaagcaacgaaaataacatcctgcagacataactgtcattagaggtttactctactggcaagagatgaagtaatggaaaatgttgataccttgttagaactgatcattctgaatttacaaaaggtgtggtcaggcaaggatggtgggtacaagtgtctccagaaaaggacacctggccaaggaacatgggaatagtaccatgaaaatatgtcaaatacaggaacaaaagccagcagcaaggaactaaataaaggaccctacacaggtgaggaaagagggagtcagggatgggagggaaacacggccccccacacagtgagctaaaaaagacagggagggctgggcacggtggctcaggcctataatcccagcaatttgggaggccgaggagggtagatatcctgagatcaggagttcgaggccagcctggccaacatggtaaaaccccatctctactaaaaatacaaaaattacccgtgcatggtggcaggcacctgtagtcccagctacccaggaggctgaggcagaataatcacttgaacccgggaggcagagattacagtgagctgagatcatgccactgtactccagcctggaggacagagtaagactctgtcaaaaacaaaacaaaacaaaaagacagggagagccactgccatggcggattgttatcataaggtagtaaatattaattactaaaatgagacagctcaggaaagaataaaggatgaaataaaaacactcaaagagcattttgatatatgctttttcagccttcctttctatgaatactttacaagtgatatgctgcacatagacatttacattctgctatcttcaccaaacattacaattaataccacataacagcactttttatattttatttggcttatccaccaaataaagtctggtcacattatttcaagacacactaaccgcagtgcacattgccacgtgcctcccaaactgttcccccagctgctgggtgtgcagctgcctctggacaacactcagctgtcaaccccttcaggaagagccagacattatgctcccctccaggaatggctcacatctataactgcctggctgtggacatagaaaggtgcagcccctttgcaccacctccaaacaatcctgaagggctctcccacctccagagcctccctacagggccactgtagtcttggttgtgactacaccacagcccaacttctccctctgccaggcttgcaggctctttcccttcccatcccttgcccctctccctcttctccctcctttttctccaaacccacccccacccctcctccagtattggcctcaagaacatccccaataaactattctccgtatcttagtcggtttcccagggaacctgaataatgtttattggaaacataagatatttaatttccaacatttttgagagaacattcttcaagccaacttcaattccaaaattttaaaatactctctcaataaccaaaaggccattaaagacctttgaactataaagcaactgtttattgagctattgagcacctactgtaggtcatccaccttgccaggggctgaaaatttatgaataaatcgggcaactcaccaactaagagtggtgaaattaacagaaagtaagaaaactgtggaaaaaatagtttgttctatcatttcaaattatttctataggttcaatatcgcaaaacaaaatcaagaagggccttaaagaaaaaggacatttgctagtcaggaaatagactttaatcaatatttcactgaataaatttttacatgatcaaggatctggatcagatgttacagcaagtgacttcctatggcccccagaaaagggttacttgttgtttctccaatgacaggagaaaaagaaggagggaggtgggaaagagtttgaagtagtcactttgcataaaagaagtatgcaattcagaggagaatgtgaaattatgttagcaattaatgcctctttatgagataataaagcaattagtggaaacttgaacaccagccactagtgttcccatgaagtggcagcccagggggcggagaagaggaaaggtggaaatgcaagttcacaaagactctcactctgggctaagaggagtcaagaggagctcacattcatatgcataaaaggtcagccatcttttcaaaaatattgaatttctgttaattcttctgtcaaacgcaagacttccaatgcaaatatgtaaagcatattttctaggaaacaacatgatagcctgtgcttatttttctgtgtcatcagttaataggcttcaacagccctttaatgtaaattatactcaggagtgtccttgaagtgctaaggggacatcatctcatggctccttccacctagggtgggatttagagctcacagatgccccagaagaaaatgttccccgggctggcttcattgtgaagaatgagccaaagtcactggacctcaggcagcaaggaccccatagccttggccatggcacagaggtccagtgtgagccagcagacgtggggtagcacagccctagctaagcccaacacccagcacaactcttcctttccatggtagcccatgaagcttcctgtccctggcaaaagactctgctctggacatcagcattctcacttaaggaaacttcatctctggcttcatggaagcaccaatttttacaatcaatggaccactcagagcagcttttctcaaaacctgatgtgtatttatgtggcttcagggtctggccaacacgaagattctgactcaggagttctgggatggacctgagattccgcatgtctaacaagattctgatgtcaatgttcctaggcctagaacctcactttgagatgccagggcttagtgatctggactgtagagggtggggaagctcacacattattctggagagcattctgcattcacactgcctgtaagaatggatgcattcacaacatgcaggcttctgtatagcagtgaattttacaggaccacctcatgcaaagagtttgtacttcccctcaccaataaaaaaattaacatccatccttttattcttaaatggtaggaatataaaaacagcctcctaccgtgtttagatcatttatattttgtaagccattttcacttttcttaatttgatgggtagaaacaccctgcagaaaaattgaaaaccccaagtttgttgtaagtaactgctgactcccacagttacatcagcttgttgtaggcactaaaatctcatattcttggaggaaaatctagggaacagtgtagcccataagagcaggggacagaaatcctgagggtgcgccaggtgacagtggctcacacctgtaatcccagcactttgggaggccaaggcagacagatcacctgaggtcaggagttcgagaccagcctggctaacattcctaccaaaaagtacaaaaaattagctgtgcatggtggcatgtgcctgtaatcctagctacttgggaggctgaggcaggagaatcgcttgaacccgggaggtggaggctgcagtgagctaggattgccccattgcactccagcttgaacaagaagagtgaaactccattgcaggggaaaaaaaaagaaagaaaagaaatcctgagggtgattctatgcgctgagacctggtgacatctatttaaagcctgaattcctggtttcatgattgaaaacaggagtgatgccttcctctttagaaggttgtcatccaaataaaatgaagtctgagagctgtctgtgagctaaatattctaagaaatatgtaagttagtttttcctcgaagactttgctgacaatccattctctctgctctaacttttgttctgaagtgaacttggacaaggattaaacacttcaaaaaaagatttcttggccgggagctgtggctgacacctgtcccagcactttgggaggctgaggcaggtggatcacctgaggtcaggagttcaagaccagcctggccaacatgacgaaacacgttctctactaaaaatacatcaaattagccaggcatggtggcggatgcctgtaatcccacctacttgggaggttgaggcaggagaatggcttgaacccaggaggcagaggttgcagtgaactgagatcacgccactgcactccagcctgggcaactgagcaatactctgtcttaaaaaaaaaaaaaaaaagacttcttatggaacattcacttatctgtactgatttaaaatgcaaaaggaattctaataaaatgattcactttctcactctacacaaatatactgcctccagttcttgtcaaagaaacagcctgcaatatggtgtaaaatgtgcttcaagataccccaaaatattatatatcactctctcttgtggatgttagcagtatgggatatttacttttcaagtttgtttgcttccgtatataattttttcctataggtagtatcatgataactatgaaatttctggccttgttttctttactctccattataacaagaactttttttgtaagtgtaatcttataagtggtaactttttccttatttattccttgagtatttatagattgaagcaaaactaaatgcatgactccatctgcaatcacacagaatattattaaaactatggtattttatgcttgacatagctcagaaaagtggaattggtaaaatataaaaaatgcacagtgggaaaattatacaattcgtaaatacataaaagggttaacttacaaagatctttattccccccggtgttacaagcatgaggtctgaacctacattactaagtttaaattccagatctgctacttacaactaatcaggtgacttagaaaagtgtcttgaatgcttgactttccatttttccaactataaaaaagggtctaaaaccagaactttcctcatctgtaaaacatggctaaaaccaaggccaacctcacaggcttgttatagaatttagtgtcattctctatgtaaagtgtttggaagagcatttagtaagggcttaataaatgttagctcttttattttatttttattttccatttttgattttttagtgacaaattctcactctgtcacccaggctgaagtgcagtgtcactatcatagcccactgcagctttgaactagtgggctcaaacaatcctcccacttcagtctcccacgtatctaggactataagctcggccaccacattcagctgatttttttattttttggtagagatagggtctccctatgttacccaggctggtctggaatccctggcctcaagcaatcctcctacctaggcctcccaaattgctgggattacaggtgtgagccactgcacctggccaagttcctaaggtatctacccagaggaaaagaagttattgtacgaaaaagatacttgcacacacatgtttatagcagcacagtttgcaactgcaaaaatatgaaaccagcccaaatgcccaccagtcaacaagtggataaagaaaatgtggtatatatttaccatgaaatactactcagccataaaaaggaacaagataatggtattcgtagcaacctggatggtattggagattattattctaagtgaagtaactcaggaatggaaaaccaaacattgtatgttctcacttgcaagttggagttaagctatgaggattcaaaggcataagaataatacattggactttggggactcagaagaaagggtgggaggggggtgagggataaaagactatacattgggtacagtgcgcactgttcgggttatgggcgcaccaaaatctcagaaatcaccactaaagaacttatttatgtaaccaaacatcatctgctccctagaaacctattgaaataaaaaataattcaaaaaagttttaataaataaataaaatgcatttaatatgttagagcagtcattctcaaagtgtgatttccagatctgcagtattggtatctgcctggggatttagaatacaagttcttgtgtcccatccgagaccaagtgaatcagaaattggaggcagcaggtggggggaaggaggcagcaattagtctctagtaacccctccaatcattctgctacactcccaattttacaaaccactgggatacaagcagaagatactattgactctttttatagatacgaattcctagtggattttcagttttgttttaggtattaattaatttgacaaatttgggaaaggctggctcacagctataaagcaccacttaaagatgacccaagcgtcttcaatgttggttcataatctttataatatttgggcattctgaaacaaaatcctttctctgattgataaatcatatatctgaaaaataatgttgaacttatcctttttgttatataactccttatacaactgagaaattagtgttaaacatcttatttgaaaaaaatatggggttgaatagaatttatatacatcgttcaactcatagttttgaaaatccatctcttctcaggtattgtaggattcttttgtgttgggcactaatatcctacaggcatagtgtaaatagttaccttaaaatttttatttcctttctaccctgcttttacatggaaaaggaattcaatgataaaataagaaagacattcacacttaggttggggagttggcacttttgtatggtagaattcagaagcagggactcttcccaagagtatgaagaaagcagcatatatatttaaagtatagtaccagctttagtagaaaggattatgataaacgtatcttagcatcacatataaaaatacaagaaaagcaaactgaataaaatacctattcacaaactactttataaatttttttcattatgttctcctggaaaatcatattatggagaatggactcataagtgctgcttttgtgctcactaatcatacttaagattctctttattcacctacgctgttactagaatattctgaagcagcatgagagcttgtatagcctttggtagattcaccatggactcaacctaaagaaactcttcctgcgtgattgtcactttggagctgaccatccattcccttactatcccttactattattcttaaatagcaaactagcattttgtccataaaccaactgcttctctaggactggctgattcgagaatagcctcgaagtctacaggaattagacaggttccaattttattagaatagtttagaagtcagaattttcatctaatgggagagtgggaagaaggaataataacgaataaggtatgggtctttgcaggacactcagcaaagcataccaacctctgcttgttgtggaataattttccgtcaacaagtaatgcccattaaaaggaagcatggctgtaacctgaattcattcaactcttttgttaaactaaccgtttcctcatttaaccagtgaccactatgtatgcttagcatatcaaagcaaagaatgctgtatacacagggcaaaagaagatttattgtaataattatcttcccagtcttaatcccaaagagtaactgtggctgcttctgctattttcataacactctctagatgcccagaaacccagtaacatggcaattgagaaactttatttataatattctatatattccatcattactcaaagacattctccttgagatacagatgtttaatgacgagaatgtgagtaattgatttcttggtgtcctgttagttatttttttgtgaagagctctttcctaatcagactggatggaacactcaggtcattgctttctgttttgtagagctctccaactattcacaggatgttatttttaatgacaaagttctcataaacaattctcaatagttttccagaacactagtaagatttttcacctggatgtctataataagaactaaatggaatcccaaaaagccatacataattcttacaaaaatgatgtattacacatatactcaatttttaaaaatctctaagttattgctattaagattcattaatattattgccattaattgttgctccccagatgcatggtgtacactcacaagtgtacaatgatcactggtatcctatgttcaggctgtaggggacaaaaagatgaaaatgtcagggagtccactctccatgtgctccccaaggccaaaatgtgagataagagatttttgaaacatcgtataaatgccaagtcaagagcgttctttgatttggaagttacttggactgatgatagaatacctccacatctgaattccgggtgactgacgcctgtcacccagactgaattctgggtggcaggcggaaagaacttgcccatctccaaggcccagggcccagcccatgtctgctttgtgagttccatcccataaatctttcccacaacccactggagctacagagctctcagccctaattaagtgtggtgtccacctagctacttatcacctataataacttgctgtttacaagtgccttgctgatatttcagtcactctgtactgttgctgtctaggaaaccattaatacgggtccatgtaccagatgagcaagtcattcagttgcaaggattctcttgtgacgtttatgcaagcagcaagccatgggtcctgccaatggtcagtggaatttgcagcctttctgcagccaatatgaagccttcaatgccactggggctctcatggcactgccacatgcttgttcctccacctgaaacatttaaaattaccattgtgggccgggtgtgatggctcatgcctgtaatcccagcactttgggaggccgaggcaggtggatcacctgaggtcaggagttcaagaccagcctggccaacatggcaaaaccccgtctctgctaaatatacaaaaattagctgggcatggtggtgggcgtctgtaatcccagctacttgggaggctgaggcaggagaattgcttgaacccaggaggaggagtttgcagtgagctgaggtcgcaccactgcactccagcctgggcaacagaacaagactcggcctcaaaaattaaaaattaaaaattaaaaataaacgtataaatacattaattaattaattaccattgtggtgggtcaaatggctggaaattaacaattccatatatttcaccagctatttctacaaatggacgccctatacaacccgacacaggttaaaataaacgacattccaagtgtgccctcctgctgctcacttcagttaacaggaatctttctctcctccagagtccctcttcagggcacttttcagttgccagtattgcccttcttgacatgtacttgctgttaagctgtgaagcatgtgccctcctgaaggatgcactgttccccttcacctttgtatcttgcagactcccttactccttgtgagtacttaatcattttttccaagagtcactgggaatcccgctgggaattgctaagagggagtagaataaatggttacgacacagacttaaggtcatactgttcatgctgcaatcttttgtttgtttgtttgttttgagaataagtcttgctctgtcgtccgggctggagtgcagtggcacggtcttggttcactgctacctctgcctcctgggttcaagccgggctcagcctcctgagtagctgggactacaggcgtgcatcaccacgcccagctaatttttgtattttcagtacagatggggtttcactatgttggccaagctggtttcgaactcctgacctcaggtgatctgcccacctcagcctaccaatcatgttgcagtcttaacatagttttttcctactggtttatatccacctgataatggaaataataagggtttatacttacctctagtatgagagttaagtaagttaactcatcaacaagtgctttgaacaggcaggggttgagtgaatattggctattattgttattatttaaaggggacaaatgctctaaacttgtctcatttagactcaggacttagccctttgacagaaataccatgagtcagactgcaaaatacgacaccattgttcttatccaaagcccgggatgcacaggcaatggatgccatcaactgaggagagcagcagcttgagaatatggagccaggcactgcccctggttgcatattagcctcacctggagtactccaagagctgtagacccctaggctctccccacagaccaatcaaatcaggctccctgaggttggtcccagggataagtgtttcagaaagcttcctaggcgattctaatattatagcattttcaggaaccactggtgcaaaacactcttggaacacacttaaaattacttttaacagtttggtaccggtttctgggataaaggtaaatagccataaagaaaagtcattcagaggaaaagttcttttccaaggtcatcacaatctcaggaaagtatcaccattcctgtttcttcgatctcctcacctgtggccaccacgataaaaggacataggaggagagaacacattttctaaattaagctgaaacttagtgaaaagcctgtagggatcagaggaaaagcctaactaagcttctagtcttagagaatgacgaacacacttgaacttgcatttttctgtacagggctatagacaaagaccaagaaacagttttcttgtctttgctaagggaacatttagataagacatctcaactgaattgactgttttatttgcccacaataagcctttctcagagcatcttaatccaaatgcatatcagacccccgcagtctgtgttctatatggtacaaggctcctaatcctcacgagtcagatttgtcaacttattatttattatcgaccccccccccccggccaaaagccttttccaacttttattcctaattgcttccctcaccccaagcaactttaccaccacagataatctgttttcatactgtggcctttggaggttcacagaccactataatatctaaagttttgtgtcctccccaattaaaaaaaaaactatttttgtccccgtagggacatcatcacccccttcctgttgaaaaagcacaatgtaattattaataaatggctctgtcagccaagaacatgacctgcagggatttacctcagaggcaacacaagagtatatgcctgcaaagctcagaccaacaaacacaatcaataatgaactgcgccagattctaacccggatccctgcatcatgctgcagggacccaccgcctgttaggacagaacgccttcttttcaaggaaggttagaatagaaaattataaaataaagaatgactctacctattcattatttcaaatgtccttttacctaatcattccaggttttcctgctcattttctgggtaaattctcaaaatgagaattctgagtattaattttgattagttttaaaataaatggtttgatgactagagcagccaacataagttggtgatatatagcagccagtaatgcaaaatgttttattattataccaactataattacttccatttacatactgctttaccatttaaaaatatgttcccatacattcctatttaaataatgagaaggtggtgaaatgatgtatgtattcaataatatacttaagaaggcatataatccagtcaaattattataattatgcttttaaaagaaatgaaaaggtcattatacactcttaattcagacaattttttgataaacattaagacaatgacttccatttttacccttgtctgtcaatcaaagccttatgccacttcttgttcatcacaaagccttgataaagtatcaccctacctctgctttacgtgggtcccccaaaacccacagcaacaggaaagggaggctacacttttggggaggtcaggatggggagtgcacaggatgtccctgcatttcatttctgaatgttatactcatttattaacatcaaatcttcacatcaaaatctcaagtcacatatataagtgcactggattgtctgccattggataaacatgtgtgcacctcttctacctctgctccaggaacaacaaacgagagtactgcaggttaagtggaatcaactttcatctatgtgactgctcaatcagctgcaatcaaaatcatctcatgcctttcaagtctaactttaaaagttattcaagggcaaccaatatgggcagggtcctctcatcatgttctatgtagatgaaatctgcaaacagtccaggctctgctacacttctttgggttgaaatataacaggaactaatcagaaaggttatggcagtgtcctcaccacttaaggtaagtgttctccacagatacagacattccttcatgtaagggagaccctgcaaggcttcagggcggaagacattccttctgactacatacaggtatctacagataaaaagcagtctgatgtagcttgtatagtttatgtttatgacaactagatagtctgatggtttcttgttgtcttgtttagttttattgcattttacacactcattgataatacaatgaattaggtcaacttctgttaaaagccgtaagtacatactggagctactaaaaccactgaattttacacttaaatgggtgaattgcatggcatatacattatatatcagtaacgctgtttttttttttttttaaacctacagcagttcttttaatgataaagatcaatggaattccattcaattaatagctcagtctaaacataaaggagattcataggcatttcaaaacagaagagtccttactcatgtggtttaatgccctgtttacattactaatgatgctctacccaatacagaccaataatttagttcaaagtggtcctaagtcagcaggatgccctcatactcggcagaataaaagatacatctttcttggaagaccataccttaaactctgacctcatgtaattcccataaataagttacaaggaacatgaatccacaatcggaaatcttacacacatgagaaaaaatgcctcagtgagcaggctgtcattaaaaacaataaatagaagaatcaaagtgaaggacactgaagattgttgaattatcagatgcagaaaaaataagggaaaagcatatgtaatatacttaaaaatttaaaggggactttaaaattaaaatgaagagttcttccattattccaaggcagattttttttttcttttttttttgagacggagtctccctctgtctcccaggctggagtgcagtggcgtgatctccactcactccaagacagatttgaataagaaaaaattgaacttctagaaatgaaaaatagaacttaaagtggcatattagaaacagcttaatagaacactgatacactgctgataggattagaaaatggtaaaaccactttgggaagtaatttaaaaggttaaggatatgcaagcgtatgactcaatgatgccacaactagggatttactcaagaaaaagtaacaattaaatcatacaaacacctgttcacagcagctttatttgtaaatagcaacaactataaacaattcaaatgtgcatcaactggtaaatgaatatgcaaattgtgttacatcctcacagtggaatactactcagcaaaaaaggaatgaactattgatatgtgcaattactaaaactgaatcattctttatgatgaaacacttagcaaatcagcaattaaaaggaatgccatgagggctgggcatggtggctcatgcctgtaatcccagaattttgggaggccaaggccagtggatcacttgaggtcaggagttcaagaccagcctggccaacatggtgaaatctctgtctccactaaaaatacaaaaattagccgggcgtggtggctcacgcctgaaatcccagcactttgggaggcggaggcgggcagatcatgaggtcaggagttcaagactagcctgacaaacaccatgaaaccccatccctactaaaaaagttacaaaaaaattagccgggtgtgatgacgcgtgtctgtaatcccagctacttgggaggctgaggcagaagaattgcttgaacccaggagacagaggttgcagtgagccaagatcacgccactgcactccagcctggcaacagagcgagactccgtctcaaaaaaaaaaaaaaaggaaaaaaaaaaaaaagaaagcaaaaaaatacaaaaattagccaggcatggtggcaggcgcctgtaatcccagctactaggagggctgtggaaggagaatcgcttgaacctggaaggcggaggttgaagtgacctgagatcgcaccactgcactccagcctgggtgacagtgagactctatctcaatcaatcaataaatcaatcaatagaatgacctgaaccagataaaatgagcctatagaaaagctacatttggctgggcatggtggctcacgcctgtaatcccggaattttgggaggctgaggtgggtggatcatctgagttcaggagttctagcagtgtggccacaccctgtctctactaaaaatacaaaaaattagctgggcatggtggcgggtgcctgtaatctcaggtcctcgggagactgaaggcaggagaattgcttgaacccaggaggcaaaggatacagtgagccgagatcacaccattgcactccagccttggtgacagagcaagactgtgtctcaaaaaaaaaaaaaaaaaaaaaaggaagaacataaagaaaaagaaaagctacattaaacataaagtgaccaagcaattctgcttgtctagctataaacctaagagaaatacaaacatgtgtgtccacatataaacttgtacatgaatgttcatagcagaattattcacaatatccaaaaggtagaaacaatccaaatgtccaccaactagtggatttatgtcattaaagtataatttatccatacatacttctccatatatatctatacatacctatatcattaactatgatttatccatacaatggtatattgtttggcaactaaaaataaagtccttatatttggtacaacatcaatgaaccttgaaaacatgatgctaagtgaaaagagccaataataaaagatcacatatggtatgattccatgtatatgaaatgtacagaatgggcacatagacacagaaagtctagggttagaagaagcttggggtttcttttggtgtgatggaaatgttctaaaatggactgtggtgatgcttgtaaaaatctgagaatatattaaaaaccattaaattttatatttaactggatgaattgcatggcatttgatttatatctcaataaagccttttttttctaaaaaaagccctgcagcagttcttttaatgataaagattaatgtaattccattaaataaaaaaggttgtctgctctcccccatttcttatcagtacaaaaagacaaaacaaaacaaaaattgtaagatttttagaagaagacacaatacagtaattttcacagattgcttatataaaaaccctaaagaagtctacaaattactagaggtaattagcaagtttagtaactttgcttggtatcagatcaacataaagaatctactgcacttctatataaaacagaaattcttagaagatgtctcttttttaaaaaaaagaacatttccaagagtaacaaaaactctgtggagcctagcaatgagaatgaaacaacgaacaacacaaaacctttctggaaaaatgtctaaatttcactgaataacatttgagaagaattaaatggacatcaagttcatgaatgagaacactcaaaatcataaagctgtaattctcccccaatttctcagaagcagactacacatatgtgaaaaattgacacaaggcagatatggcattaaagcttatgagacaaatgacagtctgctcaacagcaggtattaggagagctactttacgtgaaaaaaagaattgaatctatgcatcctaacatgcgaaaaaatcaatgaaaaatagattaaagattttaatataggtcaagcacagtggctcaaacctgtacagcactttcggaggccgaagtgggtggatcacctgaggtcaggggttcaagaccagcctggccaacacggtgaaatcccgtctctactaaaaatacaaaaattagcgggcatggtggcaggcacctgtaatctcagctacttaggaagctgaggcaggagaattgctttaaccctggaggcggaggttgcggtgagccaagatcacgccaccgcactctggcctgggcgacagtgtgagattccatctcaaaataaataaataaataaataaataaataaataaataaataaataaataaataaagtaaaaagatatagctttacaattcacagaataaataatgggaaattatttaaatgttgttttaattctgaaaattgtttaaatatgtcttaaacaagactgatcaacctaacattaaaaccaagcattctattcatcaaaggacactacagtgaaaaaaagacacaaactgggggaacatgattctaatacatacaactaacagattagtattcaaatatattcagaattaaaataactaaaataaaagacaaaccaccaatagaaaaatatgctgaagacatgattaggcatttaatcgaagaaaagacatgagtaagtgacaagtgtataaaaagtgctaataatgcctaaatcagggaagtgcaaacttcaagctcaccagatttgcaacaacagcaccaaaataattaggaaaatgttaagttttgctgaatatgtgcagcaatggattacatattgccagtgggaaagtaactttgcacaagtacttttgaaagttcttttgcattatggagagaagttgaggatgttccaatcctacaacccagtcatttctcttctgtgcccgcccaagaaaccacttgcacgcccacacaaggagactcatatgacaatgtccctagcgatatatttacagaagaaaaccctgcagactctgcaaatgttctcaggagaaagtgtaaatgccctgtggcatattcaaatgacggagtaggagtcatcagtgaaagaaaaaaaaaatgcatgaactaccagcacccacgacaccatgggcaaatctgcacagagtgcagcaaaaagcaaggtgtaaagaacacataacatatttatgtaaaattcaaaatcaggcaaaccacgtaatactttacttattaggatgcatatgtgtgagaaaatataaagaacttcaagggtacaaataaacacaaaattgagaaagctgtttgacatagtggaagagagacaatgaggagggggcctagaagactctccaacaattactggtcaaattctacttcttcaacagagttatagcattttttaaaaccatgaatatgcaaatactgcatatttgcaatagtacatatcatagatttcattatattatgcatgctactatcttaaaatataagatttgtttctgaaaattatatttgtatagcaaaatctcaaacaaattctctttataattagagccttattaatcaatgacaacattttaaaaatagtctatgatgtagttcagtataatatttttatttggaagtatcttatcattgtgtccaattaacacctcagagctatatttggttttgtacttttctgacacaaaatgtaacaatcttcctcaggaacaacgaaggaagttaaatcttccgtgtaaagtgacaaatccaatcctttaacagaaaaaccactcgtttctttacattttgtttcttaaaattcccttattttgtagttgtcaatatttctttaaatgttttaaatattctgtggagtttatttctttattagttgattatttatttgttctgactccaagatctgcacataaaactaaattctgattaattttcttcctctggaatgctagttcattagccaaacataataactgtttaaaatggtccagttgaagcttaaaatgcacttctgcatccctaccccaaaaggtagtttaactagaaaagagttaatttaaatttaatttcttctcttgaattttgatcttgcacttgctgttttatcttggtattaattggcctgtcatgcttaggagggttagcttgatatatgtcttgttattgatacctaggaaagtatttttaaccagcacaaggtcttgctatcatccctgctaaggtatgcatttaaggtagcataaagactataggttgcttgagggcaggcagtttttcttatcgggatctatatttggcgtctgtaacattatatacggtgtctgcaacattgtgtaacacatggtacctccacaattcatgtgttgaatgaacaaacgaatggatggaggaataagatttcaccctctttcccatcagagcagaggatagcacaaactcatactcctatacatttgtccttgattggctgaccccagcatccactcacccccaacaggcagactccagattttagatgcaaatcctggagaatgccatacatttccataatcccccaaataataatcccccaaatatccacaggctttaaacacattcaaacaattccagtgtttgggtaacactgaggattttctctattcccacattactctctttggtaaaattcttttctagtaccaggttaccagggaattaaatgaagcttattggtagtagaatatagaccccaaaattgtagggaccttgagcaactatccacctgagggcaataccattttcatagtgatgagactgtgtcctaaggagtgtgatattttcatgtatcacagctatgttatcatacacatattactacatattaatttaagaacattgctgtactctagtgttctttggcaatagctacaatacttgtctttagctaactgaagacatcattatcattcactaaataaaagaaagaaggaaagccataagtaaataatgtatctgtaaaaatcagggcatttcctatctattcacgcatataacatgtcataaagatgttatatatttcaattaattatttaagaagagaaagagcccacatgtatggaatactttctcagtgcctaacaccatgctaattgtttgaaaacacttctacattaatgcttataacagatttctgaggtaactgttattctcccgaatttacaaataggtaaatggggtttaccagtatactttccaattacacatcactagtaatatgcagagctgagattcaaatctcaaagtctatggttccaaactccgttgtcttcaccaccaccctggctactacctccttaaattagagcttcagaatttgttgagcatttatgatatgacaagcaatacatgagtccaaaagacaaaattgaactctttaccttaaatgagacatgtcaaaatgacgaggacttcccaacaggtggatgccatcattcccacattagggagagaaggttaattgttaaatttcgaggaaagttggcagtcaatgccttggacagatcttttcaataaaatcttgctgagagtcccattctcaaataagtgcataagacaaaggaataatgtgtgacaatttttaaacttcctcagctcttgaggtactaaacaaacagatgtgtgagaagactgggacttatgaatacagcgttactgtcaactaattaggcgacttcttctctgcctgctgctaacacagcaatctctgaaatttaacattccatgatagtttctcctggataaaagggaattagaatacattcacataggatgaaaattttttaaaaatcaaagggttcttgttgaaaatggagaatggttgtggtaaaagttaagcccacaatattggattagcctaccaaatgttttgttaaatgtttttttgaagtaagtaatagcttcccaatcctgccctgtgtcctttgacaaaagtgagcctccagatcttctcagccctagctctgcagcctctggaagccctcgttaccttgggtgaaatttttctgacctacctcctgggtaaggccaccctctctaacgtgcactgtggagcagcctccctgggcttccatccctcctcttggacactctattgcctactcagcaacgtgcaaagtctctagctggatgtgcagtacgtggcctctcaaagaatgggtatgctcagtctccatccttacccaacaccagtgtaccccatcggctccatttcaaccatactgatcccaaatagcagtttgtcttttgactgttctttccctctgagcaatgcctttaccccatttctttccctgccaatattttgcatccctgacaaagaaatatccctctgtgagccatccccagcaccacttactggttttttttttcacagcagcaacatattttatcatgttttagcatatttatgctttttcttttttctttttttttttttttttttttgataagggggtctcactctgttacccaggctggagtgcagtggtgtaattatggctcactgcaacctcttcctcccacctcagcctcctgagtagccggtaactacagatgcatgccaccacacccaactatttttttttgttttctttgtttgtttgttttgagatggagttttgctcttgttacacaggctggagtgcaatggtgcgatcttggctcactgcaacctctgcctcccagattcaagtgattctactgcctcagcctccccagtagctgggattacaggcacccgcctccacatccagctaatttttttgtatttttagtaggcacaaggtttcaccatgttggccaggctggtctccaactactggcctcaaatgatctgcccacctcagcctcccaaagtgctgggattacaggtgtgagccaccacgcctggcgtttttcaaattttggatagagatgaggttttgccgtgttgcccaggctggtctcgaactcctggcctcaagtgatccccctggcctcaagtgatcctggcctcaagtgatcccctgcccttggcctcccaatgtgctgaacccgaacctgagccaccttgccctgctgcctctgtctttatttgacagtaaaaccccagaaggcaagagccacatcgtagtcatccctgaagcacaaggatcactttaagacattaaacccttgggaatactacataagcatattttcttttaatggaaccaaatattatttcttaaaaggcccactccaaggtatccctcagtgtgaaacactattccagttccttagctttagctcaagttttagtcaaactggaaaacattcagaccatatgaggcaacttacaatatacttataaatttcttttaaattgtgttctccctcatataaagttcatgccttgacctaacaggagatttctatatttaaaaaaagctaaataaatctatagataattcatctgctttccttgaaagtactaaatctcattacttttttactaaagttcaattaatgtccccatcctaaaatattcagatgaacagcaccagaggagaccactgggaaaagccaaggctctttgtgtgtcctaatttacaggtgagcgaaactgagatacagaaatccaaatgactaccttaaaggcacgccttaaatgtgtcgctgccaagaccacaatcttctagcactcactgcaacactttctgctataccccccttccttttccatccgaataatctgaacacttggaatcatgttcatggtggtcaacaagctgtagtcatcccaagattgatgactgacatttcagctgactttcctctgaagcacatcaaatgctcattgttattttgttggctaaaatatcactgtttccaatgttctataatgaccataaacaaacaaacaaatatgaacatgcatcttggtaaaagcttttggactctcagcatctgaaggaagacagagtggatatgatggagacacaaatgcctttctactcctcgtcatatttatacacttacagcagggagaggaataagcgtgcatgatttgggcaatctcttcctctcttgctgtttgctgtttgaagagtatctattcaaagagtcactgacttctatatattaatttattatgcattccctattatacatatgttattattgcactatcactcttctttttactatcacacaatattgaaaatctcatcttcagttccagcagtgcgcatggagacctattaaggtggcctgcgtgaaagggaaattgatttaagctttcttccatctcatcttgtcaatttctgtgtggttgtctagactatattatgaaggagacaaacatggtactactctgatacatctttttagcccacaatgagaggaacaattttataatcttctgtagaaaaattagaaaagagacttcaatgaaagatgttctgtgtattcatcaaaaagggaaaatacacatgattcactcataacagttggtatgtgagatggtttacttacatttctcacttagccactgcaaatttatagaagagcattatccccatttttatagatgaaagaaataaataaaagataaattatgactatatttcaaggcaaagctaggaaatatcataaaaacataacaatgaaatttagctatcatttatggaattacaaactccatgttttggatctatgagtctgaaaaagctctaagaagaagagaaaatataaagaattttcaaccctaaataaattcataaagatttccagttctctactgattagaatattaaatttcaaaattcattagagttagtttttgtaaaacatctgtttatactgcaattcttctaaataaaattagttatattgattgtttttagatgtaaaattaatattagctttttgaagtaagatgacatttaggaaagaaaccacacttcaaaattgatataaaagcattaagatacagtaattgatgtaagaaatatgtcaaataattataaccataaagtattcaacctttctaaggccctacatcaaattctttgaacagctgactatttattattctcaaataaatttagaactattatacgcttaatatgatgactggtattttatagacaagaatattagtataatttgtcaattggcaatttgcaagaattaatatgaaggtaattatactaatgataacataaactcttaagcttttaatttgcataaaaataaatctcaaaaatatattttgatgaagaatctcaaaacaactataatcactgcagtgtatggaaaggaaaagaagcagaatatcagttcaagaatgttcgcatccctagggtgaaaacagacgagagacatttaggtgactatttacaacacaattcaagatactgtgttagacagaaggacagccttgtggtgtgacatttgaatgcatgtgcttggggagtacagatgcctagattcggaaatcaatgtctagacaccattgaatctatagaaagtgattttttttctctatatctcaatgttctatctacaaaataaaaacaataagactttaaagggttaacgaggatgacatggtataatctatctaacccatttaattttgtgtctggcctagggaaactgctcaataaactctgcaattattattattaaaattattagtcattactattgttagaactactatcatccttttcttaagatcagagtgaaagtatgagactaaatcaaccatagttccacattcggaggacatcaagctatctggccctggaatccaagataccacgttaacaagtagatattttcatgaaaattaactatgatgaatatcaaaatgtaatattatgacctagcaagatcagaataatatatactatttaatgtactgtataaatcaattatatatataaatatatctacatatataatacatataaaatgtacataacataaaaaaatgaataatacaatagataatatgtatactggaagatataaacatagaaatacttaagattaataagactggtgatactgccaaacaataccaatgagataagaacagtaataaaatcactgtatgttcattcgtctgttcattcatttattcattccgcactgattaaataaatgaatacagtattagttgctgtgtgctggccactggtttcgcatatgcttgtcatccccgtcctggagaaattacttatagactagccaaggaaatggaagagaaacagacacctagttctagcagttgacaaggctcagcaaagccttagtatgggaggcagcagctttaatccagtttgtgtattttgcttcaggattaggagatcaaagaaaactggggtactatatagacatggctcagtagagtggccttggactcttggctagatgagaaagtctcagagcactagtgactacaaaaaaagagaggtttagaggaataagagcttccctgttaaagaagcaacggctgtaaatgctcctgctattcgggaggagaaagagaatgaaaacctgaccagaaatttgatggtgcttgggaagcatggagatgaatcttgaggacccaaaaagtattttagaatatccctcctgctttatgaggaaaaaggaaagactataagaaggaatcttagaggaacaatctcagcattaaaaggcaaactacatgaggttagaattaaaataaaaaaaaacagaaataatgtgaaagaataaaggggttatgacaagaagaacaatgattcataaggagatttttgaattaggaatatttgtgagggaaggttctgctctggaatttaaattggaagaaaacaaagacagaaaaacttggaaaaaaacaaaattggcaatgctgagaagtctccaaaatatgtctatagtccctctaatttgttcttctggttttgtagtgaagcagacactctcaaagactttggaaatgactactgcaatgttaattctgaatgacaattcaataaactaattgtcttgtttaaataaatcagtacaactttattggagcagtaataatttagcctcatgagaaatggtttttttcctagcatggaaactaacaattactccctaactttgaaatagaaattatatttaataaaaaatttccaaaaaaatgatccaaaagcaatctaactttttttttccacctggcaaatgtgtactcgctgtggtaaggatataaattcctatggctatggttggtaaacagtaaaaagcatattcttcaatatataagatgtctggtttccaaaaataaatattttggcaaattgattatttatttaagcaagaataaatcaaattatttcaatattgtatcctgcagaagataatgaaactataaaatgtcttactttgtgaaacaattatattcctatattatttatttcctcatgaaaattcacatttatcatgcttttgaagaaataaattttattctcacaaaatgtatgtgaccactggcttctgtttcttcactaaatactgttaactattaatatattaactggaaatcagcatcttctctaaaataagtctgactttttttgcatatgtggaaaagatttttagactctagttatagaactgttggcatttgggctcatgaaatttagctaataaagagaatggcctttgatagtatttataacacgtattccttttgccccctaatatccaaagtatggcagactttgttggaaacctctctttgcaaaagttcaatagttcaaaggtgggaagaaaagaaagcacttccttatgtggagcaagcaactgttaatatttattacgttttatccttttaggtgtagctaacaacatcaacatcttgggaatctatataataaaaatggtggggttaaagatgattgctttatttagttgtccttattctatagtaaaccatcactccactccagattcaaattctaccacttctcagaatcaaagctacagattagcttttgagtacgaatgcatgcatatatgcctgaaaaataaaatagggtatatatattaaacttttgaagggaataaatattgtcacagaataaaatttattttctctcaaaaactttaataattcagctttttgtaatatatatctaacatgaccgattacaaagcattgtattacttttctatcatgcataaccaatcaccaacagcaacgttcactgtttcagctaacagttttataagttttgtcaagtcagacttggcaggcaagtcagacttgtaaaactctgtttggagttttacaaggctatcatcaaaatttctcaagggctactttctcttctgcaggttctggggaatcatcccctttcaagttcatgcaagttattacctgaattcaattctttgggccatcagatcgaggttctggttttcttgcaggttgtgagttcaggatcctcctcagcatgtaaatgccatctgcattactagcccacaaagcccctccgtcttcaaagccagcaccagataatttatcttgtgtcaaaactctctagcttcgaattgaattttctgaattttcctttgtctctgacctccagacccagatttaaaggacttgtgtgattaggtcacacccacccagataatctacctttcttaaagtcaaccatgctatataaaataacctaattaggagagtgaggccccttcatatttacattcctaggattatacagtctgcgaaaaccaactgatgacgggaatcttgctggacaccttagaattctgcctacctcaagcagcaacgaattttcttccacctaataatccttggaaccatgctgggaatgagggagttattgaagagacatacacatttggaatctcttgataatccaggagggaattagcctagcggaaaattccaaagaacggttcattttctttaggaagggcacaggttgctgcccattggcaaaaatattaagaggtgatttccaaaaaagacagaggaattatttcaataattaacaaagggggaggtgactgaaatccataaatctagaaatccatagcgaagttggttagtttcagaaacaatgtttaatggaaaatggtacaaatctcaagactacattttggaaattttcagtcatcatttagtcaatcaataagcatttactggggaaaagttccatggcaggtaccatcttggtgcaggggatacaggaaagaacatgtcaaggtcacgtacagaaagggctcacagtcaagggaaagagacatttacctaaatgcagataatggtaatactttggctgtgagaaacacgtgtgtgtgtgtgtgtgtgtgtgtgtgtgtgtgtgtgtgtgacacacaaggtctcactctgttgcccaggctggagtgcagtggcacaatcttagctcacagcagccttgacctctccgactcaagtgatcttcccaacttagcctccagcgtagctggaactacaggagagcatcaccactcaaggctaattttttgtatttttttttgtagagatggagtttcaccatgttgcccaggctagtctcgcactcctgggctgaaacaatccacctgctttggtctcccaaagtgctgggattacaggtgtaagccactggcctgtgagaatatattggtaggtatacacaggtgctgggtggggcccaggttgtcaggatcagggtcaacctatagctttgagtgcaagaacatggagtttggaacctgtgactgaggtctcgatctcagctatgcacttactgtctatgtggcattgtgaagatatttaacatctaagcctgtttcctcatctatatgacgtgagaatacttaccttgcaagtggtcgtgtagactaagtaggtaacacgtaattgggagctgttaggttctacactagcaccactaccacccccttttctggctaccaaatgtatatttggtttgggcatcattgtgcaaaaccattgcagaggagtctggaatttacaagatcccccagggtatggctggccaagtgaggccctctgggaaacatttttcctatattttcatatatcattaattatagaattaatatactatatacctttatatttgtatgtgtatatatttatacacgtgtgtgggtgggattgtggaagacagacagataggatgtaagtcccttccctcctttccagttctacatgctcacaagtgagactgtggtgccttacaaccatcaggtgaatgcttgggaatcagagacgttgacttagggtcatggcaccattgagacatctaaagaaaagaaccctgtctaccttgaggcttcatgttaactaaggctgagacaataaatgtttccactgctctactccattttagtccaatattctatgctctccacttataccacataaaatgaatttagcacgacgctttaaactgtgatcccttcaatagtaaaatggttgttgttctatcttctatacctaggtcttacctggaggattcacaagggtcagagcaccccaagtctccatgctatgatatcttgcctgcttgcccagccttctgagacgcttctccccagcctcctgagatccttctccccattggagccttccaggagtagctggagggtgcacaagggcatggtgcatataatcagaactgccacctgcttctctgcagcttgctgttgtcaccatctttctccttcagtgggggctgtggctctgctgtccttgggctacagtccacatcctcactgctggacaactgacaagtaaagttccttccctctacggccttctgacgcccagtgccagctctgctagagaagttacctcagcaaagccctgagactaccagtgacctggctgcagaggccatctgcagggatggtcaccctcacgctgtgtctgattcccctgccccttgcagcctccacctgctttgttcaatgtggcccacattgccagactcctccacgtccttgcaaggatccattcttcctgccttgctctgctgtggcttcctaattgacgaagtggagacaatgatgacacttaactgaaagggttaccataagcatgaaatgaggcaacatgtacaattcttcaaagagtactagccctcaggaaaaactcaggaactgctggcctcactctttataattgttattattgtcataaatcatcatcattttcatcagcataagtcttctaagagttatgtgtcatttaggagcagtccatagatagatctaactgttggtcacactcctcataattgttgctattgtcataaattaccctgatcgtcaatcacaagtctttccagagtcaagtcccctttaggagatgttcataagagtggtccaactgtgatttgaattccatttctctaccattatgttactgatgcctatggaaatcaaggaatatgtataggtacctattaggtgcccttaaattttcatcaacacttggagaaatccctacccattctttgactgaaggttaaaatattctgtggtagggcacttatggtaaagtcaatggagtgatagccccaacccttctccaacactttgtgaagttacaaccactgccaacagtccagtgagaagaacagaacagagaaacagtccagtctgtgctgatcgagaagacattcagaaggatatgagccctgaggtgggtcactagatccataggcagaggtaaccatgctaaagagggaggatattctaggaagaaagcatcataggctctgagatgagaaatcatcatgcattcatagaactgcagaagtggggaaggatccttcacagacatggttctggtttatgtatcctgcagatctaactcacgccgtgtagaggatggacttgggctgaatacagacagagggatgagtctgaatgctgttataaggttaacggagagtatgacaagggcaggtactcaggcaggtctccaggcaggagcctcaacctggacgaggactggatggctcattaagctgccggataacacctcattgacaggcctacagcctcaggaatgggccttgggctgagcatgagccagatcattgtactggccagaggttagggctggctactaccaagagggacttgattatcatcttaaataaagcaggacttgatcatgacccttcataaaaaagcatcatctgtatagtgttcctgcctcaggtctgcatagttcttgggaatcatgaagaaaatatgaaaccaaaatctctatttgtgggaaagatgaagaatccaacagctttttgatctgaaaataggttctgggtgaggaaagccaagacagaaatgagataaggtacaaagtaaacctttagctctaataaaaagcaccaataacttctttccagatgactcagaacccttagacaatcactaaacagtctgaattctggaaactatgatatgcatttggatgtttaggaaagtctgtgaagagattaagagaacacaatgttcccatttgcagggagttataacctacagaggtagatgcagaagctgatctgctgcaacaataaagatctccagattgcttgtcccgcaaattcctagcatcctcctgtactattggatggactgttaggaagttgacttgtattacaaatgcatactgataatttttttttaaagttgaaatgttgatgtgactacctgaaaagagatctttggctgggtacagtggctcatgcctgtagtcccagcactttgtggggtcaaggcaggcagatcacttgaggtcaggagttcgagaccagcctggccaacatggtgaaaccctgtctctacctaaaatatttttaaaaattagctgagtgttatggtgcacatctgtaatcccagctactcaggaggctgaggcaggagaatcccttgaacccaggagggggaggctgcagtaagccgagatcgtgccacagttgcactccagcctgggtgacagagcaagactacatctcaaaaaaaaaagagagagagatcttgggaatcagataggtgcaattcctaccaccattaaagtcagagtaaaactgaagtatatttattagtcatttctacctcttatatacaaatatgtctggcagttgtgacttgattttgtttcttttctcctaagaaactcttttactcactcgctagtatcattaagaggtatgaatcaacatcgaaattaccagacttttaaaatagccctctttttttaaaaaaaagttgacgttctatttttgtttaaatatcccttttgatgtgctaactaggttagtctatcacctttaatgaaaacttgaatttctaaaggtgcatttctaaagccaagaaaacaagtaggttatgacaaacaaacaaacagtggaagtgatgctatgcatcaactgttctccagagaagtatcaataaattgcttgtagttatacaaatgcagatgcatacattagagatttccaaaatacaaaataattaagcttgatgaagactgatattatatatggcaaagggaaatatttaggcagtgtcatcttcactcaacactattatttagtacagatttaagacagatttattgattatatatcataagctgtaagctagacatacaagacacagtgtaaagaaccaaaagttgtcatggtatcatttttctgtctaccttggaattaactgatgtattttattcaagacactttggatgtaataaatgaaatcaacttgagatgaatcaaatcaaatgaggaaagaggacaggttttaagaaggtatcaggtaatgtcatgaatgcaacatacatgaaacgtacattaggcagccagtcctaatgaaaactatacggctctcactgactttcagggccatatggcttctctgttttgggaggctcactgttaccacagagtcctccactagcacacaagccactatggccaccattgccaagcacccactattgtatgtcacagattttggcttgcttatttcatatcctccagagtaagagcccatatactcacagtctggtcaggtccatttacaatacaaccaggaattggaaattgattcacaggttactaaacagttccctagacccattcctatcaggggctggagttgcatgaaaccatgtaaaaggtatacaacatgggaaaatgtcacacagaaatatcaggaacatgaactgaaaaggtaaacagaccaatagtgaaacaagaggcttcaaagccaactcgacatcaagtcaatggtgcatatggacctataaaatctggcaggcttagcttttcaagtgttcagctttaataggaagctcttcatgtatataaaattagatggagtaaagcaaaaatacacttaaaattattatttttctctctccctaaattcaccaccttcaattagtccaacttataaaaccaacttcaagtgaatacagtttactttttgttttcattatccatcctgctttggttaatctggatgtttaggcaagtctgtgatgagtttaatacaccatgatgtacgtatttgcagcaacatatacatttggatgcagaagcagatgctttcacatatcctaaataaggttttataatggaaaataatattccatccacgtggttaaccccgcttaacaacagagagtgcagtgctttctatttaaagaaaaaaaaaacactaagcaatgttaaaaagtttaacagcatgtgactccaatacgaaatgctgcaattacaaagttatactcttacaaatataaagtattttggaacaatgaatacaaagacatttttattcttttgtggcagcaggtagctaagagtcaaccaaactcatgttcctacttctgcagagtggctgctgaccccaggactctgccccacttccatcgatgagaggtcatgtgactgaaattcactaatgaactctgagtgcagtgatgcaattgatgatgcaattcaggatggagccataggggatggcaaggtcatcaagttagaaagagggcgtgagtcactatatggagaagaagtaggcttagttggctaccttagagagaaacaaactactattgtgttaagttcactgcagtattcactgcagtttatttgccatagcagccttggttttctccctaaaaatgtagtagagtgccaaaaacacaccatctaacaagagcgtttttgagaaatggaagttaagccttatgtctctttcacacacacatgcacacatacacttacattttcatatacgaaagcctggttctaaggaggataattttattttgtggtcaagtggctaaaaagttataggctttaaaaaatatatatttcataatctcaaactaatcactaattgaataatcatttatgtttatgaatgaggaaatatttttacacatggggaactgcacgtgtggttgatcttcaaggggcaatttcataacttagcattatgtattagcaaaaacaatactggttccaccagaatgttctcacttttatttcaggaacctggagctctggatcatttacgaaaaaaaaaaaaagtcccaaactcggagactgtgacttggcatctcctgatttccagcaagctggctgaatgcaaagccttcctttgtgtaaaattacgtataatttgcattcagggcaggcattaattttgttaaaagagtttcaaatacaaatcaggacattttggacaccttttgaacatcttaaatcaggtcagttacaatttctttccaacgtttgactgaatgttccaattccaccaccgggttggaaagaagagaaacatcacgatttacttgcaggggcaactcaaagcacagacaatgaacagagcggcgctagtacctcatgctgctcatgctgccagtctcggatccgagcttgcatcgctccagctggctggctacgatctgccgttcagcctccagctctcgggtcagcctttcaaactgtaattcctgaaagaaacccatcaacaagatcaattcaatcatctacatgacaggtgaaattcagaccaaaataataggacggctgagggagaaaaatatgattttccaagatgtcaaatttgagaaatgtgcaataaaactaggattcgaaggttagacaggcttgtggcccactggccatgcaactttgaataagttaattcatgtaagtatcagtttcatcatttgtaaaacagacttaaatacttatttaataagatggatatgaggattaaaggagatactgtcatgaaaaattatcctgtgctatctttggcagacggtcagcacccaacaggtaccaatactcctgataccacaagtatagcatttaatgagaaaaagagttcagtttttaattatcttttggagttttgtgtttattccctactggccttctggccaactctatagtgtttactgctttcttcatattacttatatattgtagattgaagaaaataatgctttataacccacactcttcataactttgcattccagcagaatgacaatgataccaattctacacagcctcattactaagtacataacctttgagatatttgatatatcgccttaaaaacagacaattgaaccaatgaaaaatgcttctacaaaactgcctcaaatccactgttgaaaactttaatgaatgattcaatcagtacttcaaaaatctcagctgttccaacaacaggattttgtaccatattttactactgatgttttctttcctcatacacttaagtttttttaaaaatgaaaataaccagagcaaatcatgtattttaataaggaatggcagggaaagtttttacaatgtcacatttaataccttttaaaaataaattatctaaacagttatgttttggggataagaaacaagaatgctttctcatactgaaaaatagctcaggagtcagttttggagaatttaaactcaaaaggttgcagggatatatctttccagaaaataagattttatttacttgctaccccaggacactcttgcatgaggtctttaaaaagtagaatctggtgtgtcccctatatacattaaaaatatcctggctcttttccataggtgcacattttaatattgacattattttgggaaacaaagtaaaagacactttgtaaatgagagcttaattttccctttaaggtgctgaaactgagggaacattttgttttttaacctcaaacttttattcttacatattctgaagggcatcaaagtattatagttaagaaattaacaagatctcggctgaatgtattttatgcatctaacttcttcttctctcttaaagtcctactgcttttttttctttctggaaatcccttttcataatatccaacttttagaagattttttcacttctagacttcttaacgtattgcatcttaaatctctctgtgaaacaggaaactcacccatacttttaagttgataacacttttaaaaacataatacttgaagaccatacagaactcctcacatgtcgatggaaattcattctttgtagcatctaaagtactttgatttgctgcccactttcctgtgttaccgaagttcaacatggtgaaacagtgcagtatttggagtcagaattcatcaaccaggggcttccgctaggacggatgttgctcttggtcatccccgcttcaggtggtgacttctccatggtttcacctcttgtcagtctcacaggaggggtgacaatgggagatgactttctcgtttgcaagcttccttcccagcacgcagtcagattttccaagactcttcatccattcatgtagatctgtatttgcatctggctttattttccttccctctgaaagaacaaccttagagttgttattatggtgcagttctttgggtaaagaagtcttccagcttgacaggccttcaaaaggtatatatgtggttctcattttggaagacgtttttgctctgtcatcctcttgtttgcactgtttctaacaccaccaccaccacaaaatacagttacccttaaatttatttctctatatgtctatagtgtttattttgtatttttttattttttttttaattgagatggagtctcgctctgtcgtccaggttggagtgcagtggcacgatctctgctcagtatatagtgtttctttttaatttttctctgcttttaagattttctctttaccagaagcactgggcaatttgatgattatgttgcttggtgtagttttcttcatgtttcttatgcctgggttattcagcttggatatctggctttatagattccagcatatctgaacattttaggccattatttctttatgaattgtttttctgttctccattatttcctttccttcaatgactccaattaagtgcattttaggccacttggaattgtcccacagttcatggattctcttgcaattcaattttttttttccttttgtgtttaatttgggtagtttctattgttgacttcaagttaactaagctttgcttctgcaatgcttaacctaccatttatcccatccagtgtatttttatatcagacactgatgaatcaaacatctctaaaaatttcatttgggtcttttttgtatcattcatgactttatttaactttttgcacatgttgattatacctatattaattatcctttttgttaattctaacatctgtgctagtttcagctgattgacttttttctcctcaatctgggtcatatcttctgctcctctagacatgtaatcatctttcaacacagacattttcattttacttcttgggttctggataggtttgtattcctataattgtcttcagctcttttatgaagcacattaagttatgtgaaagcaatttgatacttttgagccttgctttttagatttgttagggggagcagaacagcatgtagtctagggctaatcatcctgccctatgaaggcaagacacttctgagccccaactcaatgccccatggactatgggttctcccagcttggctggtgggtgctggcaaacattcccacctctgtgtgagtaccaggcacagtttcctcacatcctttcagatggttctttccctggtctctgctagtttccttacatacatgggctgctaagttgtttgctgaatatgagaaagggcaccttgcctttctgatatttggacccatgaactccctggactctcagcactgtcttaactactgagaccctgctaggcttcctcctttctgcactgctgtgtggaaactctctcaaggcaatcatttcctaccttaccccaagccaagggtctatggcttacagggaaaactgtttgggccttgccacaccactgaggctaggatctgtcaagatgtaaccaccctgaactggaatggtattctctttggagttgataactgagcttgtgaatggaaacaagaagagctagaatggaggttctctaacttggaaagactgactgatttttcaactgaggattaatttttctccttggtatagacatttttgtggcccaaaggcatctagagaagacacagcattttcacaagaatggatgagattcttttgcactggaggatacttaaactgtggggtaaatggaaagatgacattatccatctctaacacagtttggggtttgagggaggacagacctctcaggaatgaataagctgctgagtttcttggaaaatttgagatgaaacagcattcaagagagggatgttgctaataagggcaggtgagtatacaagaagttaactggaaaattagaactatgtgaatatatttactgaaacttgtaattctggttataagtaaatatgtagtactaaactaattcagcaaaagtgagactgtcaagaaagaagaaatatctctaaagattatctagatttgcagaatagaagaaacaatagaagccaagataataaatagaagagtaattctggggtaaaggatcactagtatggccttctcctgggtaattctggtggagatgtggtgatgtaaatcaggctgcataaaatgtaatacagagactgcccagagacattaagatttcatgggaatttagagtacctggtggtttagagaggacatccaatggtaaaagaagttataagaaaaagcagagcagtgttagaaagcctaaatctccccactatgtggaaatcaacttatgtaagagatcataaatattcataaaagtattggagatatgatgcaaaagttcattaaaatgtacaaagaaccagatttaaatggtttcatcctagaatagcacattattgaaccatataatacattaggattattataagaaaaattatcaaacattttataacttttcctaaacagcctaaattaatgatttatttggtttaattaaatggagtttattaaatgtttttaagtagataaaagcatgtaaagtctcttggggggacttagctaacttagtatgaaaactgaaatcagaaaactcatcgccatagtttcattacttccctcaataaatatgttacttaactttgtggtatagcattagttgggatggtatcatccagatttaaggaagtataaaaatggacaattgttaagtcttaacaatattgaggcttcttcatttctatggtctaaatgcctgtgtctccatcccctgcccaagattcacatgttgaaatgctatccctcaagatgagggtattaggagttagggcctttgggaggtgactagatgaaccaggaagtgggccctcaccagacaccaaatctgcctgcaccatgatcttgtgtttcccagtctccagaactgtaagaaatgtttcagctatttataagcaatgcaatttatggtatttggttatagcaacctaaacagcctaagacaagatgcacatactattttttgcacagtttcatttccattcacatacaacattttgttttccctaagttaagaacttggagttttttgttcctttgctcagttgtctatggacttatcaaaccccaaactcctccgatttgtataaaacttctcttcacacaaacatatgaaataatatgtcaactactgaagaaatctctcctggagtttttgacctgctccaatctggcctggctgccttctttgcacagctgtcttctgggatctctctccatcttcaggcgggagatttcctttgtccctctcttccgtggattcctgtctcctctatgagttgtcttcttcattctcctactttatttccttttctggtagaaaatgtctttccagatacacagagatagagagaatgaatgagaggtattatgttctgacactttgcacatctttatatgtttttattctactctcacacttagtgaataataggacttagtaaagaaatagagaattctaggttggaaatcattttccttcagggttttgagacagtgattttttgcttcattatcttctactctccaatgttgctgttgagaagtgtgaaaactttcagaggttttcttttcttttttcttttttttttatgaaatctgctttcactttctcccagaaaacatgttgtatgtggtgacatatcttgatatacctctatttttagacatgtttgctggatattttgtgatctatttatttagggatctttcgatcaaaaacctattgtttattctaagcaattcttttgaaaatttttaatgcttttctcctcctttttaacattactcttgctttttcttcaactctcattattcagatgctaaaatctagtcctcaaggtttcttcctttagtcttcttctcttgtattattctgtttctttatcttctgttttactttctgaaaagttttatcaatttaatcatgtaagtctctaatgaataattcattgctattattatgcttttaatttctcggagctagtttttattctctgaatatttcttttaatttgcatctggtatttattctatggatgtaaaatcatctctcttctttctccacagtattaatgtggtcatgtttgttttcttctctctgcatagttcctattttatgatttttctgtttgttttaaatatgtatttttgaaggtatctcaacttccctggcagtctgctcatatgtgactgttggggtgaaagagctgacacttgtatgagcgccagcatgagtgaggcttgttagctgtgccttccaggagaaccactgtgtgcagaacatcatgcagaatcccctgaaaaggctcttcctagctccagctttgtgcataaacatttgcctgctctttttccgcaaagctaagcaagattgaggaggggtgggtctcaaaatttagcaagtaaaactgtattcaatacctcacttttaacagtttttcttgtggtccctgcgtcaagagaattaatttcaccccttccagagaaaaagcctctagtttttggcatggtggggtaggggatttggagatctagctgatatctaaattagtgttcagccaatctccggagcttaccactatacttcatgccccatgcacccacaccccgcaccttcgagagattttcctgtgtaaattggtctacgatttaactcacccccctgcttagaactccattcccttgggtataataagtcacttcccactttgtccatctaccttctttcatccattctaagtcacacatttttcacactttaatatctctgggtttaccagctcatgaattgggatgacttgcatttgatagtgtgtgactctttattggaagtactgttgctttcttcacagtgctttaagtaaccctaaaaattgatggcctctcaaacttgatgaaatatggttctttatttacccactctctatgtttagggggttataaccccttttaaaagtcttactgccattttggcaaggaagcaggggttaacacaagggttcagtgcatcttctttatttggcagtcagatcatcttttaaaataacttggcaagctcagggcaaagaaggacaggtcagagcaggagtgaatctaaaacgccccaggtctttgtgacatctgctgaacccctgagctggaatattctagtggcataggttggtccctctgctctccttctaagcataaccatatcctacaccaagatgctgatcatgttcctgtttagaaagatttaaagaatgtctgaagtcccatacttcaggtttcggtcaactttcctgctgtgtcctctatttctgaaatttgggttcatacctagttctattttgagcaaatccctgggtcaataatacagagagaagtccttctctaggcctgggcctttacagaagcattttgttgactactcaaccttcttggggaggatgttctgcctctccacacctgttcctgctggtggctccactggatggtaggttgggcctattagatgacatcctcctgatacatccctctgctccacttcaacttcttccctcctcctttcctacgactgaccactagctaatatacccactggctcctgacagagtctcagcaaattatctatttcccccagtggcccgctacagtccccatgcttcattcactatccctatgtctggcccatcctgtctatagatgagacctggttctcagatgcacaaatgccaccacgatcgagttagctgcatgtaaaataagagaatgaaacagcaattctgtatttcttctgcagctaagattgaatggttttatggagtctgacttagtgacaatgtttgcaataatagagcaaaataaccactcaagtgctctgaagtatttaattagaaagcagatttcagtcattatcattgtctaaactttttccttagatgttctacctgggagaggatcaaggtacagaactgtggtttctctgtcctagtttcccactctgggttagactgcttgttacagttccagctaatctttgggaagctacttaacatctctaagtctgagatgtccccgacaatcaaatgcctaccttattgagtcaacattggaataaataagttaatacatgtgaagcacttagcagaataaggtacatgataagtaattgcttaaaatattaactgccattatgtgctgttatcataagtagatatgatagtatcaccactctgtaggtgagttcttgccgcctggtgtctctcctctctgcactgaccaacaattaataccattgagtatgcctgggtgatcttttttcttacatcacttttaattcccatttcacatgaatgagttgactctacagccacgtctcttggcaatgttaattttaccccactgaaacatgttgccaagccaagtttgaaggggaagtggcacaaatgacagggtaataattggaagcctacagcagagtgtccaacaaatctggacagaacaagccatgatgtcaagatggaatggaacaaatcaatgtcaactgtaaagccgtgtacacctcattggtgagtcagaaactgtggcaaagagctgtctgtgaaagtttacaaaactgacagattaatgttttcaacaacgacagtgtcatcctgggttacccagcaaggcagcagatgacaggaatcagaacttggaaatggaatcataagcacctttccagaacacattcaataaaataaaaatataacgaaacacctctttctctccaactccttcattctgcagtgttccatctgcttttgctctgccattttctcttgccaaatgccttgttagccaaataaagcatgtttaatacagtttatttaattcactagctgacaggactccatgaaattaacaaaggctacatgtcttggtatttgaagatgatgtataattccattatgcttaaaaaattagtagcaatattatatgggtgactctaaactctatcacaataatctctagaactgtttaaaatgcctgggtccattccccgagaactgaagacacaaatgtggaggcaacagagcccagcatgtgcattctgaaaatgttccattagtgattattatgctcatatctgcttggggatgactattctacttatgataacagcacataatggcagttaatatgttaagcaattacttatcatgtaccttattctgctaagtgcttcacatgtattaacttatttattccaatgttgactcaataaggtaggcatttgattgtcggggacatctcagacttagagatgttaagtagcttcccaaagattagctggaactgtaacaagcggtctaacccacactaacagttcagaaacccattgcttccaagctctaggaatatttatttccactgttttaatgaaggctatataatcaggaacaatacagcaaaaataatagcacaaatttctttaatgaggaagaactatagctcatcatttcacactctcttttattttagttttcctcgcctgcctggaaataaaatattagaattattatgtccaaccacagaaagaattatacttattgtactgttcaagttcacactacaactgaaataattccttcaaataatggcccttaacttttaagaggagcactgccaaactcagatataccaaacaagggcaatgaagacagagagggggtgtacaccaacatctttgcctatacttataccacaatagagaaagcagcctttctatatttaaagggtgaaagacaaaagtaccagaatcctagcctcagccaaaatcgatgacttgcatttcctcaaatggactttgcatgtgttcaatctgcatttattcactcattgctccaaatatccatttcctcttctctatcctttccttgttcctcaagtctagcaaaaatgcctttgcctttcaattttacagtgatgaatcacattacttcatttaattgccatctgttctatatatatgcacatttctgacctcaccctcaatctcagcacctgagaagaattgtccaccactctcatagcactaacaacgctttcctgaattctgttatttacattcctgtctcctctcctggaccatatatgccttgatgacaggcaccatgcttttgcattatcaccttcttctcatctaccatagagtgctctcagtacatgaggaatagatggatgagtggatggatgccttacttgacctcaacaaataatgtttgcatccatatgagaaaatgtgcaatagtgaagagcaaactcaaactatcgatctgggaaaatctaaaatatgacattagatcacttttatagcacttccaatgcagaatttctgttcaatgatctttttccatgaattgctccctcactctacctctctctcccctctactctctgtgtcatcattgtacatcctttgtataactaacccgttttaggaataatgtttttcagaacagaaatatttgagtgacaaagtatgatgtttatcctttcttactcaatgctctttgttgaaacttaaatagctaaatatccatatcaatggaataattatacatgctcttatcaccaaacatcatgtactcgacttgacctggtaacagcattttactttgttggtctcctgttccttcccgcacaaactcttctgatggtttctgacacaccacctcctgctttctttcccacctcttttgctgaccctctcattttcctctgtggctgtctcttcctctcttaagccaccattctccttgtgattcttatactttctctgaacaagctcatccattccgaaagcctcaatgactagttcttggtgtttatccactgacattcattcccaaaaccaagaggttcacatccaaaaccaaaatcaaccaaatcctacaaacctactcccacttcttcattttcctatctcacagaacgacagcatcatttgcccaagttgcctgatccacagatttgcaaatctttctagactctgtcctctccagacatacataacaaatcatctttaatctgccgagtgatgcactaataccactccagttttggccacaagtatctcttgcccagattcctaaactcagtatcctaattaatctcttgccctgttcatacttgctttcaatctgtttttcaaaatacagccaaaatttttcatgaaaaataacaaatgtgattatgttactcatttatttagaatattttagtgaatcctaatttccaaaggataaaaattaatttttcttaacatattaatcatataaaatatagttaaattacatacaattaagattaaataattatatataaatatatataattttaaaaggttacttattacagtacagttatattagaagatgacagcatcttcaaagttatgctccatttattggccaccaagaaatgtatgtaaaacttttcagagtgaggaagaacactgttctgacttttcagaaaagcatcagtagatacttgatttctatcaacctagctgcaaagctctctgtccaaattgtgaaatctacattaaaaaaaataaactcagtcataaaattgacactttcagatatttttatcctacatcattacatggcagaataatccattttctcatcatttacctccttcctagcagaacagtctgttttctcatcatttgccttcttcctaacctaaaacgttctaatgaatttcagagtgcagtagctctttgagagttgaatgtctgtcagtatttcaagactaggaatagtttccagtctcttcggtggctggagaattcccagtgagttacctaatttgaccactggaaatcaaaatttgcccccaacaatatggtggtactgctgctgaatttctgttaaatacccacagtgtcggagttttctagtatatatatgaaatgccgagagcgtgccatcttctcactgacaatgaccacaggggtgtattgagtctttcgcactttgcctggcagctaatcaaaagttccaattatttttgacttattattatgttttatttcaaggcaagaatgacattatcttctcatcgaaatctctggtatattatcacatattaggtatcaaatcaacatttatggaataaataagtaaaacagcagtagggcaacagatgcttatgtggaaagcattctgcaaggtgctgaatgacgcagtcagggaagatacgagcataaaattaattcaggtgtggatcctgttgacagttctaagtctagtaaaatagttgaaatcaacacatcattaaatagaatgcaaagtaatgctaaattgtaatgagatgcaaatgaatttcaaagatgactttcccttagaaaagatggaagggtgtggggacaaggagggcaacgtcacatgcaggaactagtatttgagacggacaatgggagattattatttgaccatgtgaaagggatgtcattccaggctcaaagaacagcagggatttaagcacagaccttgacaaatactgaatgtgtgtggttgtgtttcagagagcaattagattccatcttattggagtttaggggcaaatttaccatcaggcaaattacattggaagtttgacataagcaaaaggttgatattcaacaatgatcctaattttcttcgtttactgaatttgatgcaacatctcatctatttccatactccaaataagaaaccctttgaaattttatggaactcatgtgtttcactgacaagaaaatagttaataaaatttaactatgtttttgacatttgagggtcaatagtgtaaacatggatcttgcactatattgcactgcaaggatgttagtttgccagtccctaaatgtccctgtcaacagtagagcttttccgtaattaggcaaacacaataaagtccactggggctatggacaccagtagatacaggttcttacacccaaaaaaatagtctcagtttcttctgcttcatttatgttgacattttttttcacccattccgtgtgttatttttcatagctcctgctcctcattgcctccagagtgaattttaattgctgctgtcacatccactgttgattgaggggactgaggttaccatagggctgacatcaggtaagagggagttattattaaaattgtaccctaacgtaatagcataatagttttattatttgtacaattaacagccatattgttactctattttatcttcacaatgacccaatgattgatttagggtataaactataatccatttatgtaaagagtagtgaactgggccaggcgcagtggctcatgtctgtaatcctagcactttgggaggctgagaagggcagatcacgaggtcaggagttcgaggccagcctggtcagcatggtgaaaccccgtctctactaaaaatacaaaaattagccaggcacggtggcacgcacctgtagtaccagcttcttgggaggctgaggcaggtaaatcgcttgaactcgggaggcagaggttgcagtgagctgagatcgtgccactgcactccagcctgggcgacagagcgagactccatcacaaatacatgaataaataaataaataaataaataaataaataaatagagtagtgaactggcaatcacacaggtaaagtgaactggcagtcagagaggttaagtgaataaatcagtatcactcagttagtgggatagcagaggcaatacagagatagctggcccattggtatttcctattcttgataaggtatgtaatatatgtatgcatgtcaacgcttttgtttcatctgagaaatatatttccctgctgcttaggaagtaatatattcaaaacatgaacattcttatattaacttgtttaaacccatgtgggacaacaggattgattttactgttcatttcttacaatactgcgcattcaattaaatactctctctactaaagcagcttaatgatttgaacatttcagtgtgatccgttctcagatcaacttcaaaagactgaatttaaacctatcttcaagctgtgaaggttttagttcctttcctttttttttttttttttaactttttaaaattcctctgctgggaacgaattaagtacagcctagcaaaggatagatccatatttgcatcctgctaatcaaacaagaacttgtaagaatgtagcagtgataaatgtaccaccgttgaaatcatttgtataagttggagcaaaatgaactgtgaccaacagattccttccacagccatcacccgtctacattgctccaatgtgcggaagtgtcttaatggatgtacattatcaagtttgcaggcttattttcagtcataaagaatagtgtaccagatgctcttggtacactgaatttgtcacaccgtagacaagctaatatcattatgtgagaccacaggggaaaaaataaaagattcacatttaatccatattaactaccaggagacccatcaaggcagttgggctggctcatgatacagcagcttctagcaaattagcagcccataacaacttagttataatgagctgcaagatcttacaccataagctcaactccattaaaccgagttcaagtacatgaattcatgtacaaagtataaccttaacatctgtctgtgcttagccaatattttgtttatgcctttttaggaacaaccaaattatctttgtgtcccctgaaactagggactgtaatttccatcaactgcagttttacctgatagagagggctggactgatcaccactggcctccccggctgcggcgtccagcagcaagctatgcatcatcccggcagctgttccctacatattgggccaattttttcccaaacaattttcccttgctgttcaagtgggaaaagcaatagtctcctcagaaattaaacagtcaacaaagcatgcatatctaataaatactgtagaccttgtatttacttaagcccaatgagttaaatcctatcctactctactcaacatggagaacatgttttaataaacttaggccatttttttttttctcaaaaagcaatgtcctccttcttttcccacagtggactgactactctttagggactcaggaaatactatcaccattattataactgttatttctgttttacagatggggaaatagagagatagactacccatggttaaccagttgctaagtgaggaaacagatattcagtatataatttaaggtattttccatggagttttatgtaaagaatgaatacatatttatgggaataatctaactttcttattattttctgtcttacataacaagtgtacattattcacttgggcagtgttttcaaaattcacatcttacctgcagaaaccttagcatgcagaaaaatgggtactgcatatattgttatgtcttttctagagttttacatatccaaatctgatctagttctaatcaatctagatgcaacgtcttaaagtctcgtagaattttatatgtggatgggatctagaaagtcatttagttcatcatccttctccttcaagcgtcagcctttccagcagtttctcaatgaaagttgacaacaaaagcagttcaaaccccaatgcataccattccatggaaggatagctctggtaatcaaattcatagtatggtttcttataaaaataaaatgattctatcttctgttctacttctggcttctaatttaccaaagcgtgagactgactttttcactgacacagtagactttgaaaaaccatttgaaaaatcttctcttctgtaattcaaacaggggtagtttagaggtttcatcattgtttttagaagccccctcctcctctgcccacacctttgcattgccctcttgttttccatggcctcttccacaactcaaaacacccaacagtttatatatgatttcacatatggcctaaaagtatcacttttcttacaactttgaaattaaacttccaataatataacttaaggttacagtagctttcttcccattatgaaatagctgctttataggaaacctgaattcaactataaattttttttttctgaacccctgtcaaaccagacttacctacgctacagactcttcagatgataactttgaacctgcagacaaggtgggacatgcatcccaaatttttatttttttatcttatatttttcagcgttttatgttcttcttggaacagaattctgtatcaaacatatgcatattttcttagccctgtgtaacctgcaaattctatagcttgctatgaagatattagtccaagtctttgattatagttttgaatagaaagtacagagctcaatgatttgccacagactctttttcaggttgatagtgatccattaaacagcgtatccaaagggatatataaacatatgtctactatatgtcatcaacatacacagatcagcaaacaccttggattgttttccagcccctagatggattgcactgtgatgtcaacgttatcttattggctccctatctgcagaatctctggtggtgatggactcctttgcaaaccaagagcaatcattcaaaattatataactgtcatctttggttgacccccaactccagtaataatcaagacaggacaaggataaatgtctaagcttcataaattacctatttctcatatctcaggtttcaaatttgattgttaacttccttacaatatgctcagcgatgcagcttagctagtaggggcagcagttgcctctgaagtggggcatgggaaggggaagggacggtttgaacttatgtttaaatgtactgttctctgctttagtttttattatatttttatatcacaaatgttagtacagtagtatttgtatcatgtataaataaatgagcataaaatggatgttcttactcagaagacttttactgaccaaggactgagattaacaaaggatggagaccagtggatgagacacccacacagaataggccacagaatgaagtgagagcccatttctgctcatctggtctgcattacagctacagtataccctaacttggcactgggaagcccctgtatgagagacaataaattcctactcatttggaagggatcatagaattgaagcttttaattttgcagttatggaaactgaagtggagagagattaactgactaaaatgagcagctttaaagcccatttgggacattccagggaaaagaaaatgaaatgaaataaagttcacatcagagtgggacctgattctattccattgttctttctcaaaatatattgccccagttaggaaataaacaaaccaaaaaccaaaacaaagaaagaaaagaaaaacaaggaaatggagaacgaccgtcactgaactacaccttttggcaccacataaatgctggcagatgttctggtgagagcatcaagcacagtgaagtaacagcagtgcattccctgtgccgaatattcaccttgtaacttaaattccgtcagcattcagctttcaaaaattgtgactatccaccttttctaaaataacaccaacacatcatcaaaaaataaaggtttacatatagaaatattcagtcctaatcttgctccagtaaaatattcttctacagatggaagaggaagacaccacacacttcatagacagcatcatatggagcctggaccacagtgataagaaggttgccactgttactctgagaaagttatattaaaaacacatgcatcttttcttagaatcatacaattagaatgcgtcggtgctagcacagaaaacagcctctgaccaccaatctcatattatttcctctacactacaatgaaggggcctatttcatacctggttaaatacactaagaattttggatctcatgaaaactcacgttttctcaaagtttctcaaagacatgaatgctatttttaagcaaggctgataaagtttttctggcttccttctaaaaatgaatgcaaacagtaagctcttacataaaattgacagggatagactcacttgccctccttaggatgggcgtagcctctatgcagccacaatgcaactgagtcaggaagctgcatttataacagttgccctgggaattctgacaccagtaattcacatggtatccaccatcatcctgagctccatgctgatcagtggctcaaaaagtttcttgtaagggaaaagtgcctggagcacctggatggaggtaaatcgtaaaacaaaacagaaggggcgtatgcagtgagagtggtctaagaacaggcagaaatctaggagggttttctaaaatctaagtgagatgcttaaattgagcaatgcccatggatagaagaaggctgaaggagggagggtcagcttcagttaagtacacgtggatacaaaatcctgtgttcatttaattctgtgatctcagaaataccatgtaatggaataattacttagcgtaaattttcacatcaatcatactgagataatgtctaacatgtagggcccttgtgaaagtttaatgcgatattatgggtaaataatcaagagcacactggatgtgcaaaataattttattgatttttatttcagaataataacaaaataaacagagaggtcaggtttataaatttttaaatgaagaaatgtaaatttcctatttaattctacacacccagagataaaataagttcctaaatggaatatgcatgacatctggtcaatatctatgcattctatttgccaaatacatgcccaaaagtaccagcatctacaaactaaagtcagggccagggcagcacctcagggttacgtctgattctacagacacagcctcacaattaactgaaagtctccctttttaattctttttcatctccacctctgtttttacggtttccaatttttggaagaagtactccacgataatgtgggtgcagttaatcccccacctcggcaagtaaatttaattacatttaacatttcaacactgaatatagtatctcttgaagagattccattaatgctgatgaaaattaccagaaattggttcagaagagcatgggggcttgaaatgaactgaggcagataaaattcatgaagaaggaacgtgtgactaatgcgaaagctatgcaataaataaccatcttcagagttgctctccttgtaggaacacgtatgcaaatgttactctatacatgcaaaacagtagtggaggcggaaaggatgcagaaaggctctaataatcgttttgccttgtactaaaacaattagacagttgaccaacacttaaaattagtttttgttctatatatacatatatatatattttttttggggggggggaggaggaagctagtactgtttaaagtcaccgactaactcaatattttttattcctagaggaagaaacgcccataatgttgaaaaatatttacacactggagaagatcacaatgtaattagccacaatgcagtgtttattaaattcctagagattacagagtttatttttaaaatcatatgtgctgagtttaattaaacatatcaaaggtagcatgaacttcatggtatagaagcacgtaatttgattcaaaaataacaaaaatgcacccacttttgctctgttttctaggtaagctagtattagatatggccaaataatatcaccatgcacatgattaacactgattggtaattcttaggaccctaaagatacgttttgtttttttgagcagaacttgatcagagctactgactgaatatgattctgtaaaaaatccaggccactgcatcatttttctcatgctaatagaggatagaaacataaagaaatacatgatttagtattttagaaattatatatacttcttcatgtgttctgtgttgaaaacatactttggagaaaatgcagataaatcacaaaaccctagggagagctgcggcattacaataatggccatgcttttcacagtggaaggaacaggcagagcatacagaagtcaaggcatttgtgacatttccatagctggagggtggtaacaggagaccaccctgtttaaggttgtttcactaagagtctgtctgatatcatataccatgccatagaagggaaatactcaggtcttactctgctccgatgcagagtaagaagggtgttggaacataagcaattgtgaatctgctgcctgtaactgaccacttctctcctacttaagagagaatacggggttgcaagtgataaccttcaatactcactactgtatctgtttcacttttttaatcgggggaaaaagaacactgtatatttgatgttagaaaaaaatgtattttttctaacacactatatttatttatatatataacacactatatttatatattttatctatgtatatctatctatctatctatctatctatctatctatctatatcagattctcatttgtttgttcagtaaatacaccaggcacagcctaagtgctagaaatgcatcaatgaaaaaaatcagacaaaaatccctgccttcatgaagtttacattctaatggagaaaacagacagtgaaccaaataaacagattacatagagctacctgtggtcaaggcaatttaaaaaagcaattcaggaaaataagacgatggggagacaacttaagtagaataattaagaacagcgtcattgacaaggtgacattacagaaaagatggggaagaatgaggaggtgaggcgtgtgtatacctgggctggggggtgaggagaaaggaggggctaggacggtgcttcatgcaaagtcaacagaaaatgcagaatccaagttctaggggcatgttctaggagaggtgaggagtttcctctgcaggagcaaaaagtgagaggaggaaacatcttgggaggcgtgggagggatgggtggctggtggcagagcacagaggcccttgttggccactgcagggacttctgctctgcatagagtagtaacatgataggatttacattttcataggattcctttgcctgctattcgaaaataatctttatattcatttattaaaggttattttgtgtgtcacttaatatttattcatctcagctacatggggaggacctaataaacacatataaatgcatcatataagctatctcactgttcatgctctccttggccacgacaccagcacagcaattactttactacatcccaggtactagttctcacatctggatcccaccagactttttagttcttgatccctagggaatgtctcttccatttttatatgtggcaattcaatatttagaacagaggaatgactcaaaaaacatttgttgaatacaagacatttcgaatgcaaaatataagacttctaaaatagccacaaaactcaactctaaatcagaattcacacgttaataagctacctgtagaaacacaaacataaatctttgttcccacaccattccaactggaacttttgatcagacttattagataggattttccaacttggccattatcatcacataagagttgaaccacatctggaagtgtgtggacaaataaatacatatatatttaacaatgaaaattcttttttcttaattgtgtggataaaatttgtgagtcaaatgggcaaatatatatttttaaacacttgaaactattttttgttaattgtgtggatacaatttatgagtaaaacaccccagaaaagattttgtaacatggcattagaaaattctcacaattttttttattatgtttgactctctgcttttgtttaaaatgccacctaaagggcctacttagtatgttttcagatatatccacataatataaatacctggattaaaaaaaagtaagtgttcaaatttaaaatatttatagtcggaaatataagggaatgggcaaacataatcataacatcaatgagttaacttaattgcgtttttaaactctttatttggatcacatacatatactgtgtcctatagtttgaagacttagtgtcacgtaaatctattagactgatttacaaaaaatgtgagcacccaaacactatattcctgatgtgagacttcatagtcatttacttttatagttcagcaaaattattaaattacagtcaatgtggaaaacacttccaaaggtcaaagttttcttaaatcactttctaaatccatagcattgagattgactttcacgccttaaaaataaaaagatttcctagctttaagacaataaacataaacttttacttttatttaataattagttgaaatgaaatacttagtaagagatgccctcagaataatatctttcttctgatattattctgatattctgatataataagggcctttcttcctcagtttctttaaaataaaaatatccatgggtaggcaattaacatattaaaacatgaaaatatgtttctgataaaattaaatcatttttaagtcaacatggtcattcttcacacttagtttataacttacaaagtcattcaaatttcatataatattaatcaaacataagttttatcttgtgtttgtcaaaattaaggtgaaaatcattttgtatcactattattattcatttgaaaatactttaagtttagagataaatacttaaggacttttttataaagactttataaatactaaagaatctctcaggcattccattttaccgcactcacaattctacaaggtacagccaacttaaatatataacaatctaaaatataattccacagattgtcattttattcaatcactggtttcaaaaaatcaatttgtttctttaatctgttgggtatcacaattttttttttttaactacagtggtggcacaggtgaaatctatgaagccattgtaaattttgggcaacaattttctcaatgagttatttgaataaaagcaatcttgaaacacttggtaaaggttttctataattaaggggtgtgtgcatcttatttacacctgcaccatttagagtgttcaaaacatgtaattattgtattctagttctagtataaacttatcactgagaaccaaataatctctgccaaaaagagaaagctatgcaacaagttagctgcccagtatattaaatttttggctacttcacatggtgactctggttgggtgattttttttcctttactctccatgaataatttctttctggatggggttattcctttaactgcgcatcgaaggaaaaaaaaaaaagacctacaatttccaaattaactcttacttaattctcacagaattgtatgtgattacttacatggataatcataactttcataaaatctaaagtatatatctatgacacaccaagtcttactaaaaacaataattaaatggttataatggttagttaatagggaaatgacccatgaattcttacaaccactttctgtttaatttggttatttggttttacaatttcaatgttcagatgctgaataaattgataactgtgaggtcagaaataaattcttaccatattttctatacagaactttaacctgcagttttaaaactttagttaaaattatcacaaaaacaacattcataatgaaagcattgaaaaaccaaacgcggttagttttcactttttgtcttttacctttactgtaccttttgaaataaatggtccttaaatacttgaaaactgtagtctaggcaaacaagacgactagtcccaaagatgaagggttactcttccctccttccccaggctgtggagcaggcggttcctggcatcctacccacctccctcctccctccctgcaccacggctaaaaggaaccacagagcagctcaaaaaccgagaagggagtgaagaacagcctcgaaaaagtcaggacgctgaattatcctatggtaatttctgctttcactcgcaaacagtttaaaagaaagcaaagcaagacatatcagagataccacaagcccagtggttgctgtcttaaaagagaaaagaatagagttcagccaggcacaaaggtctccatggcaacagtgaatttagacccccattggcattatttatgcaacatttcatcacaaaaggaccctcccactagcctgcctggcaaattctagttttctaatcttccgttcctttgctttgaatgtatctggattcttagctatctgtatgttaacattaaaacacacacacacacacacacacacacacacgacaacaacaacaacaaaaaaacacatcatgaaatgattatcaaactcaaaatagactttatttccttgatgaattcaaaagcaagaggcagattcaagattgtttagagttcatattcaaagccagtccggttttggtttcaaagatgaacagctgttcaacaaataagtttattcaaattatttggttttttgaaatagattacaattcaaagagaatacaaaatggcaaaatcctaccaacccaaaaggctcacaggaaagacagcttgctagatacggactttgaagctaaattttatataatgatatccatccccacccactcctagctattatagtacctcaaacaactcctttgagtcttttacctgattctttctattttagccacagcttccaaaaacataaattcggcaaagtattttaagcactttttattgacctttgtaccaaatggatcccaggtccacattttataattagacgacctgggacaagttatttaaaacagaggtaacgccccagtggaattaggttgctgtgagtattaacaagatgatatctgcagaagtactttcttcaattctaaaacaatatacaaatgtaaatggttaggataatatttgatggcactgaagggaaacactagtcttcatttgaaaagggctgtatttagtattagttcaaataggaactaaacaaggtgacttcttaaaaataagattttgtaaattttttttttttttttgagatggaatcttgctctgttccccaggctggagtgcagtgacgcgatctaagtgcactgcaagctccgcctcctgggttcacaccattctcctgcctcggcctcccgagtagcaggaactacaggcgcccgtcaccaggcccgggtaattttttgtatttttagtagagacggggtttcaccatgttagccaggagtcttgatctcctgacctcgtgatccgcctgccttggcctcccgaagtgctgggattacaggtgtgagccaccaggcctggccctgtaaattattttttaaaaacatacaagcttattattaaaaattcacagtacatactttgataaagtacagggtagtccttattccatacactcccagcatcaaatccattctcctttttgtaaggtcctctaagctggccgcaccatggtcaagccatcatgacatccccctgcccttgtgataatgtactttgtgatattcccccgtccttgtgaatgtactttgtacgatacatcctccccgcccttgtgaatgtaccctgcccttgtgacaatacaccctccctgcccttgtaaatgtactttgtaacaccctccccacccttgtgacaatacaccctcccagcccttgtgaatgtactttgtatgatacatcctccccgctcttgagaatgtactttgtaacatccactccctgcccgcaaaaaaactgctcctaactccaccacctatcccaaacctataaactaatgataatcccaccaccctttgctgacacctttctcagattcagcccactttcacccaagtgaataaacaggcttgttgctcacactaagcctgctcaggtggtctcttatagggacacatttaacactttttatacaattgcttgtctagacctagatgctttattcacctttacttaggtattgattgacactatgttgtctttaaaacaattttgcaagaaagttcatgggtgcctgtctttcctgttaatgcatgtttaagaggattttccattacctgcaaggcagacaaatgtccccattatgtaaccctcagaggcatttttcacctagaatggaatgtttgtggtacctccagaagcacaactcaccatcattctctgtgaaggtgtccctggtattatgccctacttagaaggttatacaactttgggatcacacttttcctcactcacaattctgaagaaatcattcagttacctctgacactgaaaactgcagaatagaattaaaaagccagattgatatatccctcttgtaagaaaattactttcccaggtgagaactattgtaaaaataacaacccatacattagctcctagttatctctcttctacatctattgcctttttttctctcttctgctttatttcttcataccagtcccgtttatttctgcactatttgtctgcttgatgcttctaacatggtttcatttcagcaatagctatttttttcttttttttgaataatctttgccagctcattgttactcctttcatgcctcctgtgtcctatgatttcttctttgatttcatttttgctcataattttaaacttactcaagttacaaaaaaattgttaactttcccttacatcacctgggggtaattttatttttctgtggttatactttctctgccttttgtgtatttgtgtttttgtgttcctttattctctttctgatttctttgtttcttactttttatggacaatgtcaacccactatctttaaacattccagtttattacttatttttgaattatggcaaccttttcttggcctgacttttgcttggtaacagattggggaggggagcaattctaagtatgaaaaaaagtgaaggcagctggtagctgaaaatgtagttcttatgctacccaccccccaacccctgacattattttctcctattgggacttgtccttcatagagcttcatctctcctgtgtcccctcatgtcttcagaactcagtgtttcagttgaggattctggctcaggaacctatctaccttccttccttccttctttcctgccttcctgccttcctgccttcctgcctgcctgccttcctgcctgcctgccttcctgcctgcctgccttcctgcctttcttccagtctgccttcctgcctgcctgccttcctgcctgcttgccttcctgccttcctgtcttccttccttcctttctgccttccttcctttctcccttcctcctgccttccttccttccttcctcttcttttttctaaaatgaaatatgcataatgtatgatatctgggaagatacgtgtaaactcacatatctccttcatgagtttgtgctgatttatttcctagtattattgtaaatggaattttattcgcaatcctcttgtatttttggttcattttagtgtttccaggaaagaagtacaataaaatcaacattgtgagataatcataacagtggtttaagggaaatcccaaagatgcaaaaatgtttactcttgacaaagttcaacagtattcttaagtaaaaaaaaaaaatctttgcagaccagaaatagtgggggaaagccctcaatttgatcaaaacaacaaccaaacatctacctaaaaattataatcaaaacctcagcatgcttttctgggggggtaaggggcctgacttaatggacagtggattctaaaatttatatcgaaatgcacagggctaagaagagcaagcagtcttaaaggaagagaataaatctggaagacagcctaccagataacatggtggactagaaaactgcagtcataaagattgtgtggtatccacataaggagagacaaaaagaacagtggagcagaagagaatccagacatgaagccacacatacacctgatttacaagaaacatgacactgcagtgcagagggaaagatagtgccttcacctgttgaaaaaaaatgcaacgtgaccccagttgcgaaaaaataaaaaaaatcaactccatctggagtgaagggctagatgtgaaagattaaatgaaaatgcttatatgcagcacatgcatgaccttggagtagccaaggctttcttaagcaggacacaaaatgagctaaccataacagaatataaaaaaagttataaattgggccatattaaaattgagaaattctgtttaccaaagaccccatcaggaaagtgaaagtacactaatgggagaagatattttcattctgtctttctctgtatatgtgttaagtctgaaatgcaatgtaatatgacattaataggcaacccaatagaaaaagggtaaaatacttaacaagcactgcacaaaagaaaacaaccacatgacccatgtggccaataaataaattggcaaacgattgatatagtttggctgtgccccacccaaatctcatcttgaattgtagctcccgtaattcccaggtgtcatgggagggacctggtgggaggtaactgaatcatgggggcaggtttttcccgtgctgttctcatgatagtgaataagtctcaggagatctgctggttttataaagggcagttcccctgcatatgctctctggccttctgccatgtaagacgtgtctttgttcctccttcactttccatcatgattgtgaggcctccccacccatgtggaattgtgagtccattacaccttttttccttttaaatcacccagtctccagtatttcttcataacagtatgaaaatggactaatacgacaatcaacttcactactcaccagggtacaaaattttaaccactatagggtgccactaagtactcattagaatgattaaaattcagagagacagataatgcccaaattggcaagtattgggtgttattggaactttcataaaactgtaagtgggaatataaaatgttaaaataaatgtgacagttgtgaatttcttctaaaattcttgataaacatactctgtttctcagcaattctactcgataatgccacaaactaaaaaatgtgcacataagcacaccagaagacatctcctataatgctgtcagtcccaactgaacactacagaaatgctcagtcactagaatgaatatagtatagtacacgtacacagtgaaatactattcagcaaagtaaataaatcatgtataaccaggcacactattatgactgagtctcacacacataacagtgagcaagctgcatttgctggaatatattaggctggtgcaaaagtaattgcagtttttgccattatagcaaaaaccaaaatttttctgtatgtatattctacttttgaaaaggttctaaattattttaaatcctagatttttgaaagctataacaggcatgcatgtatgaaaacaggaatattatttacttactaaatgttcttgattttaaaaaatcaatttcaaaggtttctagcaatattgttgccaatttcctttttaaagaaaatgaaggatttttactttttacaaaataaaagtagaactaaagtataaaggaatcactatttgctgtggtatcattaactttaaaataattgactatgctgtggccctttggacaaataatccaatcttttggacaaaaaacaaacaaatatacacacacaaacaaaacctacatgttcatgatgtccatgtcctggcaatttttatctacttatatggacagaggggtggaagaataagtagcattaacacagaaaagctttaacatgaaataggtgacttggtagtgatttacaaataagttaaagttaacatttaaaatgtttatgctaacaaaacttgatatttaggagagactttaaaagacatgactcctgaaattttggcttcttattttctgataatcagcatttcagtgtaaaactgtgtaattctatttattatccttccagacgctaaggtataaaattacacacaattgacagccaaattactgcgtctgccttccaagggacacggggaagctccaacacagattcttttgcaattaaatccttgcaaggagtaagatttttagggccagctcagcttttatctgtaatccagcagttatcgctgctgaaatggattgcaggaggtggtaaggaaaaaaatgggaaaacaggatgaggaaggaagtcaaacaaacaatgctggacttttgcctaggggccttgtagtgacaagtactcagatgcaactgaaaccccagtgctgcctgctgctgcactaaactcttgaaaccaagtgtcagacagactcaaaaatagaaccattggtactaagagactagatgtatatgttatcacacactagctaatatccctgaatccagtgtaaattcgaagtctgtactagcagtgtagggtatattaaatctattaataatatatattctggcagggtataaacctcttatttgagacctcacaagcctttcttcaatctgtgcctcaaactaaagctcatgcaatgacagatgaagaagacaaaatcatttcagaagtagctctctaccctggcatgaaattaatttcactgtattcaaagcagggtttctcaaatggaatgtatagttgaccatctcggtaatagttcagctttaaacccattggcatacctgatgttgtaaattatcaatccatgaaattcacatgcttttacatttttgggattaaaaagcttgaagacagcaatttccatccagttatcaaatacacaacgacaacgattgccagaaaattaacttagaacacactttttaaaacacattaattaattagaggtaaagaaacacatctgctatatggaatcagcaccactgcctcctaaaatgccacaatgcaccagttttactataaatatatattctttccaaataatatcaataataacaaaggcaggatctcatttttaaagtaatctctttctccaagacacatacagacatgcacacacgcaagcgcaactttgcagaatgcaaaattttcaattaacaaattgggagtctctttatggcagaactgggagtattttttgtttattaccagatggaaagcatctatcatattttatccttttctagacctcaggcataaatttaaggcactgtcttctaagaaataactcgacttgtttgactactaagaatactgcatcctaatcacccagcattaagagtggcatttgtttcaattttttgcataattagctcatgtctttacttgatatcctttaacatttatgtaaagtggtgatcatgaataatactctgtcaagacagagtgggccctgtttctttggctgggcttaggtattatgtcattgcccttggctgaggcacctaaggaataccaataagaaaaaggcacatgactaagcattttaagttcttcccacaatgtgcttggctaaggcactagccaaagagactactttaaaaatatttatttgcaaagagaaataaaacaaatgagtaatttcttgaagatatatcacatttcaatacatcaaagcgtaactatatacatgtttttgtataaccattccctgtaggatatatttgcctttggtattataaaaatcctttacatttaggctggaacattttgtcctttaaatagttaacttcctacagccttgggaagttcagatgcgtagagggtagtggttaaaggtgctgccttggaggtgagggttacaggtggacaaacaggctgaacatgactggcattcccctatgtctaggactctagtgttctctttgtgctttttgtttgcttatcggcatttttttaactgatagcagtatttaaatatttggcaatcaatctttcatgaattctagtatatttgttccatttcttcttgactgcctgagaacaagctctcatttgttctttgtactatggtgaggtttggtttgtgtggagcaggacaggcagcgaacccaaacaagtccagcggaatctctgacgataaaaggatgctgctcacagatatggcagcactgtatattaaaccgatgtgaatcacaacaggctccgtgacttatcatttgtagaaacagcacattgttcttctagaattttgaagacttttctgtaagacttgttgaatatacctctatttccgaacagtgcctatacattggtatcttaaaaatggggcccttccgtgtatgttacagcttaagttcgttctagaactgatattgcattatttgaaatcaatgtttaggtgtccacaggctttgcttacagctttgtaaaggtcttaaatactgagtttgctccctttattacccagtcaatctggaatgagatgattccttggtatttcaaagctgctgacatatctgatggactggatgaaaatttaaggctcatttagctctacagatttatgttatgttctctatttcttgctctaagcttacaatttgccttagccaataatgtgcttttcttaattcatcaatgagcagtccgaattagggaatattcttttttttttttgaaacagagtgtcagtcacccaggcttgtgtgcagtggtgtgatcactgcttactgcagccttaacctctcagactcaggtgatcctcccactgtagccttccaagtagatgggactacaggtgtggtccaccatgcccagctaatttttgtattatttgtagaaaaggatttagccatgttgcccaagctgatctcaaacacctgggctcaagtgattcgtctgctccgtactgagactatgggcatgagccacgaagcctggcttggaatagtctttgaaaatataataataacaatgaagataagtagagctggtattttattgagaagtcaactcaccactggataatgaggacaactcatttcctatatcactgaaattacccttttccatattctcatgtgataaaaatagctgtatttttgttgttgttgtatccaaaaagcagtttagccttaaagtaaaatgttatcattgtttctgtgtacatccaatgaggcaagttattattatctcattttataaatgaggaaacagattcagagaggttaaataatttgtccaaaatcatgtttgtgttcttaaccactagacagacctatctataatcatttatagttttaagtttgtcttctaggagccatggctaacaaccaccacatcatgttcttattgggtttgtataataatgataaatcagattctccatccctctacaccacaaccaagggggatacgtgctgatgaggagaaattccagcttcctcagaatcaggtaagtttctaggtgtgccaggactccaggggggtctcctacccagtaatcccactaagcgattctttaccaccatggttttgtcaaccattctaaaggtaatcaaggttgatattgtatacacattttaaaatcctttatctgattacatttaaatggtatagtgttgtgcctccttaaataagaggaaacacctatcacctttcttttcattaagcctcctatgagagggtttacaagttgagggaaaggaggaagtgtctatttcttatagtcttaatatacgaattgaagatgaagagctgggaaaatatatcttctccatgaaaactgatgaaaaatatgagacttaaccaaaagatttcacaaacaactgtaagtataaaactttaatatttattatagtgaaactcattaacagctgggtcagaaaacatgaaaaggaagtaagcatcttgtattagtgcattctcacgctgctatcaagaactacctgagactgggtaatctattaaaaaaaagatgattaatggactcacagatatgcatggctggggagcctcaggaaactcacaattacgtcagaaggcgaaggggaagcaaggcatgccttacatggcagcaggagaaagagagtgagcaagcagggaactgccacacacttttaaaccatcagatctcatcagatgtcaagagaactctatcacaagacagcaccagggagatggtgctaaggcatttgaaaccacccccatgatccagtcatctcctactaagccccaccttcaacacttggaaattacaattccacatgagatatgagtggggacacagatccaaatcataacacatctagagcaacatcaaaaatgtatgggacaatctacttaggcagttcatgataacatagcaatatttcctggaaaactaaaaaaaattaataataagggttaaaggaggaaagttaactattctagtaaacttcatcttgaacaggtatttcatttctaatagatgtttttggaagcttgtgtcttctagaacttttctgtagttataaatacatttacacatatttaatgaccatttttggagttttgaaaaagtaactccttttgtgtatgaaattttgaagttgcccgcaatagttcttgccatatatagcatttcttctcaaacatgacatccatgactggcaaaggatttgggtttttttgcttgtttgtttgcttttgctagttcttaaaatcccaaacaagtagaacttgtacttattcatgaggtccacgtagatcaaaggttagatttatacccgtgagtacaattcagtgaaaagtcaggaaaatagaaaagtgattgcgaaaatggagtttagactttcccttggggttctcagaccaggaagcttgctattctggtgatgagaaatggcacactgatttggctatctaatttcttgagagtcttattgcatgcccaggaaccataaaagtggaagtttcttctgctcttctgtcggcattctatggccatagagttaatacttgggttacactcaggaatccgagttaagaagtgcctccaaaatgcatcaaggtacctacttttagcaagtcccaaatattgagaccacaaatggtctttatccaattctaaagcaaaactataaatatggatctgaatttaaattgtctatgattaaaatatgtgacttaaatttccattcctccatctaccatctagagttttcctcagctgacactgtcagtgttggaggcaatcactgaagtatttacctgcttacagaattacatacctatgctaatacagcaagtgtgtggacacactgttttgtcaagtatgggaaaaacatttgctgacacctaaattctaagcagtatgtgaagtacactaaaactaaaaaaacaaaacaacaaaaaaaattttgtattatatgtatcaactattttccacagatatattaagtatattgtgtgttataggtgaacaattgtaccaacatgtgtgcaaattttttatatgaagattaggccaggcatagtggctcacgcctgtaatcccagcactttgggagcctgaggcaggtggaccacttgaagtcaggagttcgagaccagtttgaccaacatagtgaaaccccatctctactaaaaatagaaaaatcagcccagtgtggtggtgcatgcctgtaatcccagctacttgggaggctgagacaagagaattgcttgaacctgggaggcagaggttccaataagccaagatcacaccaatgcactccagcctgggcaacagagcaagattctgtctcaaaaaaaaaaaaaaaaaaaaaatgaagactagcccaggaaattgtatttcaaaattattgggcagaacactcccagacaacgatgttagtaaattagcttagtagtaataaatagcacagaaatcagaaggtaatgagagcattggtggtaaaaatgtggtgggaagaaggtaccagtagacattgtgaagtcatccatgagtgcttgcctcccagtgagaaggcaagctcacaggtaaagagctaaactaaatgaaatgaatccaaagaattctaaatctgacaaatattctaatttgacttgcataaaacagcaaggttttttttttatacatgatactctattttagtaacactatatatatagatgtagaaatatcttagaatgccatatctctgaatgtataactaaggactatgcgaataacgtgtttgtatccatagatgtataaacgagaacatgcatatgcatatttcacataaacataatgttgagcagcaaaatatttgagaacaacaggaaagctggtatcacattgtttctgtttcccatagcattattttcactttttttctctttatgacctaattggaatgatcagattccattcttctccattttgcatagactctttcttgcaattctatggaaaatgatgtattgctctgtaagaattttatttttttgtgaaaaaaatgaaaggaaggcacatcatattaagtgataaataattggaacagatttaattccagttattaaaaataaaatttagatctctaaattttaatgtggtctatttgaaaacccttaatcattttaaatttattcaaattattttattagatgtaattgttaatatttaattgttcacttctcacaactcattaagattttaataacatatttttctaaatgagaatatgtcataataatacataaatatatctgctgccttatagtttataaaatggatttacataaattatcacttttgatcttcttaataatcttttaagtagctattaaaatctaaaaccaaagagagattatgaatttaataacagaaagctaatttagatcaaaattcttatttgggaagttaaattaccaagctaattactgaaaatactcaggcacacattcaaatatgcttcggtacttaggtactgctcattaaagaaagcacctagatagtagtactatgtctcagaacattcaccagaacctgttcaactcaaatctgcccccgccaaacactctagaagatttcgccaggtggggaaaagtgccctcctccctactaccctgtgtttccaaggctcaggcaggcattcctccaagagggtgttaattaagttcccttaataataaagggatgtaaagcactatgggatacaatttctccccttaagaaagttaataatataatttccttaaaaatatattttattattataaaatactccatcataatttaatttttaacattgtaagtggctcataacaatgcagtagcatcatcgcttcaatatcaatataatcataattaggaaattacagatagaaatctattagagttttacaccgctggtaccaagaactcaatgatttttgtcatctgggaagatctgagaatccaaagaacacaaatgaatatttcttttcaggcaagttccccatggacatgtgtcagtatgcataataaacacgatgacattagatagtgctattcaaacaccctcttggcagttgaagcaagaaacaagggcactgccctttggccacagagaccagagcgtctcttccagtagtctgtccagatgggagagtgacacactgaaccactgggggcactaatggaataaccttacaatattcatgttcgaaaaagacagaaaccaagagacagctttgctttctctctctctctagatatatgtaaaatatatatattatatataatatatattatagaaaattatatatagtatatatttcatatattatattatatattttatatgtaatataaatattatatataatagatatattattaatagatataaattaatagatataaatataatatatattaatatatatttatatattatttaaatcatctgtctggaatactactttccatttttcaagctaatattgaagtatgatgatagaatgaagcaaactttgtcctataattctcctgtgcctaaaattgatgagggaaaaaatccagcacattacaacataatacgtaataatgatttacttaaatattttgataagtataacagaaacaaataggttggtaatttaaaagtaaaaatgcttctcagattattctctaacctattagaaagaggcatttaggagagggtacttcacaatgggcatcttaacagtaacaatcacaacaaactgttgaccctttatgcctctgcttccaaaatgcaacccatactcatcattgggatagaagtataaatgccattgcttcgtaaatctactgaacagattccatgtatacttagtatattaaaatgttgcccacctacttttgcagtatgaacatcaacagttctggtttccaaaatagatcccacaatgaaccatcccatgaaacaaacacaattagtttatccacattataattttaatgtcacagttgcagtggctctcaattttcaactttgctgcccattgctggtgtcaccgtcaggacctcacgtgctgcaccaggactctcaaaacatcttgcctgtctgtaagtatccaagattaccctgccacattcctgctttgacagtgaaatagactagaggcctcaaaggaattcagagtaaatggctaattatagagtttgctacattcagccttattatcatattattttaatgtaaaatgcaaaactcaggatgattattttccctaaaaataaaaggcaaggctatatgacagagcttgagataatgataataaacagttcagagaagtctattatacagtccaacaaattactagaagaatctcatttttattatcattctacaaatagttattaaatacctattttgttccaggaactcttctgaagggcaacgacagatgtggtcccaccctcacacagcttaccatccagttttattttggaaacactccatatttgatatctgcttctctttcttccaaaagctcaattttatctcttttaaacaaatcagcatatttattcctagagttacttgcatatagcaaacatttaatcattgccttacagattgaattggtattttcctttttaattaataagcgtataatattaaggcataactgaaacttcaatattattggctacttcagtgtcacagagggtaaaaataagaacacagaaatttactatttcatgttttgtgaatattcatattcacaggcttcttctccttttagtgttgaagtttcagtttctggaatgtggtttatggggagtgagactttggaataaaaacagtgtttcatttatgcagcaatgagctgaggcaacctgtgacccatgtcttcacagccatacagttggcatgaaaaatttacaaactctctacttgctgccgtgagttggacagtgtccatgatctagacatagtacaaaattctttacatataccatcaaaaacattcaccgtggaaaggaaagcactattgatctctttcaaagatgagggagattcaagaatgggagtgactcatgtcaagccccgaagctgatgtcttgtggagcatgggtctgcgcacagctccgcctccaaagccttgagcttcctcccacaacatgtgaaccccaagctttgcaagtccccttgcctttgtgtatacagtccatattcttctgccatctacctgtgtcctctggcttttcacatcttagttcttcctctcgctcctagaaagtctaattctcaccttccccagatgattctaaggctctgatattacctggactcaattaatcacccatgtcccaagatctcaaaaaatattctgttaaaacatttgctttggtattttcagaagcatttataataccaagtacatcagtggaggaatgagggagatattcatgggcatttgtgtcagcttttggttttagagatggaagacctacttgtgcatttgaccagttacatttgtgcaatttatttatctgtgctttaagaatgttgagaataattacaagtttggtatgttgcagaaaggtatttggagcaaggaacaacagctctgagttttagttatagcaccaggattccttggagaggttgctgaactcatcttaaataaagttcctttatttatgaaatgggaaaaactcttgtaccgtacagttcaagagaagattataggaatacaatgagatgaaactacaagttctttggggtcaagggctcagtgagatgcacattcattctcctaacagtgccaagagggactctgagaagaggcacagcagtgcccacacaacagacatgcttactaaatgaacatacacatatgaaagcaacttaaattatacacaatgaccacgtttatgtcaatgtgctgaacatctgagctgtagcaaacagacaagggtcttacattctaatgaagcatcacagacaaatttatcatacacactaaatgaagaagatggtttctcaaggtggtaagtcctataaagaaagtcaaacagtctggtaaaaagatagagcctttgcaagaataaaaagccccttatagaccatattaaggtttggattttattctaagtactaaagaaagccattagaggtatctaagtgacatgatcttgcaggtgctgtttttaaaaaagatccacttaatgtattatgctatatttaatgtgaccctatctagaataataggagtcataaagaaatagccttgtttggatctgaaatgccatggttcataaagatcacataagggaacagtgaggagtcttttgtaactatgcaggaacggtggtcactggaaatctggtggtagtgatggagggagagaagaaaagtgtgctaaaatacagctaagaggacatggcagttgtgagaggaagaattctaaagatgtcccccgcccaagtccctggtcctgtaattactcagtcaaacattcactgaggttctactgtgaaggactaaagatagacttaaggttacaagtcagttgacctaaaatagggaggctaacctggattatccaggttaacccaatctaatcacatgagctggtaaaagcagagaattctccagctgtacccagtactgtatgtcagaagaggcaagagacgagacagaataggaggtaagagagatgcaaagccaaagatggaggaatgaagccacgagccaaggaatacaagtggactccggaagtcaagaatgattcttagccaccagccagtaaggaaatggagacttcaacacaaggatggcatggaactgaatttggccaagaacctagatgcagatacttccctagaacctccagaaagaaatgcaggcctgaagacaatctgatttcagcccagtgaaacctacatcggacttctgaggcagtgagatacataaactggtgttgtcttaagccactaagtttgtaccaattcactttggcagaagcaatacaaaactaacacagcagtggaaagtatcagaaggcagtaagggaaagagacacattgggatggctcggctctttggacagagtttgagggaatggagggatcatttactgagatagaaaaacatgctggaagaacatttggggagaaaaatggaaaacaaacactttgttttgaacacgtgaagcttgagatatcttatcattcatccagctggaggtgacaggaaggcaggtaccaacacaagtttgcaactgaatgaagaggtgagggctggaggcatcagtcagctttataagtgtgtcataaacatatcaatgatgtttttaaatatgggactatatatgtgttcccaggatacctatatggacagataaacagagaatgtcttcaggatttgttcatcaacaatgtctaaggaaaatcaggaacattaagaagcacaggagattacaccttgttatgggtggaattgtattccctccagaacatatgttagcatcccaatccccagaacacatgaatgtgattatatttgaaaataaggtctttatagacgtaatcaagttaaaataatatcaataggataggccctaatccaatatgaccagcatccttgtaaaaaggagaaatttagagacaggcacacaggaagaatgttatatgaagatgaagtcagaggtcaggaacctgcttctgtaagccagggaacaccaaagacttccagcaaaccagcaggagctaggggagtgaccggggacagattctcccttgcagccctcagaacaaactgatctgatggcaccttgatcttggacttctggccttgagaactgtgaaacaatcatcttctgttgttgaagccacttggtttctggtagcttttaatagcagccctaacaaactaattcacgcacataatactgtgaagtcgatacctaagacaggcgtacagatatattttgagtggtatggtctctgtatctgacatatataatattatctccatctttaaaattaaaaaagatgaaaatatggcaagaaaaaaataattttattaaaatgattacaacagtaatcatatagttttgattactgagttttaagaaacagcaaacatttatttctcaagcacaaattactcagaagttagtttctttcattagatgatcttaagatctatggcaattcaattgacacaaatgattgttatttgaatattaatcctccattcaaaattatggaagggaagttgctcaatagtcttagttatgaatccacttctgcaagatattccttgcatttattcaaatattatattacttaacttagacctgttaataatgtcaaactgtcaacatccccaatgaaagaaactcaaaacttgggctgaaagtctgtgaacacggcaggtatcaaaccacatccaactttaaaaggaccacaccttctgctatgagcagaaattgatacctaattaggccccatgcaaggaatgtgtttcacgttgacactgtgcattagaagaaattctcaagttcattatcaaccataaaaaacccaggggaaaatcctcttataaaatacaacatctctgaattttatcaacagttcccaacaaatctagaaatagatgctgctgtcttaagatattatgctgtgatgattaatactgtcaattttgaccctcaagagaaccctgatgaacacacataccagatgcaatgtgaacctacccacagcagtggaagctatgaagagtcctgttagattctgaaacactatgattcatagaaacccagaaaacacatagttgaaagtagaaaattaatgcagtgttttctcagcctggcctaaggctttaaacatcatctatatgctgatgatttccaaggctttcatctccaactctgccctccccactgagcactagattaatctaggcaattgcctacttcccatctccactgggtatttacttactagacttctctaagttcacacacccagaataaaatctggcatttctcccattattcccattccaccactctccacctttcctctctcccaggtggccttatctttgtaaatggtaccaccagcaacccagttgtagggaacatacagaaaagattctagaacagcctctttccccctaccccacacaaatacatcagcaagtttctgttggttctgcctacaaaatatatgctgagctcctccacttcacataatctctactgctgccaactagcccatcatctctattctaaatttctgcaacagcaccttacttggtttctctgcttcccatcttgcaccccctgacacccacccaccacctccagagtcttattttccacagagcaagcagagttttccaactgtttaatcacatcattttactcttttgcctaaaatgttcaaatgccttcccatgaaatcatcatcagcagcagcagcaccatcatcattccaagggtatctgaggcttctggatttgataggactctgcctacctctctgatttaatttactttcatccttcccactttttactaagccccagccatatggcattttttcttcctcagatccatgaagcaattcctgcagcctggaccacgttttcgtcacatggcttcctctactagtcctgtgaatctgagcacaggtgtcgctcatcagagacaccttcccctcagccagcactgcccaagtctctctggttcactcatagtttttttctccgtgtattttgtttccttcatccattcatccctatctgaaactgtacatattacttgcatattttttcattttttgttgcttatgttgtttctgcctacataattatcacatgtctcccagtaagtcatgtggtttaagaactatgccttcctatctactgtccactaaatctgagagtgttttatttattttttctttttgatgaattatgaatagttgatcgaaagtttcagcttttggtttctagtgaacacagaaaatgtgccctctttaaacgtatgaaatttctttccaaatcagtgactctcaatggaccctctgtcactgcaatggtcagtcttacctgacagagaattattaatcactcaatgacactctcatggagagaatgatatttcttgaacttttgggaggacaatagtctattttataatactattatattaaataatagtattggacaatgaacataattccaatacttattttttggcccagtatagactgataaggcccaacactgacaagtgaaacaacacaaaggaatgccttgtccatgtgtctgagtgtgctccagccctgggaggatgtgtcttggcaaagcctggctgggacccaggtgggtttgaagccacctgccccaggggaggcttgaacctgggagccttctgcatctgcagctgtgggatcttgacctcatgaccaagtgacaatgaacttcttccacttagtcaggctctactaaccttttaccattatagtttgtccctaacagaatcacactgagaatcttttaacttacacaatgacctcctttaaacatgaggagaaatttagtcttgatttatttgacagcaattcggtttgagtcctagtatttgttatgttgatttatgacaacaatataagtgccgatgacaaagagttttatgacttgttccagacacaaagttccactttagctccccatacactgagttctctctacatgcacagatcaaagccgcttggctgttccctgggaatggagcccagtaagacctggccagcccaattatagcagtgaccttcataaatggatcctaagcaaaaacccagtgccttctcttggccggtatcaatgtcatcaaggaaataacattgaaaagcttcatctcgcctcatacactgtagcttgaaatacccaacatttcaaactctttagctgaaaagatgtcaaataatttatttgtgagaatagccgattttcacaaccctgtaaggcatgcaattcacaaaaggcagcaataatatccccgtttcagtggtgagaaattgaggcctagagaagtgatgtgactggcatggatctataaattactatgttttaatgccagaaggctgcctcaattttcaccctcagcccagggaacccaccgtccaataagacactctcctccacctgcctatctttgggttctagttggtagtttacaagttttaagtaatagaatgttatttcaatgaatgttgcctgaacggatcatagcaaaaatataatgaccccaaaatatccagagagttctatttatctctaagcagtgtgatcaattcatatttcagctatcaatgacatattagaggtttgtctacactgttgtcttgatggatgaattgtagctgcatatttgctcaggtagaaaacaatattttttacaagtgatcaaaggaagctcttgttcacttgaatgagaagatattatactttactgaggtcaaaaagcttagaaatagatggtaatctggagtcaagatttaggataaaatctaaagtctaagtcagtagatgatatggtttggctgtgtccccacccaaatctcatcttgaattgtagttcccatattctccatgtgtcatgggagggacctggtgggaggtaatttaatcatgcggacagttacccctcatgctattctcatgatagtgagtgagttctcatgagatctgatggttttataaggggctcttccccctttagctgggcacttctccttgctgacaccatgtgaagaatgatgtgtttgcttccccttctgccatgactgtaagtttccggaggcctcgtagccaagctgaagtgtgagtcaattaacctctttcctttataaattacccagtcttgggcatgtctttattagcaatatgagaacagactaatactgtagaaatattctaacagcaaaacctgtcaagtctgcagccttcaaagcttgctttaagcaagatttaagactatcatggtttgttgtcacttaatcacgaagtctacatatcttccctttatcaggatgcaatgacaaaggtttatcttgggccaggtgcagtggctcatgcctgtaatcctagcgctttaggaggcagaggcaggtggattacatgaggttaggagttcgagaccagcctggaaaacatggtgaaaccccgactctaatacaaatacaaaaattagccaggcatggtggcatgtgcttataatctcagcttcttgggaggctgaggcaggagaatcgctggaacccgggaggccgaggctgcagtgagccgagatcgcgccaatgcactccagcctggacaacagagtgcagactggactccatctcaaaaaaataaaagttttttcttgaactcaaaacagattagataagcacactatctagatatttccttctcttctgcatctctcactacaatgtattatcaacttttgtctctctgacaaccagctccctccagactctgagctctttgagggcaatgattctatttcatttctagttgtgttcctaatacaaataagtgatcaagaaatatttgacattaaaagcaaaacatatcatattcatttctatttacagaaatcctaatatcaggggttcaccaagcctacgtaatggaaagtcacaaaagttcgagaatatagcaccttaaaactaacaatgtatatatatgatcaggctgatagataggaaatcccaaataccagaaagtagacactcctttctgtcatttaaatgttgttgacttggggaattaagagatgtgactttacaaaaggaacatttgaagtgaaaagttttgcttaattataattcctatcagtaagtcattactcatgccttctgacttgggaattttgtctttaaagaaaccaaagtgttgcagaagtaagagttaattatttttaaagactagtactaagtagttcaatatccctgaattatatttaaattactaatggcctaaataagcagatttatgctaagatacatgggatcttagctatgtaccttcttcgttcttcatggtatacacattaagtaaatttgattgtgaagtgaaaactattcactgaaaacatagctgaaagcaacagcattaaaaaggtatattgcttactaatactacgatgcttactatttctaaaatcaaaaataggttgggtacagtggctcatgcctataattccagcattttgaagggccaaggtgggaggattgcttgagcccaggagtttgagaccggcctgggcaacatactgagatccccacctctacaaaaaataaaaaattagtcaagtgtgggagtgcatgctcgtagtcccatcaacttgggaggttaaggcgggaggatcacttgagccctagaggttgaggctgcaatgagctatgatagttccactgcactccagcctaggtgaaaaagggagaccctgcctcaatataaataaataaataaaataaaatataaaaacacagactttcatcattctccaggagtaattaacaatagcttaaattaatttccataattaatagagtcgcagaatttgtctccttgatagtggtatttatttcttgagtgcatactcttgtgctttggttgaataatgctgccaatgagatacatgggcaatacaaaacagcttctttgtgacattttctaagaagtttttgccaatgtcaagacttcttaatcaaaatccattttgctttggggtttttattttaatgtcaagatggtattcatatggcaattattctgttgcaagtagcttggataagtaatgaaattgtggcttacctggcttcttctccataattttgtagataaacgtgtgtgtatatgtgtatgacacttattgaagcttaaattaaaataatctttttaaagtgcttcttattaaaaccactgatgacatttatgagagatgtaagcaaaccctgatgcttccttcaaaatgataagagaaaaatgtcacaagaaccatcattttatggtattcagaattcatgaaaaaccaccactagaagctaaggaactagccaaagctgctgtccaatcaggcattcaaagacattaatggacgcctctgaattgaatttgtatgtattaacctatgttttcttcttccagcaatatattgcttcagggctgaattaaacgctggtgtggactcatttcctggagataaccaatgtaactagcccatggaattagagcctgttgcctgctaaagtctcagctcttgggtcatctctttcttaccagctctcttactgtcctcaagctgggtaaagctaggattagaattaggccttaatctgtgtttccatgatggttagtacatgtctgtagcttaatatcaccctaccagggactgacaacttttgctcccctgtctctacatctgactcccgaacaaaaccccatgtccccttcattcaatgcatcaattgctttaagtcctttaagtcttgtttattttttcatctataatgacatgacagaactgtatttaaaatatacatgcatttatgtagtgaagagtaaaatgtctgccaattgaaaaagtttgaatactttcaataaaaaattttgaaaattcttccttgacaatggacatttttcctatacttctttttttaaaatagtgtgattattttgaaggtaacttgcttcttactaagagtacaattatgcttctggtttatctgcatgccctttacattttcagttaacttatactgatcaccttttatgtagagactatgtttagcaggttaaataaaatatctttaatttacaaagttacataatgatgttcagacaggttaaaaaatgtgcctgaggtctgacttgtggtaagtctgaagaaacaagatttctgcctccccttttcccacctgatgtattatttctgcttcattctaccaagattaaaaactccaagtgatgcaaaaaaatgtgaatctacagaatcacttccactgctgatgggaaaacaattagacaaccattttggaaaataatttggcattagcgtattaagatgaattttaactcttgggcgtttaacaaagagaaactcctgaaaaatgtaaaggcagagacatgtacaaggctgttcatggcagaaatgtttgtaacagcagaaactcagaagcagtccaaatgctcattgaggaaagaatggatgaattgtgggtatagtcacatgacggaatattctagggcagtgatgaactacagtggagcacagcatacaggcatatcaaactgtgtttcatcactgagtggggtggcataacatacacttgagagtccagacaggggagccagacctgctgtagcaccaatatcagtgtggccctggacaattctggaacctctttcatcctcatttccacatctctggagtggggacaatagtacctacctgataaggtccttgtgagaactaaatgaatatacatatagcaattaaaatgggcaatgatgcaaaatatgtgttttgtctcaccatttaaacatcatttagtagaatctagtagaatttgagtagatattcaaactacttatgtttcatattcattaagcaatgtagaagagatcatttctatatcttacagtagaactatatttgctgtatttaacatacgaaaaattttgacacatttattaggttggtgcaaaggtaattgcaaaagtaactacttacttcctgagacatctcttctttcctatttaattgcaaaagaaatcaccattacctttaatggcaaaaaccgcaattacttttgcaatggcctaataactgaaaccatgaaaaacagtggttataactttgaaggacaatattcataattatttgtatacagtcccttaaagaaacacgtatacacttaatataaagtattttcccctattaattgaatttatacttaaaaaattatgttcttaaaaataatgtaaggccattcatcaaataagcattttagcatgactatacatttttaagtactgaaattagaaatgatggagatagataatcttagaaacacaaataaaaaaatccaaattgaagtagtagatctttgaaatcatctactcaaaacccttgatttttcaaatgaggaaaactgagaaccagagaagttaacaaataatcaaaaaatcacatgagttggaggacaggacaatacgtagaaactctatattctggctgttagttctctctccagtgtgtcacataagtgtattttaaataaatgtaccccatgacacaagagctatgcatgtgataagaccataggcatttattctatggcctgggactatgtagtggaccatcagaagtcccaagatcatcaaggatggccaagtggctactgaaaaatcacatgcatgacaatggtattctcttttacacaaatattcctgtgtggtggaccatcagaagtctcaaggtcattttagcaccatgagatggtcctctatctccatgatggccaagtggttactaaaaatcatacacataacaatgatttttcttccttagacaaatgcttctatttctgacttctctctcttggtttatgacattacatttttcctgttacccaagtttgaaacggtgatattggctttaagctctcatgctcctttgccaactacatttgcctacttactcgctgagacagcttttctttccaatttaatctccttctctcctctgggccattttctcgctacaaaaatgatcactttttacagttttcttcaactcttttttgtcaaggcatgatctactatgactttgtcaagcacctaaaaatatttccttttatttttctcatgcatttacattttagtccactgcaaaagagtttctatcattcccactctacagaaatgccttgtcacacatgaccaatagtttcctatttactttcacatctgcagtatctgatggttaactacacatccttcttaatgtggttcacatactttggccttggtgttaataatattctaatttctacctgtttttccttccttccttgcttccttccttccttgcttcctttctccctccctccctccttcccttccctttccttccccttccttccttccttcctccttccttccttcttttttttttgatgtagtctcattctgtcatccaggctggagtgagtggcgtgatcttggctcactgcaccctccacctcccaggttcaagcaattcttctgcctcagcctcctgagtagctgggattacaggcatgtgctaccacgcccggctaagttttgtatttttagcagagacagcgtttcgccatgtcagccagtcttgtctcaaattcctggcctcaagtgacccacatatctctgcctcccaaagtgttgggattacagccgtgagccactgcgcccagccctgtttgctgtttctttttgccaatctctttgttcagttttgtttccctcaaaatgcagcctttctcctaggtattgcctgtaaggatttattcctttgcatacattttcttccattatttggtctgttcttaaagcatcatccatcatatctactcgtatcagacctgtggctatgcatgtgccaaggtttccagaaaattccaggaatacatttctaattgtccattacctccgaggatggccaagtggttactaaaaaccatacacataatagtgtttttctcccttacacaaatgctcctatttctgaattctctatcttgggttacgacactgatgttggctttgagtcattgacctctactgacatcatcttcataacttctcacccctggaaggaaattccttggacattcctcagtagctggatctctgataccccatttcattctcacctcatctaacactatttgatatcacttgatgtcatagtttctagatctggtttatgttttgccttctatgttgccatattttagctcatccatcattcattcatcatatattaactatgtatactataacaggtacacacattagaagtttttcttcacctggttacttaacaaacatttactgagcagctattattctaagctcattgttaggtcagaagcacattcatacaaaaatgaatattaaatggctcttgatcttagttctgtgtcatattggtatatagaggaatatgagccagtttgcaaaatgtcttcaagggaacaatatttccacaagtgttacagagaaataaataagggcacacactgggtcaaagttaaacaagcatctttattatggaattctcagagccacttatatgtgaattcacattctcaatttcccagaaagggaagggaatacagaactgccaaattattataccacaggcttttgcctcttttctcagtctgataaagtaggtgtgtttgactgcccacattttatggatggaaaagggaattcaagtaaatatagtaatagatggtacactgatggctaatatctatccttcaagggctgctaaaagttttggctcctttatttttcacgtatttaggactttaacaacatgccctataccttcatcattctctgcctcctctacctaaccctatcaggctttttttttttaataccattcatatctaaccataccagctacttgtgtcatgatgtccatttcatgtcatttgaaaaatctcaaaggaaactctccatcaattactgacccacaatcccctacacaaaacacttggagctagacgtatttctgaattcagaatgtttgaatacaaatatattactataactacactgtggaatcaaagagaagcacttaggatcaacacgttaaagtttctgcaaaaatatgcgcaattttgctcacagttagtgagattaataaaactataaagagctgcatgctagttcaggtcaggtttggacccaaaaaggaaaaaacttctggccacttgtgtccttaacatcttgcttagaacaagctgctaattgctcctaggaaacgtcttcacaacattcactacacactcataaacccacatacatgtccacacaggtgcatgcacatatatcttatagattttggagtcaaatgataataaatgtaatttggtaaaaatactacttaagcctcttatttttccacacctctgactatccgaaattttaccaagaaataattaccactgcatggtacagtttaccataaattgatttttttcacagtcatgtcactttattctactcaaagcaaacacttatgattattacccaatcaatctttcaggaattaggcgagcttaattttacatatattgagtatcatttgtatactcattttatatgattttatccgattattgtatctatcagatattcattctcagctaaatgtaaaatacatttgaggaaacataattaagtaactagaaaccatattctgtttacctccatttttaaaaaattatgcaactttggaacttgtgtgaattcaagaaatatattttgcaaaattaatcgacaatcatttttaaaagttattatgttatttctgaagttttgtggtgtatgacttttatttacatgcactaaaaacataaaagtcctaaaaataaaaacaactcaaaattattctcaggccaggcacagtggctcatgcctgtaaccctagcactttgggaggccaagacgggaggatcacctgaggtatggagttcgagaccagcctggccaacatgatgaaaacccatctctactaaaaatacaaaaagtagccaggtgtggtagtgcatgcctgtgatcccagctactccggaggctgaggcatgagaatcacttgaacccggcaggcagaggttgcattgagctgagatcatgccactgcacttcagcctaggtgacagagtgagactgtgtctcaaaaacaaaaaacaaaaaccccaaaaccaaaatttattctcagtattttttctttcctttatctggcactgcatgcagtctgagagtacagttgatatgtagtcctagtgggttactcattaattagtctttttaaatcctatgtacaggagtctctgttgatcagaagccatatgcactctctacatgggttgtaataaatatattttaaatttctgaacttgtttgcatgatggcatagaaagaagtttagataaacattccaaacagaaggcatatgcattttggcttggctgagtttataaaaatgacatgatctaaaatatctcagtttcttaatgctgcacaagtagctggaaatttctctcactgtactcatcccagctagagtcgtaacccttctccattaactactggtgccatctgttggtatgaaatgaatgggcatccagattggtgggtatttaaatcactcacagaagaaaaatcatgtgattcaccttattatctgacctgtgaagtttccatcatactttagtgattagatattttcaaatatgttttcaataaatgtttaaaataatgtatgaaatgcatttcaatatcaacaaaaagcattttaatcgatgatattttgcatttcttgattttaaaatataaatcttaaataaaaactttgaaaacagtagcttcatcattatttttggtattctttccaagaaatgaataatggctaataggtatcctaatcatccttttttattttctgtaatgctgatgttttgacatcttgggacctggctgacctggaagggacagctcctgccagtgcttgtgtacccctaaagagagtaaatgaccagcccaacagcctacctttcatatgcaaggtaaccaatccagtgcccaatcacatcactgcctcctctacagggctgtcacattcaggaccaatattcccctgcctagtcatcccaggggcagagagcacacaatccaggacagcgcctacagcccacagcctgctgaaattattcaaactatccaaacctaaacctgtttacccagccttattcttccttcatacagaaagccaaataaaggcgcttgcccacatttcccctttgctccctctgcctcctgactggcccagtgcttgtccgtatagcctggaatatcatggggtgcccctcattttgggaactatgagtaaagaactatcttttaatagcagttgtctcctggtctgttggtctcacaatgcctgagttataataaaacttacctttcaaaacaataggtcactgggtctattatctgttttgaagtccccatgattataacctgtgacatcctgggctctttatatctggaggctggagttgttcttcctagttccaggcaaaagtgccaggtgacacttagcctagtggctcggaagcctattcccagaatttctggatgtcgaatacctgaatagtctatttagtgctcagggcatatgaacctcaacatggccctgatggaacacatgacttattagccaaaatgtggtctgcttgaccctgtctgtctcatgccagagatcaagaatagttgtaggtcctggctcactgctgtttactcagccattctcaggagtctcctgaaagaacggtgtatatgtgagtggatgagtatctgcatgtgtgtacacacacacacatgcatccatctaaaataattctgccatattcaaacatataaaaccaatatttaaaacattatggaaaataagtatcagattttagactaccacatttatacttcttaaaaagtaattttgtaatatggatacattggtggataattactggtaatattctggcaatgcaaaaaaatctgttcagtgtaaatttcatgttgattacattaatcattatattttatttgtaagtaggtttgaattatcaaacataaaaattttatatttccagtagcatctttgctgatttcactattgaaaattaatgcagagttgattccagatttttcatttatattatattagaggtttttgttagatcacagatttaactttggaatttgtatttttggttgagaaaaaatcgtgtaaatggcatgcatttgtagcttatagaaatacatttaaatcatttaaaaacatgaaagaaatcaaatataaatacataacaaatacaatatggtacagtttattttatttagatgtttatagataatatatcaaaatgcacttagcttccttcatgcaacaaaagagaatgttgtaaaaaggtgactctgggtaggaagcagctttactcccaacctttagcattaatatcttgggaagagtaaattatctttgttatatgtttcccatctgaaaattttaaacatctaagctgtctcctaatgctaaggattgcctcattaagcatatgtaggcggggctgtcatagttggctgattctataagctgtcttgaagcactttccttcccttgtcccaaactctttgcatcttgcaaatataatacacaaacaaaatacagtatttttagatgaaatattcagcatcacttaaaattaaaactaaactcaaatttgtcaaatggatgcttaaaaatccaaaaagatctaagtatgagtaactgggacctgataccaggtttatcataatgctcactaagaaataagacagaagaacatcaccccatgccttctttgggatttacaaacaattacccaacataaatttctggtaaaaaatcatgcaagttgttcctcaaggtctaaaaataccttaaaattaggatttttctgtagaagtttataatgaatagattctgtttcctaagctaagatttaatttaaatgaagaccaaaaagtaaatgaacttattttcttgccagcataaaacaagatgactgtacccttgattgagggtaagaaactagccagcttaatattaaacatcaattgcatgcaactacatataataggttttgcaataaacacaataataatgtaagtgttttgactatttgctgtaagagttcttatcagaaatggacatctcagttatattcatatgggttcataaactgaagagtttttgatgatttggtcgtattccaaaccattctaaaaggtgcaattgattgaactggccatgcagttaaaatggctaaaatgatcagattgactatagctctgtcaggtgcttatcagaaaaacacgatcttacagaggcaaatctgcccccacaaaagcatggctcagaagccattcctacctccatacaaacctggaccctcaaaaatatattctgaagtattcatttatatcctgtctacttcaaaatggagttgagacaattatatcaagggagaaagagccctaaaagcaaacacgcaagtaaaactaatatcattcacattaatttcagaatgattaaaacaactgttttaccccttaagcatgtaagatttccacttcttaaatccttcttttattgttgctatttttagtctactatgactatatccttcaaagcaacattaacaacacgactggtttatttttggtaccataagaggacaatttactggcaaactgttcccactgaatgagaatgagaaacttaactacgctgttggtctttgatatttttccagcagaaatagtccttcctccatgtagtacatgagactttcagcctccagacaggctctttattttagaggaaaaacaatatcaaatcggtagaagtgttcataactttgctttattttcattttcttataggctcgttgatatggtttgactgtgtccccacccaaatctcatcttgaattgtagctcccataattcctacttgttacgagagggacttggtgggagataattgaactatgggagtggtttcccccatactgttctcatggcagtgactaaatctcacaagatctgattattttataaagggtttcccctttctcttggccctcattctctcttgtttgccgccgtgtaagatgtgccttttgccttgtgtcatgattgtgagactccccagccacatgaaactgtgagtccattaaacctctttttctttataaattacccagtcttgggtttgcctttatcagcagtgtgaaaatggactaatacacccatctcacatgcaacgacacccataggctaaaagtaaaaggatgcagaaaaatcttcaaagcaaatggaaaacagaaaaaagtagtggttaatattttaatttcagacaaaacagactttaaaccaacatagatccaaaaaatacaaagggtattacacaatggtaaagggttcaattcaagaagaagacctaactatcgtaaatatatatatgtgtgtatgtatatatatatatatatatatatatatatatatatatatatatatgcaccaaaaaaggagcagccagattcataaaagcaagttcttagaggcctacaaagaaacttggataaccacacaataataatgagagatttcaacaccccactgacattattagatcaatcatcgaagcagaaatgtagcaaagatattcaggacccaaacttgacacctgaccatatagacttctttttgtttataaatcacctagcctctggtatgtctttattcgcaatgtaggaacagactaatacactcgttaataagtgaaaagttaagggcatgtaaactcccatgcattgagtatttctgtgttagaaagaacacaaaggttttaaggtaaaatctcattggatccttgggacaaatctattgttctctcaattttagagataaagataccaaagcgtgttaaatttacatgtcttgaccaatactgaacagtagtcacataagaactctcaggtcatctcctttattctaaagaaatagtttacatcaattggcttgttgagaagaaagaggaacatgtgaaatgtgagtatctctatttatgaataaaaatgttgaataaccttgctgttttcatttacaaaagagcgcacagaattcctttaatacttgacaatggtgttattgtattcatggacaatgatcagtcaaaatgtactctgtaggttgtattttattaaacagttttaattttagatgtaattttgttaaacagatgtaatttcaagtacaaaattaaaaggagacctgaatagagcagtaacattcagaaaaattaacttttatcaagagtatcttctcttaaaagtggcttttgtgattttgttttataagaggttagaaaaataaaacaaaatgattctgctcctgttaaggaaaattaacagttggaacccacacagggatagttcctttccctcccccaacattaaggaattccaaatttttaccaaacaaccacaactgctaaaactgtacctacctatacatttattccatatatatttatttagcatctactgtatgccaggtactatgcttgaagttgcatgtagcctaatgtaacttgtggtttatattttagaggcagctatctgtaaaaccaaaacaaacaaaaatccattgacaacaacaaccaaaaaaaaacaaagtatttttgaaaaactaaacacccttcaacaatatgcactgtaagtagcatacaaagatatgaccacatggctgaaactgtcagagcacaatagcagataaaagtatttaaacaacgacgttacatgaaattgctatgaatcagtgtaccttttgtttcttgcttctaatcttcataggaaaatgacttggtcctcaaaaattcactccactaactctcttgttagaatgattggggaaaaatattttgtctaaaagtttgaatatgacatacatgcaaaaactgattttaaacaaagaggtcaaccaatctcatagggaaagaacaatgttttcaacaactgatgctggaacaactgggtaatgcaaacagaaaaatctctctctctctctctctctctctctctctctcgctctctagcctactcttacttcacatcatttacaaaaaataacttaaactaggtcatagactgaagtgtaggatgtaaaattataaaacctctataaggaaataagggaacaaaatctttgcaatcatggattaaacatttctttaaaatgacatgaaaacacaaaataaaaatggatatacagtattgcaattcatcaaaattacaaagttatgctcttcaaataacagttggaaaaattaaaagggaaccacagactggatgaaactagtttcaaaacacctgtctgatacaggacttgtctccaatatacatgaagaactttcatgactcaacactaaaaagagaacccaattaaaaagataggtaaattatttgaatgaactcttcaatcaataagatatgagggtgacaaataagtatcttaaaattggtcagtattacaatttgtaaatttaccttaataatgccaacaaaaatttaatgccatcggtgtttgctacagtttacagattataaataaatttaacttcaactgaaattatgaatatattcatttcactccaaatatataacgtttctgctgacaagtatagaatggtattgtcagcctatttcaaagactgaatataaaatagtaggtgtctcagatgcctaatgtgaaataaaacatgaggccataatgtaaaggcaacccaactcaaatgccagaactcatttggtcacagagatttccattgtaacctcagcaaaaggacaattttcttccactcgaagtcttttgttgcacattgatgccaacttgtctaccttccccttaatgctcaggagttttgccttcgactccatttcattgcatatgtaaggctgattgcttgttgtgcttactgattacctcatttaaagttttaaattgcattgtcttaaaaatgaacactatactatatgtgatatttagtaatgacgtaaaacctaaaacataaacttgcaggtaggaaagatttgcataattcattgagattctatgaaacactatcatattaggaatgtacacattgctaattgtaaaattatattccatcaaccatcacaaattgaagagtcagagtgtttaagtcacttaagttgttaagtggttgagtcctggaatgtgttttcagttttgctagacactctgactttgtctctggtggctgccactgtgtaattatgttccttctccttagagaagcaaagacagcaaaattaacactctcagatataggaagctatgacactgcacatcacatccacagaaatatacctactcatgctttttctaaaatgaaatatttgctccatacaaagcattaaacttcacacgcaaatcggaaaagtacaagaagagttttacaagtgcatgagcacacacattcacacacaaattgaagaacccattagtgttttaattctaagttttaaaaattgtgccaaattgttcttatttcttctttttttggtgtgctggaggctctctcactctttctgctaaaagtgagagccttatttcatctattttcgcctgccaggtagaggatagatgatgaataaaatttgagttaatttgcagaggtgttaggaaagtgtttgaaaaattgctggtgatcactatgctccaaaattgggtcatgaggagcaagtcccataagacagctcttttgccttttggatagatttattaacactggaagaactagggaattctgtaaaaaataatgtttctggactttggccaaacatctgagagggctagtggtagtgcactgaaatgcccttctaattctcatcacttctgataattcttcaagacctatccagatgtccccagttctgcaaagcagaccctacataatccaggtggagttaccagcagttcttcagtggctccacagaacagatgctctctattgtgcccttttattggctgtgtaccatgatgtttttaacaattggttttaacacagcctcatctactggaccatgattctatagtataacaaaatgttcagactccatgcaggcatcaatagatatttgatgaaagctatggttgaaatcctgcagacaaaatgaaaaaaaattactatgggtaacagtagatataaatagatagtcacaatgtggaaatagtatttgctatttcaaatgatgaggagtacccttacagcagtggtccccaaccttttcagcaccagggaccagtttcatggaagacaatttttccaggctgggtgtgggggagggcaatggtttcgggatgattcaagtgtgttacatttattgtgcactttatttgtagtattacatgctcatcacaatgtacaatcagtgagaaccctgagcctgttttctggcaactagatgatcccatctgggggtgatgggagacaatgacagatcatcaggcattacattctcataaggagcgcacaacctagatccctcacatgtgaagttcacaatagggttcacgttcttataagaatcccttgctgcagctcatctgacaggaggtgaagctcagcttggctcgctcacccacaactcatctcttgctgtgcggccaggtacctaacaggccatggagtagtgccaatccatggcccaggggttggggacccttgctttatagaatacaactttttaatcaaatttgtgatttggatagggatagctattatacagattccacacgttttcaccatgcggaacaatgggtaaatccaaaaagacagaatttaaacaggataaattaaaaagtcttaattttagattaaaatatttaatggtccaggatcaagacactgaggcttaaaaatcataatatgcatataagaccacaaaataatggataatgttcactaagctcttcttctgcattagcttaagtgagaagtgcttgccaagtgtcaggtaactcaattctcaaaacagtacaatgtagcaatatcagaatctgcatgtaaaagatgaggcaattgaaactcagagggcagaagtaacctgcccaaggtcacacaaagagtatgtgacacaacatgagtgtgatcctcagctctctggggttgaaattccctatgctcttttccagttaatcactgcttccaacctcagctataagcaccatgatctactgattcccaaagccgtctgggagttacttggcctctaaaaaattataagactctatgctacattaatagatgtattacggccagactaagagggctgattgttcttcaccactttttgtactttttgtaaaattatatttgtctcaattatagtatccccaggatgggaaagtgtccaaaaaaaaaaagagtggttaaagcttttgagaagactcggaaaaacacaaaacacaatggccatcttggaatgcacagagaacggcagatgcaaatggcacttttactttttgcatgcctcttggtgatgggacaaaagctggcaggaaaaactttttagcaattagaaatgtctaaaaataaatagactaatttgtgagataataaattcctctctacgggaaaccatttttgtggaaggtggatgacacataattgggagtgctatgaggctagcagatttgactaggtgactgcaagttcctttcctactctagggatccacacctttagtgatcaatgacctaggtagcagaacaaatgaaaatgttagagctatgcttaaataactaatttccatgccaatatttttgagtaatgtatatcaagcatttcttagttactgaccattagccttgttgccactgcctaacccggaaaagttaaacaacaacaacaacaacaacaacaactcatgcaagagacaataagcctcttaaataaagacaaaagatacacaggaggtagaacagatctatctggtgtctgatatgacagctgttttctacaggtggttcataaaccccattccctacccctggcatctcgttaaaattctccaggtcactaaaagtgataatagtatttgtttagaaagaatgtatttccacccccgaaacataagagtttgaacatatcaaataaaaactaccagcaattggaggagagatcacgacataaacagccaaagatggagtaacaccagtggtgagttttcagcatttacagttgtatacattttatgtttcatttgtaggcacatgttgtttatatctgaacacaagttcatttcttattttattttatgttttttagagacatggtcttgctctgttgcctaggctggagtgcagtagtgccatcatagctcactgcatccttgaactcctgggctcaagcaatcctcccacctcagcctcccaagtgctggaattacaggcatgaaccaccacatctggcctcactcattattttaacataccattggtctccaaatcaaataggctatgatacgtcatgctttaattgttgaaaaaaatgctaattaaaattaattgaaacttaaaatgcctcattttataggggaaaaaagtaaactttttttcccccaaatagtaataaactctagcatatttaatatatgtttcttaaatgttccatatggttttctacttatacgtgcatttttgaaaaagacatactgtgacttttatttctcattctatttcctatttttctcactcaacattgtgcttcttagtcctggcatctgcagagagacataactcattaccttgggccaatgcatagttcaccatgtgctacactttattccttgagggatctcctagctctttcaacccatacagtgctgtgacaaatgtctgctacacacatctccttgtgatctgcaggaggatgtctctaataatgcacaccagggtggactgcaggacactgggcaacatgcagactgaatctcatcaattcagtccactagcttccggagggactgatcagcaaacactgcaaccaggggtgcaggtgtgtttctatttccccaattcttgacagcacctggtatctttcgacttttggcaaaccaattggtgtaaagaggtcatctttttcttaaactgcatgtagaaattactaagaagaattctactttggtttggtaacttacccatttatgtgctttgctcagttttccattaggataagtttttcctttttcctttattgatattgtttccttatatatcctacttcttaggatatcttgctgtcaaataaccctactgtcaataatcacacctgtaatcccagcactttgggaggccgaggcaggtggatcacctgaggtcaggagtttgagaccagcctggtcaacatggtgaaatgccgtctctactaaaaatataaaaacattagccaggcgtggtggtgggtgtctgtaatcctagctactcaggaggctgaggcaggagaatcacttgaacttgggaggtggaggctgcagtgagccaaggtcatgccactgcaccccagcatgggcaacaagagcgaaactccatctcaaaaaaaaaaaaatacataaacaatcatatcttctcccagtcacctgtttcatacatctcttaactcttcagattgtccttcactaaatagagagatcaattttgatgtagtaatataatgtcactttttccccttaggattttccttagtgggggaaaagaaagtccattcaataaagcttttcctatcttgctgtcattaagatattctccaatatgttattctagacattttataagactacttttcacatttaggtctccaaaatattgaaagttttaaaggatctttccatgataagccaggtttctgtacaaggttatgctacctttatcacacatcaagtaaacatatattcatggggatactttctggactcctctatagcaaggatctatgtcttatcgtgaagactatacacacactttactactataaaaattttcttattatttggtaaggaaaggccctatttactcaagataaccaacttaatcttggagggaagagagtctgtggcatttgtgccacagcacactcctctttttgctaatcaatgtgagagaagctgtactctactttgagtggttggttcaagaagacagggctcactcgctcaccacctccaagtatagagctacgcagtgtttccaggaggggaaaaccaccagagtttctcatcctccacagctccatgttgtagaagctccctttcagacaaatatgattgagaggtatagggcacccttctttcacccaggccctatgtatggtggaagatctcccctgctgcagcatgctgagactaatgactctgattggccttgccccagcttgctcctcaggagaagattctatgctgggaggaggaagtttaccatccagccccatcgcccacttacagagcaagagtgccaatccaaaagacatggggcatgtcccggaccccacctccagagaagtggtataaatgtgttgcctgggaggacaggcaaggcatatgaacagagagttccagtgctctccttaatgggaatggctatatttaaaatagagcgtacagaactgaagaccaagtgtttgtttaaaacaatgaagctcttggtgttgaacaattaagagaagaatggcagctccttgatagcaataaatgaaatgacagatgatttagaagttagaagttttccagaaggactctaagaaagagatagctaagatgatccctcctgtagttggaacaattctcagagactagcagttagtgaaggttaagtgagtgtgatatcaacagacgtataccagcaggaagattcatagggggatgaaaaataaaaagagacagtgagacagcctagctaaaaccagtcaacctggggtcctgcggtgaggaggaggacattaaggaaaactgtgtacctgactaaggatgcaaactctgaggagtgacagcagaaactgaacagagaaaacagacctcaataaactattccagtcaagttaccaaataaataaacaacagaaacaacaagcactggttggagggtggtcagtattcagagtagcttcaatacattatctaaaatgtgcagctttcaaccaaaaaagttatgagtcacccaatgaaacatgaaagtgtgacccatataaaggaaaaacaacaacaacaaaccagacattagaaactgcctctgaaggagcctagatggtagatttaggagatggaagatttcaaagcagctattttaaatatgttccaagaactaaaggaaaccatgctttaaaccatgaattaaaggaatatattatgatgactcaccaaatacaggatgttaataaaaacagaaattattaaaaaataaatcaaaggaaaattctggagttaagaagtacaatagctgagatgaagagctcactagagggaatccacagtaaagttaagctggaagaagaaaatctcagcgtacttgaagaaagaccagtagagattatgcaacatgaacaatagacagaagaaaataaattgaacagagcctcagagaagtgcaggacactatttggcacactaacacgcatgtaatggaagcgccagagagacaggagagatagagagaaggcatgaaaatatcaaatgaataatagttgtaaacttcccatattcaatgggaaacattaaccttcacatccaagaagctcaataactaaaaatagaatgaacacagagatccatatccagacacatcagagttaacacgttgaaagtgaaagacaatgaaaaatgtgaaggcagcaagagaaaaattactcttccttaacaagagaatgccaacaaaattaacaattgacttctcatcaacaacaatgaaggcaaggaggcagtgggatgaaatattcaaaagaaacatacctgaaactaactacggagccccaaattagatgaagaaaaaatgagaaaattgaaggaagaaacagaaaattcagcaatgttagttgaaattcagcaatattagttgatttaaatatcccatttaaaatattagataggccaggcacggtggctcatgccggtaatccctgcactttgggaggccagagtgggtggttcacaacgtcaggagttcgagacaaccatggccaacatagtgaaaccccatctctactaaaaatacaaaaattagccaggcatagtggtgggtgcctgtaatcccagcttctatggaggctaaggcaggagaatttcttgaacctgagaggcagagtttgcagtaagccacaaatgtgccaatgtactccagtctgggtgacagaatgaggcactgtctcaaaaaaaaaaaaaaaattagtacaacttgatagaaacgtagatcagtaggctacactggaaggtccagaaataaacctggacatctttcttcttccaatgtgaagtagtattttaggcttcagtggtttggaatggatagtggtacagtccatcttcttatgcctgatgttttttcttgggtgatttcccccctcatgacatctgtttctattttctgtccaatacccagtcaacagaatcaggctcatgcttctcctgcacacagctctctgccccatgagttggcactgcccatttatccagccaccccaatttcacctatccttttccccaactcttgagcatttggccacaatcagtcaagtcttctctacattcaaccgactatatactcatcagaaagagagaactttacccttttctttgtctggttgtacataatgccatattttccccatattctttttcagcacccagggaacctgagcaagaccataggcacacacacagccatggagaagggtggcttctccccttccttgaaagcacctcaatttcagaactgattctcttggggattcacagttgagaatttgagagagcagaagccagaaaaataccttctgctccacggggatatgaagggcatggatgggatctggactttctcctcaatctcaatcccgtgcacgatttctccagttctgcctctagttcttgctcttgaggatgaggaggttacaaaccaggagtctctcatttaaaaaccggggttctcaataggttgctctttctatgcaatcccacactgagttttgaaagtcagatcaggaaagttgaatattttactgttttgagtaggtggcagttgcacaaaatataagatgaaatggcccagaaagtatgtaaaaagcaatgagaagattccagcacattgtaatatttaagggaaaggtggaagaaaatgagtcaatgatggaaagcagaagaatcttagaaaagagggagcacagaaaacatgatgctagaaaatctagagtgaaaaaccatttcctaaaggtgcagcttgtggtatcagatggtgtgaataagtcaagtagcttcagaaatgaaaatagtccattatttttggcaacctggagattaggaacctttagagcaattttaatgtcatctagtgggcagaagatataggcaataggttgaaagatcaatataaaatgagaaattagaggtagggattatacagcactcttttaggacatctgatgttaaggcaagggaaggatagcttcataaaatataagcaaagattttttttttcctctgtaaacttaggaaggaagaaatgacttgggcatgtttttaggtaaagaacatggggcagtgcaaagagagtttttaaaaatttgagaaacaagatggaatataaagcaagatttagaagaatatggaacaaaaatgagtgtgggagtttgtgtggttaaatgttatctttagaaagaagaaggcatcacccataagagaggggtaatgatcagagagaacagtgagaaactggagtcctactactaagcatgaggaagcaaaaaagagtggaagcttaaaaggaagaagatgaaggaggagaaacggagctccttaggagcaaggatgtaatttcacaggagttttaagagcagataagactcgaatggatgaacattgataatttctgaagggaagttagggataaggcatttccatttctgttactgacttctagggctcttcaaattgccccaaattctttttcagaattgccacaacttctcaaccacatctggatattctaacgaaatatgcatgttttattcctaacattctaacattgtttcctctgcccttctatttctgtactatagtaaatcagtcctgaacattctacataggaaagaatatcttttttttcttataacatagatgggctattctttaaccccttgttttcaggccccctttcagacttgccttgcagacacattgcctgaggaacctgaaacctttacgggttctactagcagatcagctcccacccctactccttaataccagcttccactcctactctttaatgccagcatgtattttggagtatcttttttttctactttatatcacaactgaaaactcttacactaatttccagtctaatagaaattgttcaaatgtcttatcttctgaggccctccaagcatcaatggtttaatccccccccacccccgccacacacacattcatgattctacagtaacttgaatggaattttagagagaagaaaactgaggaaaacccacccccttaaataagcaccataaacaatcctaggagacatgagctgtttattttgtatattgtacttctaatgagcattaaacaagcacacacccacttaagctgtttctcagttggctataggatatagctataactattgccaatctcaaacctctgcccgctccagaatcattgttcagtagctgtacctggaaatcatcttgtcttctctttcctctcattccagaataaaatatctattaaagtaagaagtaaatgcatgaaagaatacagcgctttgttatacctatccagatcctgaatgtaacagatttcatgtcctttgtaattatggaaataaaacttttactagaaataaaatataaaataagggtgggggaagtcatccaaacggctaatatacactaacaacaaggaagttatgacagtgcaggcaactgaagtgagcatttctatcccctcctgatgattttccaacctctggtacaattggcaagttaactctgactgaaaaagtttttttcaggtattgctgttaatcaaaggaaatcaggtccaatgttcatgtcttgaaggcacttctgaaacattagaaagtgtgtcatcttggcagccagctgaagtgcaaccatttggagcagatctatttatcaatacgcacagagagcaagtttaagacttgcacactggagctgaatggagcatgaagaaggggcagtggagaacacataaatattgagcaatgaccttctatttggaagttggaggcaatcccacacatgggcttttatgcatttagaatttatttctctgagttccaaggtgcaggtggattgtattaggaataaataatatcatgatccaggaaaccataggaaaaaaaaggttaccagcatgaaaaggagttattacctcaagtagatggcaatttcagaatggcaattataatttctttacaagaaaaaagcaaaacagccatttcatttagtaattatagaagtttatatattttttaagaaaaaaaccttcaaaaaacaatcattaccttggaaaatgtttacttaaatttgtctatttctaaacgcccactgagcacttaaatactaatagagggaatgtgtatctccaaaataaactgagttcttgccaatgaaccgtttggacaaaacacacaactcagaagtatagagatatattaaaagactgtcttgctaagagctccctttaaaaaataagtacatatgccacaatgccagttgagaagttggcatctacaaccacaaaatgtaagttaaaaataatttcatcttgtgaatatggaaaataataccttgcacttaatttccctccaattacttctactgcaaaattttatatgacaaagttacttttttaaattgcttatctatttattacaatcttagtacagaattccacctctttagcctcagaacaatgccagcgaaaattagactagcacacacattctgcagtatcgattcctaactcattctgaaaatcataataatgacatttatattttagtaacataaaaaacagagaccttaaaaacctgagcaacatcaatcttctcaacaaataatggtttgaaaaatacatacatttatgttttttaaattatttattatttatttttcaaatccaatttgatttctactacctccactcaaaacctattatgtctagtgaaaggggaggaggttttagacatcaactaatctaagactcactttatagattaagacatttgagttctagagaagtgatactaattgaatataggataaatccccttaagaaaacgaataccgtatcagtcatcagtaaaatctaatgtaaagaaccggtctctaaagtctttgattttaatgggaaaagataacagcctctcttttttcatcacgtaaattagcttcagatttattagttttgttaatatattcttagtactttaaattagtcacaccagctgagggggcagtgtttccctgttactagctgcccctctgggtaattaatggcttgtgcccatgcctgtgttacctctcttctccactgatctgtaatgcatttgccaccggactgtgttatccattcccaaacattccgcccatggttctctggttaaataattcagctcctcagaaagccagtaacacttatttttggtatcttattctatgtttgccaattttttacttatggtataattctacttttattgctttataaaaaaatagcaagaagcactagcattagtctaagaaataactggtactgcagtaatagatgagatgtcttaattctccttatctctgcaagggcccttaaattctctgcaacatatttcattctctggttctagaaattccccttaaattaaaaatatgtttcccgcacaaaagttgctaagtgctcactagctatccttataactgtacagaaccatggactcccacccactactcttgctctgtcacccaggctgaagtgcagtggtgccatcttggctcaatgcaccctctgcctcctaggttcaagagattctcccacctcagcctccccagtagctggaactacaggtgcctgccaccacaccaggctattttttgtatttatagtagagacatggtttcactatgttgaccaggctggtctcaaacttctgacttcaagtgatccacccacctcagccccgcaaagtgctaggattataggcatgagccactgcaccccggccataacctcaattttagaacaaggcaggtttcttatttctttatacgcaaaaagatttccatgatctgtgacaatttaaagaattccggttttggcccatcttttccatcagaactgagaaggaacacttgagaaaatcaaagaaataagacattgtgatgcaaactatctacattggtagtctccaaaagggggtgattttgccctccaggagacatttgacaatatctggagacatttgagtttgttacaatggggatgagaaggtgctacaatcatctagtcatctagtgggcagagggcagaaaggctgctaaatatcctacaacgtgcaggacaccaagcacaacaaggaattcgcaagtccacaatgtcaataatgcaaaggatgagaaccttgatttcagttctggctatttaaaatgctgtctccataccagcagctttggcctttcctaggagcttgttggaaactcggaacccaccacagacctactgaatcaatccacagttagcaagatccccaggtgactcatatggatagtccaatttgagaagcactgattatacaacacttaggcaattcttacatattctaaaagagcatctgtcttatagcacacaagaatacccttaacttaaataacagactattacagtatcctgtctctaatacgatattaacattagttccactgtgtagcatatgaaaaaattccattgcttagtaaatacggaaaattctggttagggaaaacaaacatactagaacctctaagaggctaatgcatcttaagaatctccaagaaagggatatcatagataccatttctcaaaattatataactctagaatctatttgtttcagagcttttaataagtctaagttttcatagaacaaatttccttttctcagcatggaaactaaacatacactgattaaggttgagatcactctcaacagagccttgaatgaattattacctatgatgcatgttgcttcaatgaaagacaaaactcaaggcctgtcttaacaatgaaagtctggctggaatcccacagaacctcaacaagagaaaacctttctcaagtgttaaccatgcctaagtagaaacttgcagaggaaaatttcttacatataaaaatccaggtgaaaaaaaatatcttgggtattgttgcatgttgaaagaacaaagcttatgactggagatgaattctcttcattcagaaatcatattaaaaagacatatgctttcatcacattatctgactactttagtgataaaacattttctttattatgtaatagaaaaactctgttaacaagcaactcttgggaacaactgcaaaatagaaggaaatacatatgagtaattcaatgtcaatggtgactttattatgcacataaattacatggagttgcagactgtctcttttcatcactaattgcattacagcttatgcaaggttcactgaatgaatagaatcgccttggtatggacagctttgcaaaactgtgaacatttccttagcaattaagaattccctaaggttgccacacactgggtacaaatccttggcatgtaatgttgatatgtggacatctataaataggtatgttacactatctagaaaaaaccaacaacaataacaaatagcatatctttgtaagtatgattaattagtaagacaacgggactggtgtcacacatacctaggttcaaacctgcacgtgccctatgccctggctgtctagcagcatcaagggaaggcctgcattttcctcaacaagcacttgagtggaatgtggcatgagtcacatgacacgcaaaaacagagaacacaaggtcttggcatcactctgttagcagtcacctttgttatatttaagatttccattcttaggactgcttagctattcagacatccttggatgagaaagagtcattttggtccaccagaatcattatcttggacagagcttctgaagacatactgaaccctatcaactctgctgaccaatgggagtggtatatcccagatggcattaggaacatactctaaagtatttgacttttactgagtatatcgttcattcccctaacgaacaatatgttcgttaataaaacccaaaataaaacccaacatgtcagtgtttactgtgagacacatggtgggttccaggtgtcaggaaggtttctacaaagatagccatgcgtgtattcaaggtcgttctgagcacaggattttaaaaaggtgagctctcctcactttttattattacatgtgaaattgttaaataactttgttcatttaacagtgattgaactgttaaattcaaagaatcaaatatgaacatagaagcatcaaatatgaacactttaactctctcagacattctgctttaaagtgtgcaatgtgagcgttccatgaacacagtagaaacatctatcccaggaaccggataaaccacactctaatctcagttttactaggagtatccacttcccactggaaaagacatttaatctctttgagcatctatttccttctcagaacaggagtaaaaggatatatatatatatatatatccttttatgtatgtatatgtacatgcacacatatacacgtatatgtacatgcacacatatacacgtatatgtatatgcatacatatgggatatgtacatacatatacgtgtgtatgtatatacatatacgtgtgtgtatatacatatacgtgtgtgtatacatatacgtgtgtgtatatacatatacgtgtgtatatacatatacgtgtgtatatacatatacgtgtgtgtatatacatatacgtgtgtgtatacatatacgtgtgtgtatatacatatacgtgtgtatgtacatacatatacgtatatgtatgtacatacatacacgtgtacatacacgtgtatgtacatacatatacgtatatgtgtatgtatgtatgtatatacatatacatatatattttgccacactcacaaggttattaaaaggattctttaggtaatacaaaacaatttacatgtttaaaattgataaagctgttcattgattccattcccttttctttacggtgcataacaattgcagctttctctcattaaggtttagggtaattgtttttctcagtgaatattacattgcatgagcttggcaggtaaaaatagcaacattgtttcttaaaagtgaaaaaagaaaacccacggagttttgagaacaattttgtgccccaatttacacctactaaatattgaggtagatccattctatcaatatatattgaccacctatttatgtctcaggtacagcccaggtgtttgaaacgtatccgtaatgaaaacacataaagatccctgtccttgtggagcttcaattctagcagcaggaggcagaacataaataatattataataaatcatcaaattatgtattttgttggaagatggcaatcacatattttaaaaaggaatcatagaacaagggggttgcaatttgaagcagctgagtcaaagtaggtgctttgagagggtggcgctgcgaaaagaattggaggagatgatgaagccagcagcacaaactctgatggatgaagtttccaggcagaggaagagaagggcaaaggccctggcaaactgctgtattcaaggcacaggaagcagcagtggagttggtcaaagtgagttgagggtggggctgcgagatgagggccaagaggtgacaggaagccctcaaaggaagaagcaggttgcccacaaatgtgacgttggggccacagatcctgggcacaggcaataagggtgaccttgtgaggaatttaattataataagaaaccaactggcattcagtctgcttttcttatcattatgtgccagcaattctaagcaatgtcacagataaaatactcctcaacccctgaattctttttagtctaaatgctaaataattgccgtggttactgtgaagttctaattgcgtgtaatatatggaacttcctgctatgtggtcaatccctaaaacatggagactcatgctgcatgcatttgggtcagttagaagtctgtagcggtccagaattgtgcgagtgctgtctgtgtctccaatccctgtgtcactagagtcctgaatttagattcaaaataacaaaactcagtaattataacagcaaagaaacagatcttcagttataatctatgtaagcacttggcagttgaattctatttcaaatttaaaacagtaaaatagatcgcaaactgtaaggtgtaatattttatgtgtgtatgcttgcacgttttagttcatacatttaatattttattttttatttttgtttttttaattttattattattatacttaaagttttagggtacatgtacataatgtgcaggtttgttacatatgtatacatgtgccatgttggtgtgctgcacccattaactcgtcatttagcattaggtatatctcctaatgctatccctcccccctccccccaccccacaacagttcccggtgtgtggtgtttcccttcctgtgtccacgtgttctcattgttcaattcccacctatgagtgagaacatgcggtgtttggttttttgtccttgcgatagtttgctgagaatgatggtttccagcttcatccatgtccctacaaaggacatgaactcatccttttttatggctgcatagtattccatggtgtattatgtgccacattttcttaatccagtctatcattgtacagctttataacagaaacttgttactgtgaaattattcttacataactgtaatttattaaactttaatgggattacttattattgtgagagaccaaaaaataattataatgttttttctattttttcccaaaaaaatgcactaatgtaattaaaaaatgttacatcattacttatttccttttatgtattgtaacatttgtttttattgctctgcatacatgaagtaaaacgaaagaatttcattttttcactttttgttcccagtcattactattattcatttgacttcatatttattaatgaaaataactttttgaataggagaagaaatgttaaaaaaaggacccactccagctgttgaatacataaagcagaccaatgattggaaggaactcattgatcttatttcttaaatatttagtgcatgaagtacaataaaatcacttagtctagcggccgactttattacttttggctgttcttctccacagtgggagagtttcattaatagttgaatcaataaatgaatcaataagaaaaagtgaaaaaaaacctagataatagtatttgaaaggctgacaggaatgtgtcaggccagatataggacacaggtaccaacgtggcactttatgtaggatgtttcacattaaagtagcttattttcttgctttaaacatctagaaattacaacagtaattgttatgtccaactactataagagttaagtcctgtaaatgataccaagcggctgtgccgggtgcagtggctcacacctgtaatctcagcaccctgggaggccaagacgggtggatcaggaggtcaggagatcaagaccatcctggttaacacagtgaaaccctgtctctactaaaaatacaaaaaattagctgggtgtggtggcgggcgcctgtagtcccagctactcgggaggctgaggcaggagaatggtgtgaacctgggagccggagcttgcagtgagccaagatcacgccactgcactctggcatgggcgaaagaacaagactccatctcaaaaaaaaaaaaaaaatgataccaagcaatatatgttatttaatcctgctggttttacaaaaacataacagcaaaggaaatctgtcatgactgcccactatatggtcataaaattgaacaattgatgcttgtcacccataagtcaaactgtggataactatgaaaataaacctattttaattgatttttttatctgttagagaattagagatatgaagaattcagtttgatggcaaaaaagcagatgtattctgaaatcatcaaatagttatatatatgtatatactttcacagtatttttttgtaagagacggggtctcactctgtcacccaggctagactagagctgcataaccatcatagctcactgcaggctcaaactcctgggctcaagggatccttctgcctcagtatctcagatggctgggactataagcgtgcaccaccatgcccagctaattttttaactttttctagagacggggtttcactgtgttacccaagttggtcttgaactcccggcctcaatcaatcctcccacctcagtcttcccaaaatattgggattacaggcatgagccaccatgcccagtctaattttttgatatacaatttcaaactgcaagctagaatggttccctcccccacatttattatattatgactcaacagaatgtgaaacaggtccatataacacagaatgatatcccagaaattgtgctcatcttcacaacactatttttaaaaagttacattaaaaacactttgtatttgcctaaaaaggttaaaataaaccacttcttcctatagttatgtatactaaattcaattatacgtgaatgattccttatctagattttttaattttccttttttaaaaatttctttttatccagatatttgaatatatcaataatcattatagcctttcaacaactgagaaccactgttagtgcaataattaagaaaggattaatagcacttccagatacttctactgtatttttgtgcacttgtaactgtttcatttttagaccagggaaataaaaatatcttgtccttactgcttatctaagtttacatccttatcataaaatgcttaggaaaacaaacagcataaagaataaaataacaatcacattacctgtgaaaaagtacagtaggaaatttcatctatattaatatttattttatgaaaataatgttcaacttttaaacataaacagtacattatttatctagctttattgttttattttttttaaatttaaaatcctatcttccaccatagttcttgtcaatatgcataaatattcaatatgcataaaacatatgattccattttatgtatttatctcagcagtcctctgtgaatcttctttctttccttttctttttctttctgtccttttttcttctctgtccttttttcttcttctgctcttctctctgctctctcagtccatgagcccatgggccctccctctagccttgttttttgtttttccttctttattactgtggataaaatatgctgaatatttaccatgttatgttccagctgctgtgcttagagtcttatgtgtatcatcctagcttccctcacaagtttctgaatagccattactggtggtattcattttataatgaggcaaaaatgaggcttagagagattaaggagttgcccaaagtcatcaagacggcagacagcaaagctgggattcatattcaacagggtctgtttccagtgccagagcctttcacaataatagacacggaaacacacattctcaaggatgtgccagtgtactcttgcctgaacgtttccttggaatacatttccatcagtggaacaattcacaggctaacttaaaatgttggatacatacttccaaattatcttcaagaaatattttaccaatgatgcatggaaaagtcctggcttcctatttcttaggaaatatcaagtaaatttcgtttacttgatattttaaaatattttttgttcaatttgtctttttgttcctatctgctaaggcagaagcttttcttcccttcctctctaagaccctgttcttcctgatcatggcacaggagcaggccaaatggcccagcctcctgcagaacgtctgcagatcgtgagtttcctcaagttgcctgacctccttctgcaaccaggtggaaaggtgcaccctggtctctcactgctcaggaagctgctgacacttggggcatcttcagtctccctgcacacacagtgcttccaggacatcaaaacagccacacattctcattggcatccttctaaaactgacctttatttttctgtcttctattctgattcagcctcctccccttccagcactttcagtacataactagtaaaattcttgcacctgcagagtactcggtcaccactgtccctgtctccatcaccctttctgctcattgagcaaactctactgttctttgctctcttcctctttcagctggactccatggtgtatttaaaaactcagccagctttcctcaaacactgccccaccccaattcttttgtcaattttctggtcattgctagtccggcaaaaagtccaagcctggatcaataaagctgtctgccttctccatgtctaagttccaacaaaataacttcagctgcaaaaagagcacaactggacaggatgctgttcaggagaatccacgctgtgtggaatccaacatcagctggtcctccttcagtgttccccacagcatttcttattccctaccaacctgtccctgtcatctccaccagtcactccagccactgaagggtggcttccatgcaagccactttgctgatagtgccccccgcaagccccttctatctgcttgtcagtgaaattgtacttcacctctcttctataattgaaataattttctgctagtttctatgacaactcacacccctaatgttctcacaaacaattcctgcaccccacacaattctttctgggcttctccacctgtctgataaccattggcgaccttctcaaggttgcatcaggacctgtgctaactctacactctgtcccttgacaattctcaccttctcacgggcatcccatcactaactgctttcctaacgatacctccacatccagccatgatcttgctctagagtccaagcttatgcatctaattgtgtatttgcctgtttccttagaaatccaggtttctgtcctcaccacctggataaagtatagtcatgttcacggacagagtcacggacagacatagacaaaggagcaggcttgcttggctaaatcttacttaactttcaagttttagcctagatattgccttctatatatgttaaatctggatttagtacatttctattctattgcatcctgaacttttatcatatcacttagcacatataatttcttatataattttctgtctctctgtcatctgtaaactggctccatcaatgagggcagagagaacagtgactttttttttttttttttttactattatattcccagctttatacagtacacccagcaggtgttcatgctaccaagataaactgaactcaatggaatttaattctgcctgggaatatgggccaccagacctaggctacttggtcctgccctgttaatagctatgtctcagctgtcactttctaggaatggtgatgcagacattttcctcaaaagcccctttctccaaccttatcaactcttgctaagagatgccaagtaagctactgacctatccattcttcagggaagaggaatctacagacccacttgggttcagctttacaccttgctgcacttggaaagtcctccccaaaattatttttcccccaaattaatttatattttttaacatgccataatctttaatctacctgatgcctgttttgctataaagttacatttttttccaattagtaagttatcttagcactatttatttaattctttattctctcatgatctataatttcaactctgtaactagcaaaatcttctagcaccatggcaaagaatatagaccctagagccagctgcctagatccaattccaccatgacactcaatagactttgagcagatcacttaatctcactggattaatttataagtaaaatgcttaaaatggtactgatagagagaagatctttatgcgttactgtgtattgttactgtaatctgatttcatattttattttcagctccatttactttattgttgaacttgtgccacattaattgctgtagatggataacacatttttgcgtctaagagaatattaattcccatccctttcagaaaaaaactacttttatattcttatgtaattattcctatagtaaaattctttgtcctccaaatattaatttaaaaagtcaactaccacttctgtatttatttttatgggtcaaagcattgtattaacagctttatttacataggtaatcaaatttactcatatgagatatgctttattattacatttgctttatgaattaggagaataaaggttgcaaacattaagtaacccaggttgtctaagtccaaaatttgtaccctatataactgtaacataccactttcattaaagaaacaaacttattttgttatttttatttttatttttttaagacagagtctcgctctgtcacccaggctggagtgcagtggtgttatcttggatcactgcaacctttgcctcccaagttaaagtgattctcctgcctcagcctccagagtagctgggattacaggtgtgcaccaccacactcagctaattttgcatttttagtagagatggggtttcaccatgttggccaggctggtctcaaacaactgacctcgtgatccacctgcctcagcctcccaaagtgcagagattacaggcgtgagccactgcacctggccataaagaaacaaactcttgatgagattgggataggatttgggttaaacacagacaaatttggggggaactgacactgttgaatactgtcttcttgttcaatattgcggttactgttttatccaatcatttatgctcttcattaaggttttatattattaatatagctaaggtttacagtttttactgtattgtaggcactatcagaatgctttacaacaattaattcttctaagtctcacgatgaccatatgactttggcattattattatttttataattattataatcatttcacagaaaaccaagacacagagaggtccctttaaattaaatgactgaatgacttaatatcacctagccagtgagtgacaaaactagtatttttgttatacactcttggttccagaacccatgactttagtcagtgatatgatttgaatttgtgtccccacccaaatctcttgttgaattgtaatccccaatgttggaggaggggcctggtggaacatgattggatcgtgggggtgatttcccccttgcagttttcatgatagtgagtaaaatcccatgagatctggttgtttaaaagtgtgcaacccctcctccttcactctctcttcctactgctccagccacagaagacatgcctgcttcaccttcaccttcagccatgatagtgagtttcctgaggtctctgcaaccatgcttcctgtacagcctgcagaactgtgagtcctttaaacttcttttctttatacattacacaatctcagtagtcctttatagcaatgcaagaatggactaatacagaaaattggtactgagaagtggggcattgctataaagaaacttgaaaatgtggaagtgactttggaactggataatgggcagaggttggactagtttgaaggggtcagaaggagacaggaagatgtggtaaagtgttgaactttctagagatttgttatattgttgtgaccaaaatgatgatagtgatatggacaatgaagttcaggctgaggtggtctcagatgaagatgaggaacttactgggaactgaagtgaaagtcactcttgctatgctttagcaaagagactggtggcactgtgtttctgccctaaagagctgcagaactttgaacttgggagtgatgatttaaggtatctggtggaagaaattcctaagcagcaaagtgtccaaggtgtggcctggctgcttctatcagcatatggttatatgcatgagcaaatagatgatctgaaactggaacttatatttaataggagagcagagtaaaaaagttcagaaaacttgcagcctaaccatgtggtagaaaagaaaaacccattttctggggagaaattcaagccagctgcagaaatttgcataagtaaagagaagccaaatgttaatagccaaaacaatggggaaaataccttgaaggcatttcacagaactttgcagtagcccatcccattacaggcctggaggcataggcaggaataatggttttaaggcaggcccagggccccaccactctgtgcgacctcaggacactgctccctgtgtcccagccactccagctctagccatggctaaaagggtcccagatacatctcaggctgctgctccagaggttgcaaaacagaagccatggcagtttccacatggtatgaagcctgcaggtgcagagaggacaagaattgaggctttggagcctctgtatagatttcagaagatgtatgaaaatgcctggatatgcaggcaaaagtctgctgcaggcgcacagccatcatagagaacttctactaggggagtgtggaggggaaatgtgaggttggatcccccagacagagtccccactggggcactgcttagtggagctgtgagataagggctaccacctttcagaaccagaatggtagatccactgacagcttgcactgtatgccttgaaaagccataggcatgtggcccatgaaagcagccacagaagctgtaacctgcaaagccacaggggtggagatgcccaaggcattaggagcccagcccttgtatcaccatggcctggatgtgagcaatggagtcaaagcagattattttggagctttaagattaaatgactgacctgctgggtttcagacttgcatgaggcctgtagcctctttgttttggctgatttctcccttttggaataggggtctttacccaatgcctgttcccccattgttatcttggaagtcaataatttgtttttattttatttattttttttattttacaggctcaaaggtagaagggtcttgactagtctcagatgcgactttggaccgtgaacttctgagttaatgcttaaatgagttcagacttgggggactgttgagaagggatgattgtattttgcaatgtgagaaggacatgagatttgggaggggccaggggcagaatgatatagcttggatttatgtccctgcacaaatcttatgtcaaattgtaatccccaatgttggaggtgggtcttggttgggggtaactggatcttggagatggacttcccccgtgctatttttgtgatagtgagtgagttatcacgagatctggttgtttaaaagcgtgtagcacctccccgtttgctttcttcctcctcctacggccacgtaagacacacctgcttcccttttgccttctgtcataattataagtttcatgaggcctccccagccatacttcttgtacagcctgcagaagtgtgaatcaattaaacctctttttgttatataaataactcagtctcaggtggttctttagagcaatgtaagaatggactaatacagtcagtgagctttcagactgactctcaaataatttataaatttccagctatttatattgtattgacatttgtgaatggcaccttttctcactatattgttattgctagtctataggaaagcattgtttctttattttcctttttaaattttattttcaagatgtagagcaaaaatttatgttactgggtttttgattgttctgatacacagacattgtgaagtaatcaccacaattaagctaattaacatatccattacttcatgtatgaagttgtgtgtgtgatgggaagacttatgacctactctttcagcaagtttcaaatatacattattaactatggttaccatgctgtacatttaatctcaagaatttgttaatcttataaatgaaagtttttactctttgacctatatcttcccattgcccccacactcaaacccatagcaatcatctttctactctttttctaagggtccaatttctttaaattacacatataaaagagatcatgcagcatttttctttctgtgtctagcttattttacttggcataatgtcctccatctatgtttttgcagatggcagaatttccttcttttttaaggctgaacaaaattcgtgtgtgtgtgtgtgtgtgtgtgtgtgtgtgtgtgtgtgtgtgtaacctacaatttctttatccattcatccactgacagacatttaggttgtttccatatcttgactattattaacaatgccacaaggaatatgggaatgcagatatctctttggcatactgattttaattccttttttaatagtcccacatatacccattatagtgcgattgctgtgtggtagttctgtttttcgttttttgagaaaatgccatgccctaatgtctctaccaattttcagtctcatgatgagggttctcttttctcctcacctcagtaacacttgttatcatttggcttttttataacagcaatactaacagatgtgaggtggtatctcatcatggttttgatttgcagttccctgatgattagtgttatttagccctttttatatacctgttggtcatttgtatgtcttccttggaaaaatatctatgcagttactttggtcatttttaaattgggttatgtgtgttttttgtaaatattgaattatatgagctctgttatatattttggatattagccttctagcagatacatggtgtgcaattattttctctcattccataggttgccttttcattttgttgtttcttatgctgtgtcaaaactttttagtttgatgtaggcttgtttggtttttttttttcccttttggttgcctgtgatttgggagtcatattcacaaaatcactgccaagatcaatgttaaggagcttttttgttatgtgttcttccagaattgttacattttcagggctcacatttaattcttattccattttaagttgatttttatgtatggtttaagattaagggttcaatttcattattttgcatgtggatatccaattttcccaacaccatttattgatgactgtccttttccctttgtttggtcttgatgcctttgtcaaagactagttgaccgtatgtaggtgagtttatttctgggatctctattctgttccattagtctttgtgtctgtttttatgccagtaccatattattttaattattatcatagctcttcagtacacttaaaaatcaggtagtatgatgcctccagctttgttcttttgctcaagattgctttgctcttcctggtaccataaaattttagaattatttttctatttctgtaaagaatgtcattgggattttggtgcagattacagtcattcaacctgtagatcactttgggtagtgtggacattttaacaatactaattattccaatccatgagcatgggttatctctcaatttgtgtcatcttcaatgtctttcatcaatgttttatacttctcagagtatagatctttctcctctttaaatttattcataagcatttttattttttttgatgttattgtaaatgagatttttaaaagattttcattaaagaaactcactgttaattcaatattagtgtatagaaacatgagtgatttttgtatgctgattttgtagcctacaacttcactgaatgcattagttctaactgttcttttggtggcattttttggtggcgtctttagggtttttttttttacatacaggaccatgtcatctacaaatttcacttcttcctttccaatatggatgtcttttgtttccttctcttgactaattgctctggctaggacttctagccctctatgctgaatagaagtggtaagaatgggcatccttgtcttgtgtctgattttagaggaaaagcttttagcttagttccatccactgtcaaggatgatgttagttgcagccttgtcatatatggcctttattatgattaggtacatttctctacctaattggttgggagtttttaatcatgaaaagatgtttcatggtgagacagataaaaaattgtcaacggtggggagcactggtttatgtatattatcttgctgccctgttggaagattattaattctaatcgtttatcagtcagttatactgggttaaataaatcatttagtttttcaacattcaaaatttatcattttatattgttttaaagaatgttttgattagcacttactgaacaattttaaatagatttagcactaaatacagttgtccatactgaaccttagtgggaatgcctctagtttttcacatgtaagagagacttaactatttttttttttaggcagataatatttaacctgttaaggaaacattggggattaaggttcttatattaagtcagttactattatttcctggatctttcattatttaaggtgcaaccaccacccccattctgcaaaacacagccatatatttcgtcaagacagcattacatcaaccagtaggactctgctctccacaacatggatatctcacaattggcattcgtaaagtaaaagaacaggattgaaaagaaactcattattcttattcttgtcatgatcaatccttccaagtttacttaagatcattccagaataaattatattaatagataatttttaaggaagaagtccatacattgttcagctcaaggtcatgtgtttttagctgaaataaaacacaatacaaatggcaaaaagctttgcttatattgattgattattttcattcagagcgtaggaatcaaataagatcaatccatatgtactagaagcaaccctaagaagctttcatacatttcatgtatggttacccaggaagtaaacatcacacacactgtggtttcagtaattgaaatggctgctaatgtggctccaggtttcccaagttgctactttttttttctttcaatgatgacacacactcatttggtttctaatacgggacgtactgagtcagcgatctttgacttatttccataatggtgtcataaatgttgcacctgcagcagattattctttgattcagtaaaaaaaaaaattattttagttttaaagtagctctgaatatttccattccaaatctgtttcaggattttagaattcagacatggttacataaaaagagaaccataaattggcatgagactataaattacagtcaaagaagacccacgtttcaagcaagatgaatctggatttttaaaatttttatgcatgctttttcagttttaattcatatatacgttacctagaaatacaatcaataagtggttttatgtctctcctctttaattctgtgtgaaatgttaccctttgcaatggtcttgttaaacactctagaaaaaaagagcagtctaagctgactttataaaacctctacctttgttcagcccaaccctataccatccctgcttctatacccctgctgaacactcccagaaaaaaaaaaaatatactaatgtgaaccagagtcactatgcaacctcatttttgccctcagtgtattaggtaaaggttctttgttttccagattctctctgtcagtcacggcacaagttattccaaacacacattgcactgttaccaccaatgaccccaccacccaccaatttcaaaagataactcatgctcctactgatccacgaacagtggaaactcattgacaggaaagtcttcaccctctctcttatcgcaggtgagtgttaatgcagagccacaaaagatgcacaactaccagctttgtaactatgcaagctccgtaacagtgaggaaaggaagtcaatgataaaacagtccatcccaaaaattctgagatgcacatttcttcaattttaatggttctgaaatcagtataaagaagacaggcagtgtcttcttacaatcactttcggccagatggtggccatggcagaattctcaaacctagcacaggtgagaacttggccctctgcgtatcattcaacaaacgctctaagggctttgagttaggaatatcagttagggctgttgtctgaaaacattccagtgacatattctgatgagaccaagaaaataaaacttgaagaatgtgtctcaacagcttgtaagtcaagcacagaaggcaatcgtgaaacacttcttaaaaatgtcctgcagcctcaccacttttcatgtcacagagggtggcagtgtggggaaaatgaagacactgatggctcagcatcaaaagtgattcagaagagaaagacagtggaatattttttgggaattctcagtcaccttactgaactcgtattttcattttttaaagaatgtgcaacaataatataatcatacatgataaaaatttatatctagataagtctaaaccagcttttccaaaaggtataaaataaacacgtgaagtaataaaaaagcattgtgtcctacttttcatgctaacatctttgtatttagctatctctctctctgtttccttccttcttctttctctctcctgtttctctctccttcctgccttcatttcttcctcccttcattcttttcttcctttcttagtacataaaataaccgtatgtattaaattcaaagtgtctcaggttttatgagttggcaaagatttaaatagtgctagttaattctgaccattagtcaaacaattagtgacaatcacactaaagactgacaatacaaattgcaatttttcagattagtatgctatttaagaagtacattttgaataacttcaatgggcacatcaatcaaaataatttttaaaaatcattttgataaacctattgtgcataaaactcaaatacctttaaacttaaccccaagtctcagtatcacacaatatatgcatgtaacaaagttgtacatgtacccccgaaattagaagttgaaattataaaaaggagaaaaagaaaaaacgtaaacaatgcttcatattttgaatgatacaaaaacctaagctgcttcttaactttatgacttttgttatacagatggttataattctatttaaagtggttgaaaatcattttctccaaatcatcatccagaagaacactttatttttattactaaagcaaatttttatttttcaaaaattaattgctatattcatattttaatctattacacaagtatttcctgaaaacctatattcaaattatagtaagcttcctcttcaagttttatgaagattgtgaaacttacttacattattacatctttttaaccaagtaagaataaaaaaaaattcttgaaaatatcttgtatgcatgtgtgtgtgttcctgttgactcatgatccattgccttcattacataaacctcgtccaagtaacctttcacaggtgaggaaaatataattgctagcaggtgagaagcaagagcaagatgaagaactaaatctgtattaatttccctaatacatgtcagagatattgtgaatagctcggtgacagtggtgcattctgaatctatctgttgttctccagcagatcagatgcagtcaagtcaaattactgacaaccaaggaataaacagaatccattatgggaaagctcttatttcctggcttcctgtgctatctgtattgttgtattccgtggaaactcactaaactgaaaaaaactgacatccctcatctttgtcaaggccataaaaacattacagtcaatgtcttgaactcacttaagccccctggcttcacgcactcagcttgtaagctttccataaacgacagctgattgctgaggggaggaagtgacaaattagtgaattaaaaatttacactgcgctatatgaatacatttcctgacaatcagcattactggctgctaaaatgagtttcaaaaagatgtacagaccttgaaattttcaatcatagttttatctaataacacaaatcacgtttttatttagtttacaaaggactactgaaaagaatttagagatcaattatgaattaaatattatcataaaacagagcttataaccagatcacatttagcaatcatttgatagtttaataaaaacttttaaaaattcatttcagtcaattgtgttttaatggtagattatttacttgcaaatgtggttcaccctttgtattcacggttcctcatccacagattcaaccaacggcagatcaaaattatttggaaaaaaattttaaaaataaaacaatacaaataatacaagtaagaaacaatacattataacaactattttcatagtatttacattgtattaggtattataagtaatatagagatgatctgatgtatacaggagaatgtgcataggttatatgcaaataccacatcattttacataagaaacttgggcatctgtgaattttggtatctgcaggtcctggaaccaatcctcctcaaataccaagggcgtataccagcaagactgtattcttaatatagtatatgcaattaaaatgaatccttaactcctatagaagaataagttcacgtgtggactgtagacttgaaggcatcattctcttgtctggtgcattatagctttcaagtgttagcatgcacattgatgcaaggacatagagctgatccatggctctatacccagaactagaacaaggaaacatggaacaaggactcctgatgcctgctcaatagactctccctacacaggtgcagtggctgctccataccatccagcatatgacacgttaaggccaaatgcaactatgatcagggccactgtttcctgcattagggcctcgtgttttaatgctctttttctccttgtctcttcaaggactctcttcagtggtccaaagcctgagaacagttgcttcatatatttgtctagttttataactatttatgtcatgagtgtacatcagctaccagtaacgtctttatgaccagaagcagaattccaggcaaacacatgttaagaagggttcttactgtagtagtaatagtatataccactttgaagagaattgtaaacacttaacgggctagaatattggatacttatcctgaagtagtgagaagacaggatgaaatcagattttgaacttctttagctgtcaataaagagtctttattagattagcaatggagaagctttaaagaaatttgagctggtgggatgagctcagcagtttgtgcttgaagaagtttaatctggctgaatttatcaggcaatagtaatagaatgagatgtccataggcagaccaggcaagaagctgctacctgaggtcacaaggccatgaaaaaggatgggggaaggagaaatttaatgaaagaataggaacaagctacttcatgaaggtctgctatttgatgagtatggtacgagaaaagtataagttaaagtactatcaaaagtgttgagcttgcctgatttaaggagaaagagaacaatcaccggacagaagggatatctgactctgggaacaattacattaatgatatcattttgactttgaggctggtaagatgcctaatgttgaaagaggagatgtccagatggaaatgaccagtagatgcctaaaaatacgggtcttcagcctctggagtaggctcagtttcccaaaaatctgaggatttcatatacaggtaggcaatgagtgagttacagaaggaaacaaatgggtcattggtataaaatagaatttgggaggaaaaacaagttgagaaagagaagatggtgacattgaacgtgtttcaattattgatagtggtacccttaaaaaagtcacgtatttaaaatattagtctagtttgcatgtgtgtgcatgtgggcatgtgttgcaagctgatataataaccttaaaaatgtcttagttctaatggcataaattatccagatgataaagtaaaataaagttaaagtacacaaatctatgtaggatcaatataattaaaagtaacatttaatttaaaaatcttgagaaaaataacaaatggaaacttttaaagaagaatgtgagagttgaaaatgtggcttgatttctgaaacatggctactcagttgctagatcagagaattatttgagtaatatttatcaaaaaacaatgataatacttgcttttaatgaaaataggcctctttccatttttggtagccacagtgagtggctttccgaatggcctaacatagatacaacttatcacccactttagatgtgtactgttataaagctctcttgtttacataattttaaaactttattaaattaattttgagataatctaattaggtttcaggaaaataaatgttgagaaatacaaacttcttaaaagatcagattaaggaaagtcacagacttgaaaaaggtgtcatttcaagagatatgtaggctatggattccacaagacatggtgcctcatttaacaaatcaggaaactaagttactagaaggtcccataagctacttattaagaaagtattactatttcagttctgttacttttttattgcaaacttttgcaacatctacttaaccttctgaacttgtttctcatctctagaataagcgatctaagatgtcttccaaataacatcataggacctatgtgacgaaatggcttttgtgcctttgtctagcactcttcccaaacctacaggttcatgcttacatctaactccttactatcattaatacagatctttaaaaaaaaatcatcaatttcctagtaacttttgtaacaactgctttatttgggtttagctagaaaaagaaataagcaatcatcatacatgtctatttctgttccctaaggattatttgctttttaaatttttttccgataagctgaataaatttttctttttatgtctttcttggttttatatatgtcacggactggtaccggctggtagcctgttaggaactgagtggcacagaggaggtgagcggcaggcaaatgagcattaccgttcaaactctgcctcctgtcagatcagcagcggcattagattctgtattagggttctctagagggacagaactaataggatacatgtatatatacacacacacacaaacacacacatatatacacacacacatatatacacacacacacacatatatatacatatttctgaaacatggatacatagttcatatatacatatatacacatatttatgtgtgtgtgtatatatatatacatatatgtatatatacacatatatatgtgtatatatgtgtatatatacatatatgtgtatatatgtgtatatatgtatatatatacatatatgtgtatatatgtatatatatacatatatgtgtgtatatatgtgtgtgtgtgtatatatatatatatatagacagagagagagagggtttattaagtagtattaactcacacaatcacgatcacaagatcccacaataggccgtctgcaagctgaggagcaaggaagccagtctgagtcccaaagctgaagaacttggagtccaatgtttgagggcaggaagtatccagcactggagaaagatgtaagctgggaggctaagccagtctagacttttcacgattttctgcctgctttatagtctagccatgttggcagctgataaaatggtgtccacccagattaagggtgggtctgtctttcccagcccactgactcaaatgttaatctccttcggcaacaccctcacagactcactcaggatcaataccttacatccttcgatccaaccaagttgacactcagtattagccatcacagatggatgcataaactctactgtgaactgcgcatgcaagagatctaggttgtgcaccctctatgagatgggacagtttgggcagtttcatccccaaaacatccccctgcctccccatcccaaaaccccgtccatggaaaaactgtcttccgcaaaactgggccatggtgtcgaaaaggctggagatttctggtctacatgaaagctgccagtaaacaaataaagtggataaaatatttctagtctgtactcacttgagaaggagcacatcagagcattatgtcaagaccaggatggtattaagccatgtgttgtgagaatgagaagtgaggaaggcaccaaatgattcctagctatttttaagatttttgttttaagaaatgcctctagtcagggtctaaggaaatgcaagactccaacacagcacccacaaagtcactgcagatggcctgccatacatttgtactttctgtaaagtggtcgtggcatcataaaaaatgtgtctgcataattgatttgaaatataagactgataaaaattagatcaccctaatgttctccacttgtcattagattgatctatattaaaaagacaatcaaattttcccattaaagagaagatattcaatcatgaaattgagttttccattcctatctgcaatcaacattttaatatatacagcctgtcaataagtacagcggaaaatagagttatataactattaaggtgcttaatgagtagaacagagatattcctggaagaaaaagatgtctattcctggaaaacaatgaggaaaaccattaaaatatgatgtcttcctaacagcatgaattaaactacatatgtgtgtataaaatgcagtgatttcaattaacatgataaattcttttcttaattaccatccccaaatactctattccacagcagtatttagaaacaagagactaataaagccaaactttaaacttgtaaaaaccttaaaatgctttcccaatacaaagactgtataaatcaaagattattataattaaaataatccagaatacagtcataatttgacctaggaagaataagaaaataagtacaataaggtgtttgatatgtattataatatttaaagatatcctttatcattgtattcatagctaatagcattaagtaacttattatgcttctaaattatattagtttgtgaaattaaatttaatgatactaaaagggatctgattggcaacactccaaattagcatttcttagcaagccaagaaggtagaaaccatctcaagactagatgctatttcttcttcaaattccattagttgccaacatatttcaaagctacagggaacttaacacaaaaggtttagtctagaaattcattcagacctgaatgcctcagataaagctgctaatgaaaatgttattccataataatataaattggttgctaaccttgatacctttattcaaaatatctaccaaataattatgtacatactatattgttatcaatagaacattttttaaaagttcacttctgtgtcataccttgacaaacattaagagttttcagggctgactgtattaagacgacttaaaaattaaaatacaagctgggtgcggtggctcactcctgtaatcccaacactttgggaggccaaggccagcggatcacgaggtcaggagattgagaccatcctggccaacatggtgaaaccccatcgctactaaaaatacacaaattagttgggtgtggtggctggtgcctgtaatcccaactactcagcaggagaatcacttgaaccagggagtgggaggttgcagtgagctgaggaagtgccactgcactccagcctggtgacagagtgaaactatatctcaaataaaataaaatatataacttactttaaagtttgtaacataaactcatgaaagtaccaaaataatttatcatagaaaaaacatttgctcatttcctaagtttcagatggccttcgggttgagatccttttcatctaaattattacctccaattcatttcactcactatttcctccatggatacttatcagggaaagctagaattgataacttagtcttccatcctccacagaatgaagtgctccatcaggtcttgttcagggaatgaagtatgaagtcctctttattgttggattaagtatataattgtaaaatgaaagcaaattaattgtattgtgaaatcactgctttgaagaaagaatcctagtgaaaggaatgcctccccggaatgaaaattcatgaaatgttaatatttggtgtcacggggtttccattactcgagttgccagccttcttttgatggtgagcatcaaaagatgctgatggtgaattgaaattcaatttcccaaccagatttcctatgaataaataaactcacgcttgagtttacagataactgggttaatatttgctattggtgaatagtgcatctccgttcagagcttaatagagaaattgtgtagctcttgtatatgtggtgaatccgtgggctagctgggaaccttgcctgtgactttcagctccactacttaccagctatgagatagtgagcaagttattccatccagctgcttcactgaaagaatgcagatagtgatacctacattacagagttgtggtactggtttatataagtggttctgaataacatctagctttaccatatagcaagatagttcctgaaaacagaatgcctgaacccgtgtataaatcttactacattttcacaaccacaatgttatcatctttagggatttcacttgaggagaaaatagactaagtgacacaaggattttctcttgtttcattagtaatttggttttacaattcaatgctatacggaatatcatcttcaagcatggctacttcccagggagttttccagaatgacagatttatataatgtcttatatattcaatagaaaatatcaacttgctcttcttctctctatcttaatattgatgtgaaactgaaaacaaagtgaggtgtgtattcaggggccagttgaatcacaggaaagagaggcagtgaagaccctaaccctttcctgtctcacattgtttaaacacatttgctttgtccttccaagtggaccacaagggttatcctcctgtttcataaatatagtgttatgcttaagatatgacagcagaaatatgtaggggaaaacaaaatgcatcatatttttccttgataatcatcaatcaggaatcatatatattatgagcaaagaaatacactttccaaagatctaagcatgtactagatttgcatgcagtgaccatatgattattaaattttttaaacaagatgaatgtgtactacagaatgatagccaagaaggatgacacttaagccccaaacctaacattcagtggaatcaaggcatgtacacaaattgcaacctgaaataaactcatagcctgtgacataactgcaaagtttgtgcactgccaaaaagcacctggagaaagaggtaattcgaggctgtagttggactctcataggattgtctaagctatgcaccttggtctaaggctgtgtcttccaggaggaagaaacatcccaagtcagcagacttatatcaacccagaggggaaaccaaaccttagaagtccagaatgaaataaatacattaagaatgaaacacagataaatgaaagaattattttcccttgaaagattattgcactcttcagagaagctttaaagagttttcatagatgggattgtttcaatagtcacattacaaaatgtaaaacaaagttttcacagatcaagttgaaggaatatgtttggataaaagtaaaagtgtgctgtaatgcgatcataaaatggaactaagtctgcctgatcattggaattgttctctttatgccactgagtcttagagttggagcttgtgcttggcctgtttctgtaacgtatgagggaaggaaaccatttgagatttttaactactcttttgtaatgtaaagtgaatgaattcttctatacttcaaattgagagaatctgatttcttattttttctttttttaaaattatactttaagttctggggcacatgtgcagaatgtacaggtttgttaaataggtatacatgtgccatggtggtttactgcaccatcaactcatcatctacattagatatttctcataatgctatacttcccccagcccccaccccctgacaggccccagtgtgtgatgttcccctccctgtgtccatgtgttctcattgttcaatgcccacttaggagtgagaacatgcagtgtttggttttctgttcttgtgttagtttactgagaatgatggtttccagcttcatccatatccctaaaaaggacatgaaatcatcctttttatggctccataatattccatggtgtctatgtgccacattttctttgtccagtctatcactgatgggcatttgagtcagttccaagtcattgctattgtgaacagtgccgcaataaacatacgtgtgtgtgtgtctttatagtagaatgatttataatcctttgggtatatacccactaatgggactgctgggtcaaatgttatttctagtcctagatccttgaggaattgccacactgtcttccccaatggttgaactaatttacactcccaacaacagtgtaaaagtgttcctatttctccacatcctctccagtatctgttgtttcctgactttttaatgataaccattctaactggcgtgaaatggtatctcattgtggttttgattgcatttctctaatgaccagtgatgatgagcattttttcatatgtctgttggctgcataaaaatcttcttttgaaaagtatctgttcatatccttgcccactttttgatggggttgtttctttacttcttgtaaacttgtttaagttctttgtagattctgaatattagccctttgtcagatggatggattgcaaaaattttctcccattctgtagattgtctgttcactctgttgatagtttattttgctgtgtggaggctctttagtttaattagatcccatttttctattttggcttttgttgccactgcttttagtgttttagtcatgaagtctttgaccatgcctatgtccagaatggtattgcctaggttttattctaggtttttatggttttaggtcttacctttaaggctttaatccatcttgacttaatttttgtataaggtgtaaggaagggatccagttccagctttctgcatatggctacccagttttcccaacaccatttattaaatagggaatcctttccccattgcttgattttgtcaggtttgtcaaagatcagatggttgtagatatgtggtgttatttctgaggcctctgttctgttccattggtctatatatctgttttggtaccagtaccatgctgttttggttactgtagccttgtaatatagtttgaagtcaggtagcatgatgccctagctttgttctttttgcttaggattgtcttggctatgtgggctcttttttggttccatatgaaatttaaagaagttttttccaattctgtgaagaaagtcaatggtagcttgatggggatagcattgaatctatcaattactttgggcagtatgcccattttcacgatattgattcttcctatccacgagcatggaatgtttatccatttgtttgtgtcctctcttatttccttgagcagtggtttgtagttctccttgaagaggtccttcatatcccttgtaagctgaattcctaggtatttcattctctttgcagcaattgtgaatgggagttcactcatgatttggctctctgtttgtctgttaatggtgtataggaatgcctgtgatttttgcacattgattttgtatcctgagactttgctaaagttgcatatcagcttaaggagatttgggcttgagatgatggggttttctaaatatacaatcatgtcatctgcaaacggggacaatatgacttcctcatatcctaactggataccctgtatttatttgtgttgcctgactgccctggccagaacttccaatactatgttgaacaggaatggtaagagatgacatccttgtcttgtgctggttttctaagggaatgcttccagtttttgaccattcagtatgatagtggctgtcggattaccataaatagctcttattattttgagatacgttccatcaatacctagtttattgagagttttagtaggaagggctgtggaattgtgtcgaaagccctttctgcatctcttgagataatcatgtggtttttgtcattagttctgtttacgtgatggattatgtttattgatttacatatattgaagcagccttgaatcccagggatgaagccgacttgatcgtggtggataagctttttgatgtgctgctggattcagtctgccagtattttattgaggattttcgcagtgatgttcatcagggatattggcctaaaattttcttttttggtgtgtctctgccaggttttgatatcaggatgctgctggcctataaaatgagttagggaggattccctctttttctattgtttggaatagtttcagaaggaatggtaccttccgctctttgtacctctggtagaattcagctgtgaatccatctggtcctggactttttgtgattggtaggctattaattgctgcctcaatttcagaacttgttattgatctgttcagagattcgttttcttcctggtttagtctttggagggtatatgggtccaggaatttatccatttcttctagattttctagtttatttgcgtacaggtgtttataatactattctctgatggtagtttgtatttctgtgggatcggtgctgatatcccctttatcattttttattgtgtctatttgattcttctctcttttctcattagtcctattttgttgatctttttaaaaaaccagctgctggattcattgatttttttttgaagggtattttgtgtctctatctccttcaggtcttctctgattttagttatttcttgtcttctgctagcttgtgaatttgtttgctctggtttctctagttcttgtaattgtgatgttagggagttgattttagatctttcctgctttctcttgtgggcatttagtgctttaagttttccgctacaaactgctttaaatgtgtcccagagattccagtacattatgtctttgttctcactggtttcaaagaacatctttatttatgccttcatttcattaattgctcagtagttagtcaggagcaggttgttcagtttccatgtagttacgtggttttgagtgagtttcttaatcctgagttctaatttgattgcactgcggtctgagtaacagtttgttatgatttccattcttttgcatttgctgaggtgtgttttacttccaattatgtgtcaattttagaataagtgtgatgtggtgctgagaacaatgtatatactgttgatttggggtggagagctctgtagatgtttattaggtctacttggtgcagagctgagttcaagtcctgaatatccttgtaaattttctgtctcattgatctgtccaatactgacagtcggctgttaaagtcttccattattattgtgtgggagtctaagtctctttttaggtctctaaggacttgctttattaatctgggtgctcctgcattgggtgcatatatatttaggatagttagctcttcttgttgcattgatccctttatcattatataatgtcctcctttgtctcttttgatctttgtggtttaaagtctattttatcagagacaagactaggattgcaagctctgctttcttttgctttccatttgtttagtaaatcttcctccatccctttattttgaaccttccatccctttattttgaacctatgtgtgtctttccatatgagatggtctcctgaatacagcacacagatgggtcttgactctttatccaatttgccagtctgtgtctttaaattgggggcatttatctcgtttatatttaatgttaatattgttatgtatgaatttgatcctgtcattatgatattagctggttattttgccccttagttgatgaagtttcttcatagtgtcaatggtctttacaatttggtatgtttttgtagtggttggtactggttattcttttccatgtttagtgcttccttcaggagctcctgtaaggcaggtctggtggtgacaaaatctctcagcatttgcttgtctgtaaaggattttatttctccttcgtttatgaaacttagtttggctgcatatgaaattctggtttgaaaattcttttctgtaagaatgttgaatactggccccccatctcttctggcttgtagagtttctgctgagagatccgctgttagtctgatgggcattcctttgtgggtaacctgacctttctctctggctgcccttaacattttttccttcatttcaaccttggtgaatctgacgattatgtgtcatggggttgctcttcttgaggaacatctttgtggtgttctctgtatttcctgaatttgaatgttggcctgccttgctaggttgggtaagttctcctggaaaatatccagaacagtgttttctgacttggttccattatccctgtcactttcaggtacaccaatcaaatgtagatttggtcttttcacatagtctcctatttcttggaggctttgttcatttcctttcactcttttttctctaatcttgtcttctcactttatttcattgaaatgatcttcaatctctgatatcctttcttctgcttgattgatttggctactgatatttgtatatgcttcatgaagttctcatgctgttttcttcagctccatcaagtcatttatgttcttctctaaactggatattctagttagcaattcgtctaaccttttttcaaggttcttagcttccttgcattgggttagaacatgctcctttagcttggaggagtttgttattacccaccttctgaagcctacttctgtcagttcatcaaactcattctccatccagttttgttcccttgctggcgaggagctgtgatcctttggaggaaaagaggtgttctggtttttggaattttcagcatttttgcaatggtttctccccatgttcgtggatttatctacctttggtctctgaagtcagtgacctatggagggggtctctgagtagatgtccttttagttgatgttggtactattcctttctctttgttagttttccttctaacagtgaagccgctctgaggcaggtctgctggaatttgctggaggtccactccagaccctgtttgcctgggtatcaccggcagaggctgcagatcagcaaagattcctgcctgttcctccctctggaagcttcgtcccagagggacacctgccagatgccagccagagctctcctgtatgaggtatctgttggcccctactgggaggtgtctcccagtcaggatacacaagggtcagggacccacttgaggaggcagtctgtcccttatcagagctcaaatgctgtgctgggagaactgctgctctcttcagagctgtcaggcagggacatttaagtctgctaaagctgtgcctgtagccaccccttcccccaggtgatccgtcccagggagatgggggttttatctataagtccctgactggggctgctcactttttttcagagatgccttgcccagcaaggagaaatctagacatgtggttcaccttgctgagctatggagggctccacctggttcaaacttcctggcaggcttgtttacactgtgagggtaaaaatcacccattcaagcctcagcaatggcggacgcccctcccccaaccaagcttgagcatcccaggtagagctcagactgctatgctagcagtgagaatttcaagccagtggatcttagcttgctgggctccataggggtgggacccaccgagccaggtactggagggagtctcctggtctgcaggttgtgaagaccttgggaaaagggcagtatctgggccagagtgttccgttcctcccagtacagtctctcacagcttcccttggctagagaagggaaatcccctgaccccttgcacttcctgggtgaagcaacaccccaccctgcttcggctcaccctccgtgagctgcaccctgtccaaccagtcacaatgagatgaaccaggtacctcagttggaaatgcagaaatcacccaccttttgcatcgatcttgctgggagctgcagaccggagctgatctatgaaactaatataaagtccacaaacttgtacacgtaaggccaaatttcttctcattttccagtttatcactttaatactcatgggttttacaatcagaaaatgcagggcctctattctgagaacacatcactctcaaatctttcagaaattctggaacttacacagtctttttatatgagataaatcacattttcccacccaagcagggagtagtagagaagacagaaagcaattgctgtagattttcacttcctatagttctttctctaaatagttctctctcaattaatttatagatatagctattattacgcagatgaatatccagatttaaatcccaatatgttataaatgcatttttgtgggttttgtggtctttttatttttatttgtttagaaaatctgctttaatggttaagcaaagacttatctgaaattgcagtaaatgattatgcataagttttgggttttatgagttaaaattaatttgtgacatggttgctttacatatggaaattcagtctaatctttttctcatactttaaaatcttattctgaaggctgggttttattgttttgtaagttttgtaatggcctcaagcccaaagcaccataaatttgaattggcattaccatgctgatttattcaatattagaaaggtagctaatttttacatgaaaagtgaaaagggaatttatgcaagacatttataacttcagataaaaaagaaaaataaatataaaactgataaatagcgttatctaaatgtttgtttgaggctctatgatttatcagcatatgagtcttaaatcagagccacagagagagtgaagtgtccaagtgttggcttaggggtgagggttttgatttgtgcatgtcctctatatcataattatgactagattgacaagtcctgggtatattcaacctcagttttaaatatgaagccgaatttattcacagaggtttgggaaacagattaagttaataccagaaaaagtccttcttaaattacaataagtaaatgtagtgagttttttattcccaagcaagtctacagtgtggttactctaagtgttgattctttgaatatcttttgaattccaaatacaagatacaccagtagactttaaagtgaaaccatatctacagcttttcctcctaagaaaataatccattggctttcaaaattatagcaaggttaaaagacagtatatgagataaaaatatatgccacgttccattatggactttctaagctatttaatgaaaacagatttttttcacatatgcatatattttatcacttaacttattaattttagcgtagttttaggttcacagcaaagctaaaaggaaggtaccatgatttcccctatacttcctacccccacacatgtatagcctccctcattatcaacatcccccaccaaagaggtacaattgttataactgatgaatctacagtgacacaacataatcaccaaagttcatagtttaccttagggttcagtcttggtattgtgcattctatgggtttgaagaaacgtataacaacatgcatagataaactcatgtacatgaatttctgtagcgttagagttgtttcattagaagtgggattgcggagtcaaaaggtaaatgcatatgcagtttttttgtttgtttgtttggttggttggttggttggttggttttgagacagagtcttcctctgtcgccaggctggagcgcagtggtgcaatctcagctcactgcaacctctgtcccctgggttcaagcaattctcctgcctcagcctcccgagtagctgggattacaggcacatgccaccatgcctggctaatttttgcattttttaagtagagacagggtttcaccatgctggccgggctggtctcaaattcctgaccatgtgatcctcctgcctcaggcatatgtagttttatcagatattgctatattctttccaatggggttattgcaggttgcattcccccagcagactctaaaggaaggcagaatttttgaggtgcctaaaatatttattcaaactaagattgtcaatgaaagtattctgaaacggacggaactgaagaaaatttaaacatttactcaaaaaagtagaaaaaaaggcatttgatatgcaatattcatactttaaatgggaaataagccaatcaggtaaactaatgtatagcagaacagaaactcactttccatagcaccagcccaatccctgttttaaccgtgatacccaattttcaaacagccactggcactgcccatggagactgatctccatggaacctgtgtttgcctggcaagtgcagacattctgaatccaagtagggatgaatgccatttgttagcaagtgcagtgggagggaggaaaggcaaccagcgccctcagagaaaccagagtggggcagttcttgttcctcacagaaccccatcttctctcaccacctctgtgtaacctgacccccctccaatttttaactctttttaaatttttgccttttgcctctgaattttgcgttcaccagtccttaaaaatcacagaggacccagaagagattttaatgtagcaacatttttttggaatgaaacacttataaatttactaaatataaatgttaaaaaaactgttacagcatatatatataaactattacatcacatatatgtgtgtgtatatatatgtgtgtgtatatatgtgtatgtgtgtgtggaggctttgttcatttcctttcactcttttttctctaatcttgtcttctcactttatttcattgaaatgatcttcaatctctgatatcctttcttctgcttgattgatttggctactgatatttgtatatgcttcatgaagttctcatgctgttttcttcagctccatcaagtcatttatgttcttctctaaactgcatttgagctctgataagggacagactgcctcctcaagtgggtccctgacccttgtgtatcctgactgggagacacctcccagtaggggccaacagatacctcatacaggagagctctggctggcatctggcaggtgtccctacacacacacacatatataacattttcaattgcttagatactgttttcctaactttactaccttttaggtataaaaacagctttacagaacagccttccttctgaagagacaaccattattaggttaggtacttaagtccatattacagcttcatattgtctccctttctatgtcacactcaactctgtcccaaatactaaaaaaagaggtgagaaattcttagcatcctggtagtgatttacacgtatcatatatctttagtattgtcaatctagggtttttagcacccaatttatgggggcaggggttaaggaggaggccagtggggtgaaagtccgtgagttaatataatgaggaagagctcgcaaaagagatgagcatttatgagtgacataaatctctgaagtttaagaacagcacttagcatactaaactgtccaaatagtccttgaatgctgacaaacggttcgtaaaaagttaaaaaaaaaaaaaaagacatacattcttcagagctattttttcaatacctgaaaaaaatcctgtaatcccatattggtttgtgatacatgttatcattcctttatggagttttcaactcaaggtcagaaggttcttgagtcattcctctttggtgcagataagttgtattttacgttctactgcagttctctgccattcttcttgacttccaaatctcaagcttagaacatttcttatgaaatctatgacttccattaatatcaaacctgtttcccttttgtgtaaattaatatattaccattcaattatatttaagtttaccaaacatttctcaaaattatctcattctctttaaaagataatccaaaacttggtcctcaattagtttcttccattgtaaaccaatctttcctttctgaactggcttgcttaactgattgtatgcttactttttgattctgttaaatgaacttaaatttggcctaattctgctgctgtatgtagttaactgcaacctaacctagcgtgtcaaccaagagcaaaccaacttaagagtctattcttgcaataaatagctgtgtctcagccaatcacagtagccaagcttcaaccaatcacaagttgccaactgataagatcatgttcatataaggcaaatgcctcatcatatcttgcccaaatagggcaaacactgagctgtaaccaatcaggctgtttctacacctcctgtgcttttctggtctagaaatactatctgcccctgagtagagctcctggaacctctcctggttctgagagctgcccaatttataaactacttttgctcagataaactatgctaaatttgatttgtctgaagttttctttcaacagatctgactggttttccagtaaggtgataccagatagactactatagcgattatgattccttagaaatgaattaatataaagactaatgtgaagtagaggaaccggctttaagcaaaaatacttaaaacactgatagataataatgtgtttatgaaatgtgaacaacacacggttatgaaacccttgagttaaaaagggtacacaatgaaagcccatgtattcgagttttgctttaagtcattcaaaaaccgtgaaagggaacactacaagtaagttctattttgatcacagttgtgtgtggtttccacataaaacacctagatttcatcagtgcttgtccaatatcattaccaatgcttctaacaagtggtccagaatttgtggcaaaggtgatgtgaatctgattcaggaagtatcaagcagaacactgcaggagttccactcatattggaaatgtatttttggccttattttctactgggccaaaaatatcattctggttaacatcccataaacaggtagtgaaccaaaaagagggtgagagacttccttcctgatagtaggaaaaatattcactctaccacagaccgtggatgggtacaggtgtcagacagaactctgacaataagcagttaaacattacttggcattgacaatacaagaaaaaaaagtcagaattcccttcactatcaggaaaataatctagataggtattttagaaaactaatgtatcagatcaatccacttcctgccaactgaagttacctcctactctgatagaaatgtgtacttatttattattcaaatggttgcagcttaacaaatccgatatctatcaggaggagactaggttttctgaagcagtgacttcagaacccctgactggtattttacattaataaaattggctagagctctagacctgctgagtcaagagttaaaataaaactccccaaccagcaatccatcacctagatagtgcaagcggccacaatgctgacgatggagtctttgataggtgtccattgaaataaggaggactaattaatgctctgacaatcatcagccttcaataggaaattaaatgttattaagacgaagccctctagcactattgatcattgatatgagcagggaactgagcttaacatgaggtgctatgtccatctcacacaaattaatctagctaaaatactgcaaatcatgcagatcacgaacaaaattaaggttaatcttcctttagtaaagagtaacaaaccttattttaaagtactatattaagagtatggcaagttacagataagtttaaggaaaaaagtaaaatgttccggcctatatacgtgaaaaatccagagtactggagtttttggctcattggctccaggaacaaaggacaggtgtgtgtatgatcttttgccacccactccacatctcttacttccatttctttacttgcctctgcttggtcatattgatagatatacttattctacatggtgctgggatggacaccgatggttctggaattacattactctcaaacattgcaatctcagaggagggaaaagacttttgtttttcagcatccctttcgttctcatgggggactctgactggcccttcctgaaacgatgcctatccaggaaccaatcagtgtgatcagggagataagatcctagatgggccagtcatgaggcacacccctatcctggagaactgaaatgaaccattccaatagaatcacacagaatgactagttacctaaaggaaagggactgccaaaacctataactctactacacacacattatgtactcaatccattcaggtggtatttactgagtacctatatgggccaggccttgtgctaaaccctacaatgccagaaatatggagattaaaactgatgcttgtatctctatcagaattaaaatgctgtaattcattgaagtctcagttttataccatctttaggcccgttatgctggaccatcttattagcaggtttctctgaaacaaagtatgtaatatagtctaggaattgtcagccaggctgcttctcactccctcaggtgttaataactttcaccacaactcaaagctttagagttagtctttggattactgcttcattggctgcaatcaagtgggctcatttggtggtccctgtctttcccgacactcatgtgtctctttactttctgcacccaaatatgttaaagtctctacctaattaaacatgccaaccaacagcataatggtttgttgaattcaaccaaagagtacaatctcaccagtggctgctaatgatattagtaacgtatcctgttgtaggcactcataaaactgaggaatgacaacaaccagctccctgacctcatggaggcggcatcccagtgagggagacacaaaccaaacagctagtaacacattccttcgttattgtggtgattgtgatgaatgttctaaagcacaatcacaggaattacagaagaatagaatccaagcacataacttatcctgggagactagagattatgtttctcgagaaagggactttggaagtgtaacatgaaggaaagtcaagaattaactaggggacgtgggtggcaggagtgagggagaacgttccagacaaatggggcattttaaggaaaaactgtgaggtgtaaagaccacaggatgctgagaaacagggagaaggccagagcagggaaaagtgagaacagcaggtggatatcaccaacccctaaggcagctcttagataacgcaggaacacagacttacaataatgctaaggaattggctctttatccctagagcagtggtttccacactcaacaattttgccccccacccacacccccacatttggcattgaatggagacattttggttgtcatattgccacaactgtggtggtaggagtggggagggagtgttactgacacatttagtggaaagagaccagggcagctgctaaacaccccaccacgcacaggacatccccctacaacaaatggaatcatgctggcctgaatgggaagaatgctgaggttaaaaccctgtcttaaaacagcacaaggacctagaaaggttttcagcgagaaattatcatactaaaatgtgcattacgtgcacttaaaacaaccaaaatatcgttcctatcaggaaatgaataggaggaggagagtgagtagatgcgtgtgggctgaaaaaagaaagaacccaggaagtcagggcagaaataacagcacagagcagcaggtggactgcagaggaggtcaggatgaacagaggcaagacatgtcatggacaacaaaccaacaggcttgttcatcaccagccatgggagcaaggaaagggaaaggctccaagaaccactcttgtcattgtggccattaggtaaatagagctccaccactcactcacaacaggaatgctagtggagagaaagccacacactcagttctggacatgtcgagctttagctgtctgggatacaggagggtggagatctagaggatgagatggagggctgggctgctgatgccaatttagagatgtctgccatggccatgagtggtctcaatcaggaaggacagaatgagatgcgaagaagatctccagctgagcctggaggaattctacccccagttgtgtaaggaagaataaactggctaagaaaacagaagaacagtcagaatggtaagaggaaaaccaaaggagaataacattttgtacccaagaaaaatgtatttcaagaaggatggagtgttcaacagtttagaagagagcccagagataaatgagaactgaaccgtgtccacagctgacactccagaagtactcggatgaatctaaaggatgcagattaaagtctcctgaacataataaaagcattcaaaagaacatgaagtcaaaagcttgtgtctgcactgacatgtgccctgacttttcaggttccctttctctttcttggtttgtcttcttcagcagccctgatcttgctatttattccacatggcttctattgtgcatgtgctgaagtctctaagaaatcctgctcttgaggaaaaaaaaaattctttttccagtcccaacagggaagttaatgaagggataatgaatgcaatagaaagcataaagatccatttatttgtatatgccaacaatttttataatggcacaataatcttaattacagttatttatcacaacgtaattcctactgaccatgccacattgacacaattaataatttgatgtgtacttcctaaaacaaattggtttacacctatcagaaaggctgtgcttgccagctacctgcaagtttactaattacctgctttgaaaatctactgacctatcaggaaagggttaatttttctcagtagcattcctgtggtcaccatttgaagtaattatcacaacatagtaagaaacagacaagaaacagacaagctgtctacacatgagatgactggccttctgacacatgacacatgacacatgacacatgacacacagcatgctggccttctgtgcaggtaagtgcctgcttgtttttccccaggtaactgactgggagcagcaactggcctatctgtaacgtcctgccattgagacacagtgcagagtcatagagcatttgaattatctctggtttctacaaagaagacatgcatcggcggcacactggtttaacgtatcacagtttcatatgctcttcctagactctcagatctttatatgaaagttattctctgtgcctgaagccttgggcatttctactgggctggggacaatattttttagaaaccaacagatggaagcaagatgacagagaaagccgaggtgttgaaaattgcccttgcagcttaacatccaatattccacaggcgttccaaacacaacttattcagtagcatttgcacattatcacaacatccggatagattcctaaaaatgtgaaaatgtctactttggtcagcgaatgtgttctaaataaaagaattataccaaatgtatactggaaggatatttctttgtgtaaatttagagaaaaaaggttcctcctttaatttctttcttaacggatttttgctgtatctataaagatgcaacagatttggagctacataaatcataatacatttcatgatacatggaaggtgaacagtagaagagacacagttattattcttaattgcaatacagaaaattactgaacaccaaaaatgtacccagaactgtgtgaagggcaagtaatacaagggtccttgctcttggatggaaacacaatgcataaccaaaccaagaggcttcttagattggcatgtggtctgctgttctgataggatgaaaaacagaaacaatgaaattcaaaaaccctaccactgaaaatattacagaaatatgcaactatgaatgaggaggaaaaggtggaggaattagaatttgcaaactcactgtgtagaaaacataattaaataaagataattactaaatttattggaacagaatacatagccccacaatttaaatcacattttctacatcacttatttgccagtcaatgatgcatcgatttgtaatctcttctgtattttctgatggttcagtttgcactgctaatttatcgtgcacttctggggtttatccatctaactagtttctaacgcattttacccttcacttggaaatccacagacatgtaatggagactcaagacatttaaatattcttttaaaagcagtgtattagatagaatattaagcttccatgtcagaatgtaaactctaatgaggtgataaaaatttcactgaaagaattttaagtattctgagcaatgcacagactatttatcaaacagcagcagaaaataaataggcttcattactccaaacatttaacctctcttaagtcacatttttacacctcaattcatagtccataataaagccattaatagaatactcatgatccagtataaagacaatgatttctttttccgaaatacaaattaatcattttaaacaatccatagcacaacctaagttggcaatcctgtaactgttgaagaccgtctttgcacttacatggtactttgccaataattagtattcttcatttattttctactgaactgctctttataaagtactcaaagagaaaactaatgcatatcttcttgaacttttaagtgaaggcaaatattctctggaaagtgagtttctcatctctctccttcaaaaagccacttggaatcatataaacaagaaacctctgttgacaccctatggagaaacaacatataaagctgcaggcagcattaccatgtctttccattatgatgactggcagactctaggtcagagccctgagtcctggagcgctgcccatgtttcatttcctcactgtaacatgaagggttttgaggaaataaactctaagctcccaatagtcctaacatgttatgacagtaaaagtgctaggattgcatgattccagggaagagaataaaaagggtgtagacctaataatataccattatgatgtcgatccacttttaatcaagacagacagctactattaggttttttacacattatttatttttatttttattttttatttttttttttagatggagtctcgctctgtcatccaggctggaatgcagtggcacaatctcggctcactgcaagctctgcctcctgggttcatgccattctcctgcctcagcctcccgagtagctgggactacaggcgctcgccaccacgcctggctaatttttttgtatttttagtggagacggggtttcaccatgttagccaggatggtcttgatcccctgacctcatgatccacccgcctcggcctcccaaagtgctgggattacaggcgtgagccaccgcagccggcctacatgttatttttaatagaagagaaatagtgtaaatatttaatgagacatattttaaaggatattgtttcattgaaaaaaatgattattttaaattagggtagaacattcaatacactttattttaaatgcagatttccttctccaaactctatttcttccaataagatcaagtatattaagtcatatatccagtcagcaagttggtcatggcacagttagtacatgtactgtgcctcccaccttcttaattcctaacatgagtgtgaatgagtttgaagtttgaatgctgtagtgcttttttactatagtactctgttaggtgatctggtgattgttcctatagttgctatgtgcttggtcaaccactttgctaagtcatctcagctgtactactcgaggattttatgcaaatcagctccttcttcaactgccttaaaacaggaagcttttctctatttctgaaactccttgaacttccttccttagaatacttcccactatagtcaaacaagtaggaacaaagagaatggtccaatccttcttccctctacctgataatatagtaatcattgccgtgaaatcattaggctgatgcttcacagcttataaccttcatcttattcatagtgcaacctaataaaagggctattttgtcatctaaaacagtgtagtatcttcaattcctcatagtttagtataagtgcattgttactttagaaagtagattaccacaaaaagaaaaacagtactatgttgaccctaagacattttctttgtccatacctagagttacaagttcacatgaggggcagcagatgaagtgtatgtgtgaaggtgctgggcataagagctaagggagtcttggagaaaaaggtgaacacatattcagtcaaaacttgtccaatgtctttaaaaatgaaagcaaagtgtcagccatcatattaacctacaggtagttcacaatctcacctctcatgaattccttacaacaaatacataattacttgagctttctggttatttgagtgccaggtaatatttgattgtatgtgaactaggatcataatggtctactagttactacaacatagatttagggattgggatataacaattcattcaagtaaaacaaattcttctaacaatggcttacttttccaaacataaggattatattattaaactcaaccttttactctcttaatatggaaactctaaagactttgcatatatccactgaaaattctttaagttaaattccatcaacaaatcattcagatgctaacccaatcctactactacgaattgcaatttaatgaatacttgcaatattattgatctctacaaagagtatctcaggtaattccctcacagtaaacctatgtgagaattatttcccagtctagaggtgaggaaatgaagaccagaagttgtttatccttaatctttacattctctaagaataagtccccttagcattcaaatctatcacataaataagcgtaaagattcaaggaaggcctggcacagtggcttatgccagtaatcccagcactttgggaggccaaggcaggccaatagctttgagctcaggaattcaagaccagcctgggcaacatggcgaaaccccatctctacaaaaaatataaaaattagctgggtatggtgacatgtgcctgtagtcccagatactcaggaggcagaggctggaggactgcttgagctcaggaagtggagggtgcagtgaaccaagatcgtgccactgcataccagcctgggtgacaaagtgagaccatgtctcagaaaaaaaaaaagaaagaaaaaatatatatttaaggaaaaactcatgtgaagcactgcactttggaaaattctatagtacaaaagaggaggccatgggtaactctgtgaggcattacaagagccctgccaatgccaggccactccatttgctattagccataactgaccttaattttcagtcttgtccagcagcactaggaaggcaatcaatcttttgtcagagtgaactttttagggaagacatgtgctattcaattgtataataacaatgataatactatttctagtgaataaattatatttgttttttatatttgccacattcaaagacctctcccagaagtatgtgtgagctccaaaaaggggttctcagtagtcactaccttaggctccacatcaaagtataggtcttgctgatgaatagtagaaggagaagaaatgtaataaatttctaaatgtgagcatgttaaaatatttaacaatatactttattaatggaagtaatgcatatataattttttaacatcatgttaaatatattattcttatatagaaatatatgtatatacaatacacaaatataatacacataatataaatatatatttatatactatatgtatctaatatactatattatactataaacatatatacatactacatatactatatatttatataaatatattatctatgttttaaaatatagacaaaaatagaaaatgcagttaagaaggtaagaaaatggtatttttcatttcccatccctcccagggacgtgccctttataactacttgtgctatgattcagtccattttgccttcccagagtcttttaaactcaccctctctccccattttcaatataattcacctggttaagttctttgtcaatttgttgcctggactactccaataacctccaaactggcttcccaaacatactgattctcttcaatttattcttcatgcgatttccggagtgatctggctaaaacacaggtctgatcatgtcatacaatctcatccctgacctttgacattcttcaatgactgtcacatgtacccaactgcattgcaaaggcaacaaggggccgtgatcattggcctcctgcccacctcactggcctcaattccttgcactgcctcccacagtcatttccagggccccagataaagcatgttctctttcctacctagattctagggtatggattaagtatgtgggttccagctgcagtccacccagattcaaaacctgctgcccccacttagtcaccaaggtgtgggcaagctactacacctgttgaaactgcagcttctgctgtgatatggaggaggtagctggacctaaaacatggcttaggtgtgaggatcatcaagtgtatgaaatcattcctgcagagttttccatacagtacttggctcacacacagataatatctgtaggcctcctttccagagctaaaaatgcacacacttcacaagaggggaaaaatcttagccctcatggagcacgtgttctagtggagacagacactgacaagtataatacacagtgtgttggaagtaaaaactcccatgaagaaactaaagctggccaggactgccattttcagtaggatgggcagaaaaaacattaatgggaaagtggcattggaccaaagatttgtaagaggtgagaaggtgagccacacagaaatctgagaaagaaacatctcaggcagagaaaaccataaggcaaggaccctgaggtggggttgtgcctggagagtttggagaatagaaaggagatcaatgactggaaccgaattttgcctgggcgagtgataatgaaatcaaagagaaaagtggtggtggagcagatcatagtggtttgggggccatttgaagggtactggcttttactgagtgaagtggaaaagtatatgactgccactggctattactacttattaacgtttctgggaagtttcaagccaatcttccaagctggctcaagagcttcatgtctctgcccccagaggacatctgaaacctctattatggcacagcagtcccccacctgaactcccggaagacaaggctcaggtgttcatcttggtgtccccagcactctgtgggttactcagcaggcaggaatggcttaattaagaatgactttgagaagaccccaaaaaagtgtctgttccatagtgcactaaatatactctgtatgatcctaaaaatagtgatgggaaataagcatatgccttccgctgacatcatgtttgaattctcagcactttcagcaatacgatacagtgatgctggactattttgctaagattctttcattttacaattttgaaaaattcttgcatgggttatctaaatctgtttcaaaaataaccctgtgctttttacattttagtaactccattttccaaataaggaaactgaagcccaaaatatcaagtgacgagtggaagtctcagtcctataattcagaaacccaccacccaggagaagggccctgatgcttgtaaagaatgcaagaatgcatggctgcttatgacacagagagcatccctattaaaacggctgcagcacagcgagctgaagcaaggcagaaagagggagaaaacagactgagataatgcagcagcacttggtggtgaaaggaaacaaccaaagcaggaagaattccattctgcattcactgatcacagacggagttgcccttttgatgaatgacacagcgagggccacaaaataagaggtgctgccaagagacaccaagatgactgggaacgaacagtatcgatatcaaagttactactggtagtgcctattctctgtactgctgttttattctattgcatttttgttggattctaattccacagtagctgtagtatctctgatatggagcatagggcagctgtagcaccaatccaaaactaaccagcactgtacctgcacccagttaagactcagcatctactactgatgaagtcttagtcttattttttgttttcttacttctgggatctggtttcttaatctgcaaaaatgggaatgatggtgtctattttacagatttgttacagaataaataatgtggtagagtattaaaaatgatgaactgttctatgatggtaaaacataattaaaatctctcttctctccacatacatttgtgaattagttgtgttgccctcaaattaaataatactttactttataatcattctaaaatacatattaatttttctgccatctaaacaattatcaacacctaaaaacagaatcatactgcatacccatttcttagtgtcacttttcagtaaataaatcaatttgtgaatgctgttgtacagaatattgtcacttactttttttcacatatactgtatcatagtttcatgaagctaataatcactgtactgcagaaatagtctaataggtcttttattcaccacactgcttctgtattttattatggtgatattttgacacttgagaagcaaaagtggtgagacagtatcttcataaaaaaaaagggatcaattacattgaattaccttgaaaactaaagtaatgaaaatgatttccttcaacttaatatgagactgctgatcccatcatctctttccaatagtgcacatcgtaacacagcagaagctattttgttacagcagcatcaccacccatagccttgagtctaggacagtaaatgagcaacatgaatgaatcgccattcttcttccttcctacacagtactgtgaagaatacagagcaatagtcaaacatcaggggaaatctatcttgttctttcaaaaataataacctgagtttatattttaaaagattatcattccaagtttggagactttcaaattgcctcaattataaaacgacttaaatgaaagtgacaaagtcaaagaaaattgcactgtgatggggaaataaaatcagtgccaggaatgtgatggaagagaatagaatccaatgtatccaccgactggtgcaggaattcaaaatcatgtaactgttgacaaatatttaaacagcaacacatcagcttaaatgtacaactaaaaaataaaaacaaaaaaaactttcaaacgttacaaacaagaaagcatactattgcaaattgtatagtcctcaaatgctgcttcatttttacagtaacacagcgaagtgaagcaaaatgaaaagcacatcaggttctgtaactccttctattcacctacgatattagaggctctcacttaagaaatctatgctttcttgggaggccgaggcgggtggatcatgaggtcatgagatcgagaccatcctggctaacaaggtgaaaccccgtctctactaaaaatacaaaaaaaaattagccgggcgcggtggcgggcgcctgtagtcccagctactcgagaggctgaggcaggagaatggcgtgaacccgggaagtggagcttgcagtgagccgagattgcgccactgcagtccgcagtctggcctgggcgacagagcgagactccgtctcaaaaaaaaaaaaaaaaaaaaaaaaaaaaaaaagaaatctatgctttcagcaatatactcttttacaaaacaaaaaacttgattgcttataattattatataaaatactgctgcatgccctttgggcttaatatgaaattaataactccatgtagaaggatcacagcatattaacctgaaaacacgttgaaaatgaaaagtgaaattttagttaacaaaatgtaatgattgtgaccataatgagagctgcattgttttgtatttgtttttgcagtccatctaacagtgaggctccccaagataagaacaaaaaaatgtgaataatgcaaatatcttaaaagaaataatggccgggcgcggtggctcacacctgtaatcccagcacttcgggaggccgaggcgggtggatcacaaggtcaggagattgagaccatcctggctaacatggggcaactccgtctctactaaaaatacaaaaaattaaccaggcgtggtggtgggtgcctgtagtcccagttactcgggaggctgaggcagaagaatggcgtgaacccaggaggttggagcttgcagtgagccgagattgcgccacttcactccagcctgggcgacagagcgagactctgtctcaaaaaataaaataaaataaaataaaataaaataaaataaaataaaaaataagaaatgatatgtctggctaacagagcatgcaaagtggtctctggtatgttttgaaaattaccattttccccaatatacaagtactcaaccaaagcatcaactttttgaaaaatcagtttcatctaaaagatacacagttcagatacaaattatatatattttaaaagaaactttaaatatataataaagaaaagtaagaagcaagttggggtggctcacacctgtaatctctgttactttgggaggctgaggtgggaggattacttcagctcaggagtttaagaccagccctggcaacacagtcgtcccctctctacgaaaatattagttggatgtggtgttgtgcacatgtagatatatggcagtttgaggtgggaggatcactagagacccaggagttacaggctgcagtaagctatgattgcaccgctgcacttcagtctaaggcaaagtgagaccttgtatcaaaataaagaaaaacttagaaatgttttagttctcaattatgtaactatatttttttcatgtgctcagtgctcatattctatgttaacattttagtttaactggttctataaaatgtaaaggttacatagctaatcaacaaaaactgtatgattgaaactggtttaaaaaaaagttttcctaatatctaagaaacaccatacatctatttttttctgaaagaccatgcaatcatcaaaacactattttgcagcagctgcacatttaatactttgaaagcatggctgcaatgtattttgtgaattttaatcctggttaattctgggcacataactattaggggtttttattttttcccttttatcttaccttctttcagaaatttcaaacaaaaaaaaattttaaaaagtaaaagaatatgattcccaactcattataaaaacataaaaatcaaactggaaaaacattggtaaactatagcttgtgaaaacacaagtggccagatgcacagtgagacaggctgctgtctgtgtttggctttcttgatattacatttcttagaatttgttttatttgttaggcagcaaaacaaagcttggcaagaggataccacgtctgaggagagtctgaggatgtggaatagctcaagaggcagctgggtgtgtgatgagaagataaacgccattaggtggaatttggaaaactaggtcaacattttattttattttatttgagatggagtatcgctctgttgcccaggctggagtgcagtggcacgatctcagttcactgcaatctccatcttctgggttcaagtgattctcctgcctcagcttcctgagtagctgcaatttcaggtggctgccgccatgcctggctaatttttatatttttagtagagacggggtttcgccatgttggccagactggtcttgtactcctgatctcaagtgatctgccggcctcggcctcctaaagtgctgggattacgggcatgggccactgcacccagctgggtcaacatttttaaaagacttagaaagtctcactgaggtatgtgacaaaaatctcttcttatctccccaaaactccagtaagaatttctgtatttcttcaaagtttagtcctaaaacacatctgggttgtcaattttcatatattatacatataaattcagagtccaaaaaccaagaacattttaaaagttactccaatgtcaaactttggagtaatttaaaaattcctcgtaaggtgaaagggagcatgctcactctttccaccagatgaggacgcgggaaaaagacaccatctacgaatcagaaagtggagcctctccagaccctgaatatgccagtaccttgatcaaagatttcccagcccccagaactctgataaataaatttctgttattcataagccacctagcttatgttagtttgttatagcaaaccaaatggacagatacgcagactttagattcaagtcaacttgggtttgaaacccagttttggaagatactgcatttcattttagggaagttatttaaattatttgaatcacagttttttgtttttgtttttattttgttttgttttgttttctttaagaaggagctagaaatacctgtttcaaagcattgttgaaaggattacatggcacacataaaatgcctggaacaggcacttaggaattaacaaatcttcaatgcaatggaatctcaatgaggacagggctgtttgtgtcttttgatcactggtgtatgcctgtcatacagaaatgctccataaatatttggagaatgagagaactagtattatcaataattatttaataatttcccctaagcttaagtagcagcctaaacacagtacgattgattcttgttatgtgtgatagttttgttctataaagtcaatgataacactgaattagagaatactgagctatcgctcctaggagaaataaagggttaagttcctgcaagcctttggtcacaatgttttcatcaactaattaatgcataatcttgttttatggatgtttctctttgaagctatcttatttttatatattgttgattcatgaatatttaattcatggccaacagctctgtaactcatgcagaaacaaagcttattgaacacatatattttctccgtagggcacactgcagctttcttgcacttataaacattagataacaaatcagcattaccattgagggctattttaaacaatgaaatcactaggaaaaaacatgaaaatgggccaggcgcggtggctcatgcctgtaatcccagcactttgggaggccgaggtgggtggatcacgaggtcaggagatcaagaccatcctggctaacacggtgaaaccccgtctctactaaaaatacaaaaaattagctgggtgtggtggtgggcgcctgtagtcccagctactcaggaggctgaggcaggagaatggcgtgaacccgggaggcggagcttgcagtgagccgagattgcagcactgcacctccagcctgggtgacagagtctctcaaaaaaaaaaaagaaaaaaagaaaatgaaaaaaacaaaaccaaactgaaatgtggcaccaactagactatgaaaagggcatttgtttgcagaaggagagctgaaatgagaacgcagagtattatcttctgaggcctcagttaggtacatgtgtgtccatgcacggcacatgactgtgaataccctgtttgttaatttgggggttataaatgcattttaacatacacaagctcacaaacatgaaattctcaaatactgaggatggattgtatatccaacagggaatccatggtactcatgtaaggattacaccttctatttctgcatatctctcctctctccttctgtctctgttcaacactgtcataaatatttcttttcaagcagcaaacacccaatcagtacgtgctgaaaagaaaaaaaatgaacatatgctttgaggattttcattccaatggagactaaatacacaacaggacttggaaccccaatgtgttgtcatcttaaatgtatatggtacagtagtcatccaaaagaatattgcatatagcaggtcattttttaaaaatgttacatacaaacatgtctttcaatgaatgttgttagggttatcgaacagttagaagaaatggaaatatgctagatgaggttaagtaaatagaaagtagatagaaaaccactagcttccatcagggtctagaggagcctataataataaaaaggtcagaccaggaagagacaggctggaagaagagggatcacacaaaggaggaaactggtttgtatagtatgttattaaaaatgctgatttttgtcatatcttgtcacattgcttattgttcaagacaagtatctagcaactggcctgagaggaaattaataccctatcataatctctctgatctattgttcagtggcaagcaatgaggggaaaatctttgtgtcttgagagctgtgtggcttgtgtattggtttactacttctcattccactgaagctcaagagttgaattattctctacagaatcattaagaagtataaacggagtgccctaccacttctcttttcctcggttataatggaatgggtaaataacaaggtattcagagatgttttcctatttgtgtattaaaataatgcttttctatttcttgagaaaaaatggaatatttttattccgtaacaatgtcacattcacatttatttcactaatgaagaacactatgcagagttccttttacttagctttgcgtgagtttgatgttctcatgctgtcttatcattttagtactgaagcaggcttatttagaatagttaggcaataaataaaaacaaaatccataatcccttaatttgtcccatttttatcacactataaacagatgtaatattacatacacatatattacatattaaaattgtgatattatatataaagtcttacactgtttttaatcacttaactatataatgagtattgtccagttccttagacagtcttcaaaaacagtagttcacactgcctgtaatggatgaattatttaaacatttgccacttttattataaatatttgtatactttttacaaatatctataatctactttaaaatagttagcatggatagtgtgatattgccatgcaattatttaactgtcagcacactctttctgcaaggggccagatagtacatatatttggatttgtgagtaatctcatctcttctccaactgttcagcactgccatgttagtgccaaagcagtgataaacaacgtataaaggcatgagtgtgctgtgttccaataaaactttattagtaggcgctggttgaatttcacctaattttcacatgtcatgaaatattcttcttttgaattgtttccaactatttaaaatatgtgaaaaatcattcttagctcataggccatagaaaaacaggcagcagcttggaatcagccttgggctatagtttgcagaccactagttcaagccccactgcagattcagtcaactgccctaatgagaatctcttgctccaagactggccaactcccttccatttagaagcccctttctccagaggagggctaccctaaactgtttagactaattttatatctgatcaacagcagatatttttaataatttgcattagaatgagtttccatgggtgacattaatggcttgttagcataatgtagatgtaagaaatgagcgctcattgttcaaattcatgatacttagagccagcatttacccctctttagtggttttcaggttgagcacctgcagatcctaagggaggtcagggacactctgaaacccagacagtagtcatatatcaacaggtatgaacaaccagtaattagcaactgacatgctgcataatagctgaaaatcagccctgcctaaatgggctttatctgatttcacagatagctggatgaaatcttttgtgctcacttaaagatacatttttgccctttatagaaagagctgctgacccttgccttaaacacctgggcaatatcacactatccatgctattttaaatgatagatattcagaaaaagtttcaaaatgtccataaataaaaggtcaaatgtttaaataattcagccattataggtaatgtgaactgtttttgaagactgtttaaggaaccggacaaatatcattatgtatgtaagtgattaaaaatagtgccagaataaatatgtaaatgtctgcaggcatggtagattttggtgtcagaattgctctcactttcaactgttatacagaggttgttggaaagtgtgcaagctgcccctgattctaaccattggaagctgccattccattgccccccaaaaatttggaccttaacagtatataaaagttggatctcaattcacagttcttccataaaacacttactgagtttcttttatgtgccaggcatagatacagacacagtagtggaataaaggcagatatggtccctgtcttgatattcattgttatggcataagtgggaataaaaaataagcattaaaatgcattaaatattcctttgtattttataagtcagtaacagtatactgtatcaatcactaaaatagggatttccatgagccaggactgtcccaagggcatggcatacatcaatctattcaagaaccccgccttatgaggtgatattatgcccacttttcagatgaggaaactgagggacagaaagattaaggtatctcttgacatatgacaactttaaagctgtggcttgggttttaaccccagcagttcaaactcttagtctatgctcttagtctctgttcttcaaagtttggtgaatgaatttggggtacaaagtgacagtcacttaggcgggcagtcaaggaaggactttcttagcagggataatttaaactgcagcctaaaggacgggaaggcatcaattatgaaaaaaggcaaacagcacatctaacaccctatgtctgggaggagatttctctgttcctgtaagagaaaagaggttgacatgcctagaacctgggaagccacagataggaccttgcttttattctaagctggcagaaagtaggagagttacagtcagatttaattttaaaaatcagtctggttgctgtgcagagattgcataatggggtaaaagtgatactaggtggggtccattgaagatcaagaacaaaggtggcttagaccagagtaaatgctgcagggaaagaaactgatgtagcccatttcagaaacagttcaaaagctcccaaacaatactccccaaccaagccctccatgaaatctatctgatgctgaagataaataattgtatttcttgtattaaagcaacacattattattttttttttttttttttgagacggagtctcgctctgtcgcccaggctggaatgcagtggcgcgatctcggccccctgaaacctccgcctcctgggttcaaaggattctcctgcctcagcctcccgaatagctgggattaaaggcatgcgccaccacgtccagctaatttttgtatttttagtagagacagggtttcaccatgttggccaggatggtctcgatatcctgacctcgtgatccccctgcctcagcctcccaaaatgctgggattacaggtatgagccactgtgtcccgcccaaagaacacattattctaatgtaaattacacacttccttttttgtctccagcttacacctttctctccatgaagtgctggaaataaatcagggactaaattttcatataaagaattttttctctcttatctaactaaaatatacttaatttcatttgaaatgttatgaaagcaatggagctagtaccacaacagagtttaaagtaagaattgtccagttcaatccattaaacaggtgatttatttttggaaaaataaagctttaaataatttataaacaaatttgatcatttattctaaattgtaaatatatattataataattgaaggataattaatatcaataagcatattttcttttcttaatgcatattattttgtgctattattaaaacattaaaatattacaatttatgtattaactatatatcatatatatatacatatatatatatcatatgttcccccacacacacatagttagatttaatctacttatacttttaaaaagagttactttaaaaaaagtgtcactacatatgtcaattctatcgaatgagtagctgtagaacaggtttgccacactcaatcagaatcgtaagcactgggacaaatggtcaggtttacatttcagaatcattgcctggttgttagataggttgggtcaactcaggatagaggccaagagtccacggggagacaaagtggagagtgtggaatcacagaagcatgaatgcaatggaggtaggaatggcctatttcttaggacctgggaggatgactaagtcacctgaggatacgatgaggatgacaaaaagagggaaggattgtgggtgagagggaaataagattatttatgggtatgtggagttcaatttgcttatggggcatgagaaattgaataaaaagtctaaatgactgaagagagaggtgggccagaccttctcaaattttcaacatttaagtgaaaacaagggaggaataatattcctcggggatatcatgaattgcagagaaaagggccgagatgaaaggaatatttaaaggacaagaacataaagagaagcctccaaaaatactgtagcccaactctccttccttcttcttattgccatctctttaaattcttgccacataaaaaagcatatcatccacgggcttcctttcaaagtaaaaatattttctagagctttctaacttgtacctgtcctggaagaactgttctgtaatgaagttagaaattataaaggtaagcatgaaataagtacaacgtgccagggtgtaaattcaatcaaatccccaggtggggtttccctctttggttcagcttcattcttttgtagtagagggagtcggatacttggtagaagctccatttgactgaacattaggcttagttgaaatcatctatattttgggttttaaaatatgtgtgtggggggcactgtgggtaggtagttgtgtttaacatatcaatatgtattgaaaattattttttgattgaaagatttaatcacttggccaggcacagtggctcacatctgtaatcccagtgctttgggagacccaagagggcagatcatttaaggtcaggagttaagagaccagcctggccaacatcgtgaaacccccagctctactaaaaatacaagaaaaattagctgggcttgggggcacactgtagtttcagctacagaggaggctgaggcaggagaattgcatgaacccaggaggcagagggtgcagtgagccaagatcatgcaactgtgctccagcctgggcaacagagtgagactccatctccaaacaaacaaacaaacaacaacaaacacaaagatttaattattgaaggtgagtgttccgaccctgaggagcttacaatttgctgtgggatcaatgacttaaagaatcaaagccctacttggttgtattcagcgtgctgggggagtaagccatggtgagaatgtgcctcggggtgatgcacatttgtgagctcttttcatcggcgctgtgtggttgcattctctgtcatcctcttgggctgccatccttttgtctgtacctattcactcactgaagcctacggtcaatagagcactagttgaatagaagattattttagatggaacactctcagatctcaagaaatttctgaaaaaaagtaacagtgccaggtagctgaggaaaagaagagataagaccttgaaataagaatctgattgaacaactgaactaaagagagagaaaagcctttgaaaagcatgtgatctacttgaaatttgaggatttgggctataatataaatctgtcatgttgaaagaatacttaggaagttggtgaagacagaacccgtgctaattcggggtaactataaaatgattatctttatttcatgagtagcatcagacataatcaaagggcagttattttattaaacagatgctcactttggttaaatattctgggattacctgagacccattctgtacataaatgtcttttatgacgtctaaagaaattgtcaatattctgaaaggaggcttttaacaaaatcatgggccacaggtggagatttctcctctttacttgaggacatagcaggctttctgagtatgtatttctacttcaataagacctaagtccccatgaggaactccccataggaaaaccctagcactaccccatcagcaagggaccttccatgcagagaattccatcggatgtcacagataatggctgcctttcaaccagtctgctggatacccaggacaaacgtgcatgaagtataagtaaatccaaagtgaacttaattgacaacctaataacaatatcaaatttaatcaatagacatctttgaccaagtaatgattcagaccactcaaagaatttctatacattcaatattcgtatttattctattttgagttaaattgctagaattatgaaatacagaattattaatgagttttctacattatatatgatgaatatgtatgaggacacaattttacccacttcatttactataacctagtctatgtattaaaaccccaaaagaacatacttatacatacataagtataagaaagaatgagaaagaagtatggaatactccttaatataagctcctgtagtataagtgcagcatttctgttacaagtcttataaaatatatgaagtatttatttgtataatttttatattagctaggacacaaaaatcatgctgagaaaatagttaaggatttttatcactgaagataggctgagttatgctgcagtaaaaacaaactaaaaatctcagcagctcgagtcaacggaagtttaaagagaacgaattctgcagtgccttcccactgtgtctataaactcagccacataactcatcatgggaagcaggacacaagcaaaggcttggaaagcactcgggcagttgggtttgtcctcttcctcatgcctcaaccatcgctctgagaaaatgccaggtctactgcaggaagaaacacagtgcacagaaccagggggtccagttgctccagatcacatctagttgaaacctagagacatacaggcaaaatcagcagaatggagctgaccaccccagtcctgtgagcaaaaaaatgcttcttgtgtaccacaagggtttgtggttgtttgttacatagcatacttgtagcaaggcacagctgatacagctgtcaaggtcccagtatctgattttagctcccagtttatttttctgttgtgatgaacactgtttaattcagtttcaagtccacatgtacatgttagttttcccaatctattgccctatagttacatggaatacatgaaggaggtgctcagacagttcttgttttattgtatttcctgccaaaaagatgccccatgttcatattagttattccccttgatcagctctgcttctctttttccacaacaattagtgcttctatccagaattactactgtccctcttatctttcttcttctacccagaattgcaaagacaattacaagtcactgactccaagccactctccagcacaaggattgctacaccggatcctagggtggaaatctcaggataatcttttctggctatctgctaatcccttcatatcttgagggcttcccctgggtactcttcaaaaacacagaggttgttagcatgctttagctctctatgcagagactgagctccactttgactgcaatgctttcctccatttctccttgctctaatctctgcaggtgcaaaccaaccctgacatcctggaccccaaactgggtcaaagagccaagctctctacttaatttggaggacaggcttagtacctgatcatgtcaactcttaaccaacatccgcaacactcagatgcttcagtgttactcccaaaacatggcaatgggagaataccaacacagaaaaattctaggatgacgcattcagggatcacaaggcagattcctacaggatcacacatgaatgcagtgggctggctggggttaagagttgggtagagtctgcaggctccatccaaataggctaagagctacccaactgaagtcaattcattccaagaagaatcatgtttcaatttttcaaattttcaaaagaaattaaaaatatatagttggcaattaatttttaaaaacttatattgtcccaatgaaacatacatccagtttacagatatatgtttatatatgctatcaggagatagcaaccaccatagaggtttgatctatttggtggattattccagcaggaaaacagtgttcttacagtcaggatacatgcatggtacctgaattatgttgtttactggaagcaagagggtcttgccttgcctttacctgggttttgcagtcagaatggaacacagagagtagggctacacaggcaaatctccattgctgctgcagagttacaccttctgccaacagcaagtataatatgcaaaagatcttaactttctttctaacatttattcagcaaatgctatgttccaggtacttctttagttattgcaagatttagagtggaataaaatattgtctctgccctcagggagtagacaatttcacagtattactgtatttagtaaacaaacagatgactttcagtcttttgggtctcatagaatggatttttaaaaagggtgaatttgaattacttatctggatatcttgtatatctgccaaataattcgattttggaataaagatacaaaatataatttgatcagacccccgtatctctgatcagaatcacttagtaactaaaatagttaagaaggtgcaaaggaatattatcctggaggaagaaaattaaaagaattatctttttctgagggattctcaaataatcttaaacaagcatatagagtgtcttaacaatacgtgtactggaatcctcatctcaaagcatcctacaatttttttcatctctcattcagaggacagggaaaaagaaaggaaatgatttttcatcaaaaatgtgaacatgctgttttaacatcaatgactagaagactagatgtagtcaagcttatttgaaattaattatctaagaagcctcaatagtgctcatcccatcaatcttgttccggcctgacctcggaggactacctgcaaaggtgtgaagacagctcagacttcagaacaatccaatgcatggccttggctgacattcactacaggaagactaattaagaagacttctcagaatacagatgcctacctaatgagagctgaagtaacacataccatttttcacttcggtcaagaaacagatgacagagagtagcagatggttcactttaacagaggcctgatgaaaatatgaatgagtgcctctcagttgctacctggcagagtgttgaaagcacctcagtcacagagagggatcctgaacccaagtacttagcatcaggaatacagctcaagttccagtttccagaggatgttctagcaaacattagttgaggccacttaggtttggaacggactgtgttggtcctggagggctcctcgaatggatgcatcctaacctttaacccacaataagagaaatgtacttaagcccacctctaaatgaatttgtcttcagcttgttcctctggaggccctatgtccagcccaactatgatatagctgtcacagtttagttgtggctcacagttaggaaaaaggaaaaagctgcctacataaagcatatttacttggctcccttccctgaaacccactgcaatggaggaaaacaacataatcacacgtaataaaaatggaaaatatctacaatacaaatgctaacctagtgaaactaaactaaggacacacaaagtcagtgtgtttctctccagagctcaagcagaaggcagattttgctagaattaaatgagagactcttgagcatctcagctcaaaatgattcattttctgacaattaaattagggaaactgtctgaagataaatccagaagggaaagaaaaaatagccacaagcttttgaagagctgacatctgtcaatggtgcaggcataaatcatctccaaatagccaaccaaatgcctgaacaggacaaataccacactgaccttctgccaggatgatcagcttctctgcccaaagatgtgtctccaacccaaaggatgctacacattgtgtatggagaaacagaatgtgtctgagcactacgccagccagaattcttcccccacccaactccattcctgagcaaatcatgggccacacttgagaataattattagaaagagaaaaagctaatgtaatataagtggaaaaagcaaaaggcagatgacagaagtaattcaataaactgcaaaacagtatatatagccagatcccttatatgaaaatatatgtatatgtgggcatataaataaaataatacctgggatgagacatctgaaaatgtaaatagtatatatctgagtagtgagagaggggttaatgtgacgcttctactctttgctttattcatataggaacattttaaaaatataattttgaaaaaacagctgagttgagcttagcctctgaagagagtgaacatcccttcagggaagtggtataatgctgtcagacttgaaccttgatcctttttcttctatcccttttatctttcccttgactctatggtgaaccactttagagtgtccacacttttatgcagtcctccacatcttgagtgtggataggacccatgacttgctcctaatcaaaagaatatagcacagtgatgggatgtcatacctatgattacactccattatatacacatgcattacgtgagactttatcttgggaatagactcactctagagactcccctggctagctagaggaagcagcagctgtactgggaaattccacatggcaaggaattatgagtaacctttaaggaccacaggtagcctctaagaactgaaagtagcttccagccttgagccagacagtatcccaggccctcagacctggaggtctgaacaaattctgccaacagtctgagtgaacttggaagcagattcttttccagcaaagccttcaacaaaacccaacccagccaacccttgattgcagctgtgtgaggttctgaggagggggcccagctagtctgtgcctggacatctgactcgcagaaactgaactcataaaagtgtgcttttttaggccaaagacaaaacaaaagcaaaactctgaaaccatttccattggtgtgatcactgaatcaaggtggtaaaatatgggccgagcaagggatagggatgaggccttctcaacaccagtgctttccaaatattttttgaaagtcaagtttattgggggaaatcttatagtcagtaaaatttatccttcttaggtataaagtttaacatgttttggcaaatatataaaggcagataagcaccaccaaatcaagatacagagtgcgtcatcacactaaagagtactctctttcccttagttgtcagccacctgccctggcccgcaggcatccactgataggattgtctacagttatgtctttttgtgaatatcacatcagtagaatcacacatagcctcttgtgtcagtctcctttcacttaacatagcatttctgagatttgcacaaattgttgtatgcatcataattagttttttttgatgatgaactttcctaccagggaagctactaaaataaggaagtaaggccagcgcggtggctcaggcctgtaatcccagcactttgggaggctgaggcgggcggatcacgaggtcaggagatcgagaccatcctggctaacgcggtgaaaccccatctctactaaaaaatataaaaaattagcctggcgttgtggcgggcgcctgtagtcccagctactcgggaggctgaggcaggagaatggtgtgaacccaggaggcggagcttgcagtgagccgagatcacgccactgcactccagcctgggagacagagcaatactccatctcaaaaaaaaaaaaaaagaaagtgaaaattaggtgtcccacaactatgacttttgacaacgtgtgactgcagaaacacagcacttctgagatttgcacaaattgttatatgtatcagtaattagttttttttgttgatgaactttcttaccagggaagctactaaaataagaaagtgagaactaggtgtcccacagccatgacttttgacaaggtgtgactgcagaaacagagccggtctgccagtcccatcctcctctcatgcacacagacctaatgatttttctacagaatatacccgttgtctccatgcagaggccgaacaatgacctgcatctcacttctgccttctttttctcatgcaagtaatccaagtggtaagacctcaaacaaattcaggaccctaaatgaaaaggagtctgggaaatatatttgtacctttccagcctctgtagttcaggaagataccacaggaaaaaactacaataggtgatgagtgacagtccaaaatccccaaaaccaggaacacaggacacacaaatgccacagtacatattaaatgctaaattttcaactattttttagagtaaaccaaaatataagtaaaaattgtaatttttcttcctactctctctcttatgaaaatcacttttgtaagccaatattttagacacacaacaatttgcgattacaaagtctgtttaaaaataaaagaagaaaaactacaaaaaagcctcagggtcttcaaacatcatcactgcagacagctctcactgtatgactctaattaatctcttggagcctccatttctacatctttaaagagacaaagttaaatatttctaagaactttccactcctaaatttctgcattttgctaattgtaggatattagctatgatgctaagtggtaactcacatatattcagaagaaatatattgatgattaaaagtatgttttaaagatgatttttttttttttgagatagggtctcactctgtcactcaggttggagttcagtggtgtgttcttggctcactacaacctccccatcccaggctcaagcaaccctcccacttcagcctcccaagtagctgggactacaggtgcatgccaccacacctggctataaagatgattttttaaacttaaatagatttatcagtggtaaaatgtaacaaaacccattgcagagtaataaattgtatttaatttttactataatatataatgtgcgtcagtttgctaaggaaaaaagcaattaaacattaccaaagggggccaagaaatctcctaaagtgaaaagctgtaagtaagaaaagatgaaacctttctttaagggtttaatcatggttctctctagatattggagagatctgagtagttctacgaattataataacactagtaataagtcttttatttacaggatactaatctgctaggatgtatccatttgcacaacctgaataacaatgtctaaaatatacaagtttatttttcttgcttggcgagtctgggattatctagggcgggccttctgcagtgtggctcaagtacgatgaagacacaggctccatcattctggatgcttccccatcctgggagtgttgtttgtcaactcagggccatgagctctgttgcagttccaggcaacaggccacatttaaggcagggtaagcaccacaaaatcaagatacagaatgtttcatcaccctgaagagtaccctccttccctttgttgtcagccccctcccgtgacccacaggcatccactgatgggatctgtctatagttatgtctttgtgaatatcatataagtagaatcatacatagccccttgtgtctgtctcctttcacctaacatagtgcctttgagattcgcacaaattgtcacatgcatcagtagttattggtttatgaactttcttaccagggaagctactatgataacaaagtgaaaactaggtatcctgtaagattgaagaatggcagtgcatcgactgttcccaagagagcaagaactgtttcaaaaaacacagtaggtttctgcgtttatgtgtcagagctatgcctgtgacacacccggctactgaagaggctgggaagataaaatcagctttcccacttctacagcagaagccagaaaaggagaaggcagtttcactcggctaatgggcagtatctggccaagatttacaagatgaaagtctttcatagctgctattctttaggaacattaccagctagagttaactccaggcccagctacacagcagtgtgaatgatctcttattcaatgaccactgactctagaaaaactctcaactatactgtgacatgggtgtgtttgctcaaataatttaatcatgtaaaagcatctcttcttggatctgttaaagcacttgtcaaaatgtcagataaaagaagatgatgaactaaactgtattataaaattgtgtacaataatcccaaacagttagttatttttttctgcttgctaagaatacagcgtgacctgcaaaaacaacataaaaagttaacaattctacagaaagcaataagagcagtgcagagagaattgcttccatcatttaagaaacggtagacaaagtattgagaagccttaaaacaagtgcaaatgatgctgtcagtaagtataaggttggactccttttactatggagagattttgtacaaaacatttctttaatattaaactaatgttttcttagctaaattatcgtatagtgaaattgtcctttaagtacattttaaaaacagaaatcatgctcatttaataaaattaagatattacaaaaaagcatatttgtacattaataatgtaagagttatttagaaaaatgcctttggtgttccacttaagatccatgaatggcatgtattctgtgatatatggaatataaaaatatttttattataagagattaacttaaacccacagagacatttcaatgtagtgagggagaggtgaccacagataactctaatacctgttagagatgactatgcatcccaagagaagggcaggcaaaggaaagatgattgttccttcctcagctttaaggagccaagaaccatttatctggattttgacctgcttccctttgtctccatctcctaaatcaggtgatggtttaaggaacccttcggtccggctgggtgccgtggctcacatctataatcccagcactttgggaggctgaggtgggtggatcacgaggtcaagggatcgagatcatcctggccaacatggtgaaatctgtctctactaaaattacaaaaattagctgggcatggtggcgtgcgcctgtagtcccagctacttgggaggctgaggcaggagagttgcttgaaaccaggaggtggaggttgcagtgagctgagatcacaccaactgcactccagcctgggccaaaggcgagactccatctcaaaaaaaaaaaaaaaaaagacagaaagaaaactgatctcacagcaaaaacagcttgaagaatgtctacactttctccttcgttggcctattagcagaaatccttgaaggcagatctaggaaacaggaactgatgaaaaacaaacatgaactttaactctacaagtctattttttccctaaatgcctcagcctgctgccttcacagcagttacagctgaaggtccgggcagtgcaccactacagtggcattttcaatggaagggaggttagggttgagtttgctatgtgcatcaaagcttttgctacgtttctcttttattttttgtcatagcaaaacaaaataccatgcaatctgatcctttgcctattcagtttaaacataagaaaaacaagttttaaccccttgtcactccacatcatttgtacagataatacatttaatttccttccagtgtgttcttattgactctaattatcaaagagaaatcactgagattcccattcttcttaccaatgattggcttaattttttttttttctttttgagaggaagtctcactctgtcgcccaggctagcatgatcttggctcactgcaacctctgcctcctgggttcaagtgattctcctgcttaagtctctggagtagctgggattacaggcatgtgccaccacgccaggctaatttttgtatttttagcagagacggggtttcaccatgtcggccgggctggtcttggaactcctgacctcaggtgatgcacccgccttggcctcccaaagtgctagaattacaggcatgagccaccacgccgggccgactggcctaatttgatagcatttttttatatatatttaatcggcatagtcctaattttaacatgtagggcatgctcattgcacgccacttacatatagaaatgtacattcaggtttcactattgtcttttatataaaaaaatcaagcagatattcttatgttaatggcacataaaagtaatagctaatggttattttgttattactacatgttatgaactgttttaagctctttagctatattaactttgaaattcttacaattctgcgagataaatactattattaactttaacagataaaactgacgcacagagaggttaaataatgtaacaaaatatatttacaacactcctagttactgttaaaatgaagtatagttttgtctatggataacattcacatcttgatctttcacactttgccacatactagccacacggccttaagtatgctaacttatctcattaagcctcagtttcctcatctttcagatgggcatgggaattgtatatgattctggtaggtgggcagattataagataatgtgtgtgaggcatggtgcctggatcacagtaagtcctcattgataattagttaacattattattagtaggagttcaaacactgacttctagtcttggattgggagtttataatttgtgtaatgttggataaaagacttaagatctttgctttccctatttctttgcctgtggagtgagaactaaatgtccccagccagctccatcatgtagcataaggtcaagtcaaacaatgtttgcagaagcagtcggtaaactgtaaagaactagacacatacaaactacttcttttattaactcaacagggagaaaaaggctttaaccttttattccacaatgactacttccaaaagtttcagggtctctgagctaacacagataaatgctttcattgcatttttttttaatggcaaagtggtagctgatttttaaagagttttcagaaatattttcaacaaagtacctctcagcaactttcttaggatacagacctctctctgaagtttcacagtccttgcatctgtaattatggatgaaatgtagtattcctactaacaacactgagacatcaagaaaatgctgaaatgtttgtactgttctgttctttattcaataaagggcatacagcagtgttaaaataaaaataattttataaagacaatttaaatagaaatattaaagtacttgtaaagttcaaactctaaagtttcttatttgaaactcatttttccaatgatgctaattcaataggtataatttaaataatatttttctaaattcgtggtcacaaggattgtttttggacattaaaagaagagggtaaaataaaacaaaagagtcgttcatcctagaaatcagagtttagtaacttcccacagttagcaaacttaatagcttaaaatgagtttaaaatagaatcaaatatactagttggagaagataagtttttacgagattattttttgattaagtatatgccatagtgaaaatggggatatgatactgaacagcagcacacaaaagcagaggtattttttgataatatagtcattcatagtatcctaggggtcaggctaaagataaataaagttcgagccacattcctgcaaaaatggtatgtacacagtgctgcaaaatggggagaaggagaaagaaatgagaacataggatattcctctccttatgaaaaattatattgactatgaccagacagaaatactaaatacagtcagcaatttatttcttattttaggatgacagaaatcaatgtgaatgggtgatttcacaaataacatttgtttttgttgttaatattactattattagaagggctgaaattaaaaactattctttgtggagacaattagcacctacctatattagaaatacaatatgtaagccaggtgcagtggctcaggcctgtaatcccagtactttgggaggctgaggcaggaggatcatgaggtcaggagtttgagaccagcctgatcaacatggtgaaaccccatctctactaaaaatacaacaattagctgggcatggtggcatgcacctataatcccagctactcaggaggttgaggctggagaatcgcttgagcccaggaggcagaggctgcagtgagccaagattgctccacgccactacagtccagtctgggtgacagagtgagactccatctcaaaaaaaaaaaaaaaaaaaaaaataccatatatatacatatatataaaggacagtttttctcctagtattttcatcatgaggataagacttctgcaacaacctggatatcattagaatatctaaataccagctccatttcatttcaatacagacaaataaaatgtaacacagagccttaattctgcaaatttcttagggtacaaattgcaatgaaatatgtcatggatttgaagactaaaataaatggtttgaaacattcattaacacaatctaaacttgccatctttagtgatcaaggcttctggacctaccgttcacctggaagtgtggcataggacactggggacagcaggggggcgggactctgaggactccattcaagtatggcaggtccctaacaagaccgtagcctcgacaacaagttcaatattagtttaactgtaaattacattctatatttaactttgttacacggggagtatatgtttgctgtgagtgatggcttaatttatttttaaagagaaagtgaaagatatttctcgtgattgtatctgaaacatagtgaatgaatttgatggaaggagtgctcctgtggagctaacattggtagaaaatgaaaaaagggaaaccctatcagaaactgactggagtcggccttccagacagaaaaacaaatgcctcaacacctctttaaatgtttttattttcctagggataatgacaatttttttttatgaccagctccatatttttcttaagattactgcatgaatttctctcttcctctctcaataccttactctggtaaagttacagagcattacactggttgccttgatcttttacttcatttatatgcatttacagattagcagagaagcaagctcacttaaaaggtaggaaaatttaggtttgaatgccattctcacatttaatagtctgtgacccagaataggttgtaagatctctcttagcctcatcttcattttaacttgaggatgatacaatcttcctcatatgtaaattgtaataattcagggggcctggcgcagtggttcacacctgtaatcccagcactttgggaggccgaggcgggcggatcaagaggtcaggagatcgagactatcctggctaacacagtgaaaccccgtctctactaaaaatacaaaaaaaaattagccgggcatggtggcaggtgcctgtagtcccagctactcgggaggctgaagcaggagaatggcatgaacccgggaggcgaacagagcttgcagtgagccgagatcccaccactgcactccagcctaggtgagagagcaatattccgtctcaaaaaaaaaaaaagaaagaaagaaatcaggaaggtaaagaatgaaaatgtacgtgtattgcgatacattattattagctattatgtttatgattatcattaagggaaacaataatacttatgtaaaaataaaataccttaagattttgagagatagggtttctgtcttagagtgaatttttcttcatggccctgagttaccaggcagagtgattggggaaaataaatgccccaatttaatatccaatactctctggacaagtttagttccatagccagagcagatgtgaatgatactatcaagcatgaactcctcattcactcatttttacacaagagtatcacaagagactgccaaatgctttattgaaatcacgaagcattacatcttcaggttgtcgctgctttatttgtatggtaatctgttggggaaaaaaaacaaaggaaaacacacaaacaaaaaacaaggcagtttgtaaccattccttctgagtgaatccaggtgggcacattctgatgaatttttcaatgtattctccagcagttgacttaactgttaactccaaaacctcctgttagtcaagcctttttaagaaaggaaaagatcctttaaccatctccagaaagttgtccaaataacagatacatgtgacaagtagatttacccttcctactcttttctgggaattcagttctaggaggccttgccaggagtcaatattctggaatgcttcaattcatgcatagcttcttaaaggcatcttataaatgtcttaagatagaaatggaaatgttatgggcctgcctataaagagattacccatccaagtgccaaatacatgatttagttagaatgcatttggttgcgacagaaggtcaatgtgagctagtttaagcaaaccaaaaaaatgaaaatgacaaaaaacaaaatcaaacaacaaaaaataatttattggaagaatactgggatctctcactgaatccaaagagttgaacaatcaagcattctagctttctttacagggcagaaaacaaggcctccaattatccaaactctctatcgtagacaagcagacttcgttcaatacataataatgctggcatgaaaggactcagaaaaaatgcactgatgtgtccgcatctgttcaagtaaccattctggggccaccaatcctctacgaccaacatgagcatggggtatctggactattcacagagtgagcaattagggcttgacagccactcataaggggtttcccatagtaacttccggattcctttataccaggtctgatgtgatactacatcattatcaagtcataatgtttcttgaaaaatgtaaacccaacaacaagaagagtagcaatttagttatacacttaattaaatagtttaaataataaaataattgagggatgttaacaaaggataaatgtaacttctcattcatttatttatgtgtatgttatcaaaaaggtcaaattcaagcatgtgcccagatagcattaccatgaataagagagattatttactttggttaaactcttttaaaattaaatgtgaggtattattgcaattgaaatattcacatcacagccttgcaacccttgcatctacctaaatatattaaatttcatttacttattttctctctatacaatttctaacagttgttatttatttaatcattcattcatttaacctaaaattgaatcccatcagttaagaaattggaaagtactagtctttttatttacttatttgtttatttatttatttatttatttatttatgagacggagtcttgctctgtcaccgaggctggagtgcagtggcgcaatctcagcttaccacaacctcctccacctatgttcaagcaatgctcctacctcagcctcccaagtagctgggattacaggtgtccatcatcatgcccagctaagttttgtgttttttgtttgtatttttgtattttgagatggagtctcactttgccaccaggctggagtgtagtggcacagtctcagctcactgcaacctccgcctcccgggttcaagggattctcctgcctcagcctcccgagtagctgagactgcaggtgtgcaccacaatgcccagctaattgttgtatttttagtaaagacggggtttcgccatgttggccaggctggtctcaaactcctgacctcaggtgatccacccacctcagcctcccaaagtgctgggattaccagcatgagccaccatgcccggccaaaagtactagtcttgatactagaaattttgttatgaaatagtgattttttgaaaagacagaaaatgagtttcaccttactcactgtattagtttgttctcacgctgctaataaagacgtacctggcagggcacagtggcttacacctgtaatcccagcactttgggaggctgaggcaggtggatcacctgaagtcaagacttggagaccagcctggccaacatggtgaagccccatttctactgcaaatacaaaaaaaattagccgggcatggtggcaggcacctgtaatcccagctacttgggaggctgaggtgggagaattgctagaaccctgggggcagaggttgcagtgagctgagatcacgccactgcactccagcctgggagacagagcaagagactgtgaaaaaaaaaaaaaaaagatgtgcctaagactgggtaatttataaaggaaagaggtttaatggactcacaattcagcatggctaaggaggcctcacaatcatggcagaaggcaaaggagaaggaaagtcacgtcttacatgggggcaggcgaaagagagattgtgcaggggaattcccatttttaaagccatcagatctcatgagacttatttactaccatgggaacagtatgggggaaactgcccccatgattcagttatctccacctggccccactcttgacatctggggattattacaattcaaggtgagatttgggtggggacacagccaaaccatatcactcaccattaatgctatcaacaccttcttaaatatattccaacaatttaaataaaatagctttattgacttccataaaatagtccaatggcaataaaacatcaggactcttgaaatgaatttcgcacattcaattcaatctcagtggttaagtgtgaaatttattactattgttactcatgatcaattaataaaataatttcaatattcgtatttgtagctactatgcaaagagcagcttccatattccaggcactacgacaggccctttccattgaatccaaaagaaggaagatgtctcaaaggggcacaaggacactttgcacagcataattcaaatagtggctaatgttcttaagatttaatgaggactatctagagtctcctatcccaccttttgtgagaatttcaattgacccaagatttctggaaaccccagaacttcatgttctactggtcatctgtggctctgagctcccgcttctgtaggaaatatctccttctccattcacggacaataactattctatgtgctgactgagatgagcaacacaacttgttctccttgatttccccaaagcctcttgatatcagacattggcaggtgctgggacttgcaaacacacttgtgatccagagggttttaagtcacagcaacaaaaatgacctgattatcaagagttctaacacattttctttttttacaaaaaaaaaaataagaaaagtaagagagaaaaaatctacatcttctcccagaacactgaaatgtaacatgttgaagtgttatcaaggagctttgaaacgcctcctgcactctctctccagcggatttatagaccatctcatgtaataatctgtcaataagttaaattctgaaagctcatttattattattttttctctaccaaatatcctctcctctctccatatttccttagtgactaaagaaactccagattcaccattggatttcctgatttaatccccagcttgagactgcatagtctttactgcttaattgtctaagagagatggcaaagagtaattcatcaagctgatatcaactgaggagcacagatttccatgggcatcctaataaactaatatgtgtttgtaaaatgtgtgttattatatgcatacattccattacaacactgagagctaactgtcttcattttatcagataattaaaatcagtttcagaaatgttacataaccaaggccgttcagtaagaaaatgctggaggaatctgaagtaagtctactgattccaaatgtatcactttttccatcatgcagaatattagcccacactctatggccacttatgaatcagtccttaaaacaagatggcatacttctccttcagaagcgagtgtcacgtagcttactctgtgtcatggcagaagccatgaaaattaccttatccttaaaatagattacagcccagtagtactgagtgactttccccctaattaacaaagataatcagatgtcccacctcaagtccttacctagacttgtggtggagacaatggttcctaacgctacataataaattgtctgttgttatagatactacatatttacaaagtatggatatctcagaccacagaggaaagattcttagcaggaacaacaacaacaaaactatatttaaatgttgtcaagattaaaaaataatatgcaatatttatccttagcgatgaaatactaataagtagattttactagctaacaagttatatgtcagagtttaacaacatctatgatttggagaagaccttagttcatttagttaaatcttcactctaatttaagtccctcacagatattcattcagattctccttgcttaattctaacatctaggacttcgctacttctctctttgaatttgtgggtagctctgacatatacacacacacacacacacacacacacacacacacacacacacaccacagatcctttccaacttttttcgtaccctagtatcctatgtttcatatggtagttagaaaaggataatatattttgagcatgctgtgcaaggcaatggacgaagccagtgcaaagagcttacccagccacaccccaggctaaaaagaattgcatctcagcacatttactgacaagcgatggtacatctctgtgctgccacccactggtcaaaaggtctgtcattgattactgtttgtcagtgaatttcccaaagagacagcagcaactggccgtacttgagagtacttccctaaatttgtcatttgctggcatctttgagaccattttttccattaaaaaaaagtctaccttatgaacacatcccagaggcagatctgcagtgaaacttgccattgtcactagcaatgtaaaccccaaacctatttgttccttccaaatatatggggggctacttaagtctttgagttattcctttcaggcttaaagttcctcaagtttgtaactgagattcatatctggcacaagacagagacctgcctctcctaaattttgacgctttatcctaagctcttctcagttgtacaacagttattgaacaaaagtttggttcttcttttgcataaccatatttgaagacagctcctacagccccccttcctgtctcacccgaccacccacaatttgcaagccaagcatcattgattttcccacctgcaacatatgtaacttggtttctatattcttcacaggtgtgggtatgctgccgcgactcatgtttgggagcttattttgtctactgactaaatatattgctaatatttttaaatataatatttacatattttaaaatgtgttgttggtctgccatggaatttttttgatgttcttaggctctggtctagcagttcatttcagtgttacctcagctcactattctgcctatagtcaaaaaagtcagaaaacatcaagtgttggcaaggatgtgaagatattgtaatcctcataaaatacagaaacagcctggcggttcttcagaatgttaacctagtgttgtcatgtgacccagcatttccactcttaggtttttattacccaagggaaataaaaacatatgtccacacaaacttgtacacaaatattcacagcaacactattcccaatagacaacaagtgaacacaacccaaatggccatcaatgaatgactgcataaatgaaatgaggtgtatccatacagtggaatattatttggcagtaaaaagtaatgaaatcccgatgcatgccacaacatgaatgaaacttgaaacattatgataagcaatataagccctttagaaaagaccatatatttataattccatttacataaaacaatcagaataagaaaatctgcagaagcagaaagtataatagtggtttcctggagtgactgtgactataccaaaaccacataaaaaagggaacagtatggtatgtgagtaaatctcaataagctgtttttttttaaattcaccccaggctacatagaatcgtaagacttagaagtagagaaaatggtctaacatgactgattttttataaacatggaaaaaatgagtgaattggttatctactgctgtgtaacaaaccacctcaagatttactgacttgaaattacaaccaccatctgctttggtcctctatctccaaatatcaatgaggacagatggcctctgcttcacacagcattagctggggctcggggctccactgctgatggctcactggaaaggttgctaagtcagtgctggcatcagccaggagttcagatggtgctgcatgcctggagactgcgtgcctgtccacatggcctctttacaagtgtcttgagcatgttcacctcatggtgactggtttctaagaatgagcatctcagaagaactaggcaggaggtctacttccctgtagccctggtcacatgcattcccttccaccatagtcctaagcctaactggaatgaagaagaggaaatatggagctcgtctatcaacgggagaggatcagattctcatcacaagaaggatgggagacataggaaattgtgatctagcactctgaaacaagacaacttaccatagtgagttttaggctaagtttattgtcacaattcccctgtttacttcgccttcctgcaatctttatttgtggtccacatttctaacaaaaccacctatttactcacttcctgtgttgatgaaaaatatattcatattttacattttagtgaggtagctttcaataatagactgctttaagacaccattttcacagagttttctcctaagaagatgctgaaaagtaaaccctcacatgagccagggacaagaatgaagaatttgctataacagtacttaaatttttcaacacaaatcctcccagcattttcttctatgaagattctatttcccgtaaactgaagagaagactgaaattaatggttacacagttgcaggtaagtatgctttttgtctctcttggaaccatctacacaaatgtgctcaaaaggaaatgtgctaaaataaaaaagtgccaacaataaaagaactactcatatacaacactgtataagtccattctcatgctgctatgaagaaatacctgagactaggtaatttataaacgaaagaggtttaactgactcccagttccacagggcctgggaggcctcagaaaacttacaatcatggtagaaggggaagcaaacatgtccttcttcacatggtggtaggaaggagaagaatgaccaaaggtgggggcggaaagccccttataaaaccatcaaatcttgtgagaactcactcactatcacaacaacagcaggagggtaattgcccccatgactcaattacctcctaccaggtccctcccatgacacatggggattatgggaactacaatttgagatgacatttcggtgaggacacagccaaaccatatcaaacacatatgacatgccaccattaaacataaaaataaatagtaaacacaaaaaattacttcaaaatctgtaatgattaaaacattttaatatgacaacatcaagagtttcatcaagcacaaatatgtgaaaaatctcccaaacacaaaaagcatacaaaataagcactaaaacaaataattggatttttctgagactctggggaacagcatgctttcaaacagcagttaaaaatcactgaagattttcaacaaatatgataaacttggcataattgtatacaaacaaaaataattaagtgtatttttatgttttttatgtgtaaagttgctgattcatgtactaatatggtaggttttttttcctcttaactaaaacaaggtacacagtctagtttcaaaaaaaaagacaaagacacattttattaatgaaggatatagttgagtaaataagcctcatattaaactgaaaatatctcattccacctgattaaatgagttttgattgaggttgtttatagaaaaaattgcaatttgggggcctaggattcatcagtcaatgggcacattctgaagcgatatgcaggcagcccaaatggaagatctagacccaatacaaccattaaagtaagggaaaaagcatatgatcaatgtaacactggaaatgagacccctgcaccataaaagtgactaaggacttttaccacaattaagcaacgcatttacttttgtgctaaaataaaatggaaaaagacagtaagttcattcctaagtcatactctcaatacaaatatactaaacacctcctccatggctggcactgctccaagagctggtgacccaacagtaaggaggggagacaaggccacatccccatccaataagcttaggtgagagttagaaaaatattacagttattgggccgggcgtggtggctcatgtctgtaattccagcagtttgggaggccgaggtgggcagattacaaggtcaggagatcgagacattcctggctagcacagtgaaaccctgtctctactaaagatacaaaaaattagccgggcgtagtggcgggcacctgtagtcccagctgctcgggagctgtggcagaagaatggtgtgaacccgggaggcggaccttgcagcgagctgagatcacaccactgcactccagcctgggcgacagagcaaggcttcatttcaaaaaaaaaaaaagtattacagttatgcagttattaattattaccagtagtaagagtaatatgtctattactgaaacggttcatttatattagatcagttgactatagttaactattgaaaggttttcaatgtcagtaaacaaaccagtaaagctcctagtatggtaatttcttatcttgggtctccataaagacagagtcaccaaatcactgcagcattattcaagccgtgttcttggggggcattccagtggagggatgaggtgttgttttcaatatgagcagagctctcaaaagtgagaggatttacactctagatgattcatttgaagaataaattgcctctggcttttgacaggaggtctctattaggcaatttcaggtctctgaacagtatctcaagtgtgtggtattatttaacaaaataatttaataaaagtggctgttttgttaataggtgggctggattccaagcttatctatttcggtggagggtttctcctctgttgtggaggtggtgggcatgggtgctggccaacagtgctacagtggtatttcaaaagttctgaatcaaataaaagacttaaacacctttggttgatatcccagagttctacttttcagaatagaagatacggcagtgtcaaaactatatgtggaattgtttgtgatttcctataaaaactatggactagacttttatgtaattttaatttttaatttgagcataatttctttatcactccaagatgtgtaacttgcgaaaatgcatccccaaatgactaaatctattgacttggggaatgaagctatttagcaatgtctccctagatgttgaagattacctgtcaaaagtgatttttttttttgccttattgatattgagttgttctttctcacagtaattaggcaagtggcccagctgcttcctgaggctatgagtagaatatgaaagtcagaacttgtccttagtgaaaaaggaggatgctaatcttcacttttccatgggaggccacagagccagctcatttagagcccagggcatgaacttgcacgtgcgttttatgattgcagcccagtgacagcaacttgaacatgatcgatgggctgcctcaggcatgtttacctgtgtcactgatgcatgctagagataactccagtccaggccactgatgcccagcaacagaaattttcaactaaagtaagaatgtgtctaacccacagtattcccttcctgtcacattttctctacagatacaattaactaaaaaataaggtatagttgttccttaaattatttgtatttgggttattagtgattccttttaaaaatacattgcggatcaaattaaatatattgcagatcaaattaatgtataaatttccctattctcttctcctcgttaaataagagactggcagagaatactatctaacttgaccttagcaaaaccttggtcatagaaaaatatttttcttcagaaaaatatcagacaacacattgtaggcctattattttatctaaatgatgaggttgtgtagtgtagtgggggggaaaagcactgaatttgaagtaaaacataaagtctcagtttcttgatcataaaacatattgagcaaaataatcattagaggaaaaatatatgatttaattatatatctgaggaaatgtttcacatgtacattttatagaaatacatgttttacaaaaatatgtaaattaaaggaatttattgtctgttctttttaaaaaacgtttttgagatactattgaacattgtttccttgctctaaaataattcctgtgtttttcttgactattcctactatatctggttccatttctctgaaaaaatcaacatttttcccatgagcttcctctagaatattctatgggttaatttcttgctttgtgcaaaccatgcacagcgcactgactattttaccccaggagcccctgctttgttggcctgccagtggcccttttcagtaattaatgatgacatattttccaagcgaatttttaagagtcttgaatctttttttttcaaacctttgctccaggcagtgtctgtcaaagcagacccaatgattaatgtacaaggaagtgtgacatgtcacttcttttcatactgtgaaaatggaatcaatctaagatcaacaaaggtaaaaatgtgaaatacaattatattaaataattcacagtgaatctatatcacatactcattagaaacatgtttgaaataatattaaatgatatgaaaaaatactcctcatagaaggttaaatgtacaaagaagaataaaatatttataaagcaaaatgaaaattttgtacagataatcttatattcatataaaaagtctggaaggaaatctccctaaatatttgcagctacctctgtttgtggtgaattttcaaaataaaaaaaacccaattcatttatttttcctatctaatgttttaaacttttacacaacatgcatgaattacgcctttatagtggaaaattcataaaaattactaaaacaccacattttacatattcagtatgattttacatatgaatatttaacaatgagttgtagtaataaatatgacagaagcgttagaagcactatattgtcatgttacaaaaccccacatactaaaggcttattttctaatctagcatataacaccctagtctctttttttcccttgatagctccagtgctctgtaaacccaacaactaacactattaaatagaacagagcataaaacaatcaaatgagttaattcttggaatggagtttgaaattatcaaaaggacagataggtatataagtgtcctgagaagagttataaactgaaactaaggaaaatattaagtttcagggggaaaagtcaaaataacttagagtaactaacagaatacacataagagagcatcaggaagcaggggtggagagacagagatgatctatccagagttctagaattattcacccataactggaactcccagcacacattcccaagacttgaataagtagtttatgatttgtttctccttgatttatagttttatttatcatttttctgatgcacagggttaacaagtaaacaaatacacttcaaatgcaggtggtcccatcaatctcatgctacctgagcatccctttccttcatacatgaacttcataactttacatacacactcattttctttctttaccctcctggaactctaaacaccccatctggtcaatctatctacaatccttccatcctgtacgtatgaaactcacaaggctttctgatccttgctcccccttccttgttataaaccatatcatgtgtcatgacccagttccacggactcctagcttgcacctttatctctcaattcacagcttcaaacagatgatcactattcctaatacagctgagtttctgcaacaaaagttaaaggaaatgcatgctttttttttcatttctaatccaccctggcttgaaacaagaaataaaaattcagcaatcacgtaattctcacttaaattttgatatgtggagaaagttcaactggtagcactatgctatggataattcttcccttctctgactaaacgaatataaacttcactggtctttgcagataatcctctatcttcttgacctttcctaaggtgttataacttctgctttttcttggatgataattttgtcattaatttcataaaatgctttcccaaaataccatccgaaatttgattaatagttataggtcatttccctaacaacacattgtgttatcagaaattattgttgcacattatagtaacaccaataatgctgaaagatttagcaacgatatgtggcactggaagaaaactaattaagggagtattttataatgaacttcttccaaatagtattcttgttatatatagagttaagttacttttgaaattctaaatgtagaagctgaataaaaaggaaggcatgctatcctcacaagagatgatgtaaaagatctagtttctttagattttaaatgaatctttttaaattcttccttgtggcttcatatgacacaacatatataaagtactcagtgtcgtggtttgccccatagtgaaagcccagaaatgtcagctgggcacggtggctcacgcctgtaatcccagcactttgggaggccgaggctggtgggtcatgaggtcaggagtttgagaccagctcgaccaacatggtgaaacctgtctctactgaaaaaaaaaaaatagccaggcgtggtggcgcatgcctgtaatcccagctattcaggaggctggggcaggagaatcacttgaacctgggaggtggaggtggaagaggttatggtgagccaagatcgcaccaccgcactctagcctgggcgacagagcgacactccatctcaaaaacaaaacaaaacaaacccacagaaatgtcttactcttactttcctatattttgtacaataagaaaaactaaaaggaagagaatgtctgttttgctacctttgaatcaccaatatcctaaataatggtactcaaaaaatcctctaaaatcaagaatacggtttataatgattgtgaaactaaaagaacaatgaaaattagtgtaacaatagagtatctggagttacaaatgctctcaatttcaagtttatttttagtctgtaaaaatcatctggggtttgataatatattgactaaagagtttcctgaaattttcatctatatttttttctattttaaaactctttacatatggttgtcttatatttttaactccactgctaactacttgaaggccaattcagataaaaattttaagaaacaacttagctttcactctacagataatattctagacttgaggaaaaaaataaggaacctttaagaatgatttaggatacaaatcccctaatgaaggataagattggttgtttgcatcaggacatccccaaaaagctcatggaatctgctgctttttgatttatgctttcacctaggcagatgctgcacgtgggacctaattcccagcttctgacttgggcacctggggcttctctatctcaagtttccagaacacatttgcatccctccccaaattacttatgtgccaccaaaaaaaaaaaaagtcatctttgctgccccaaaatgaataatacattttttaattcctcagaaaaaaaacttttcacagtgatatagtttggctgtgtccccacccaaatcccctatgtcttcagtctgtttccacctccatctaactgtaaaacacaaatgctaatcaatattaatagtttgatttgtttccttctatacttttctagatgctcataaatatgtataaaccaaaaacatatctaatgttctgagtttttaaaaacaggataataccatactatgtaatttcctttctaaaattctcatggattttttccccaaagattaaacatatagccccaactcatttttactaatgactgcataatatttatagaaagaatataacattttcaactcttcaccaagccatccgtatttttggctatttcaaataattttataataaatttcgacacacataaaatcttacctatttagtcactaatttctacagaatatatatctaaatgactaaatcaatggttattgaacattttaaatgtcaatgcatagaaacaaatcattttaccaaaaaattatagcaatttatattcccatttggagtgaaaaagaatgtggattcctccaagccttaactcttacctagcatacaatataaactacttttcaacagctgtctacctggtagattaaaaattagttttattttcacttaaaattgtatgtccccaatgggtgcattagagtggacatttctaaacattcattacttgcttgcatctttcttctgtttatatcttttgcctagttttgtattcgtttatttctctttttctcaccaacattaggaagtcttcatatattaattttatcaacatgttattatacttgtggcacatattttctcttggactatttttctttgctattttgagttgtgtcttgctattactagtagtattcatattgtgaaactcatcgaccacttatgtatggcttctggacttcctctcttgtttaaaactttgcttacctttagtttacaaagctccttccccagagtttcttctaatatgttgatggttttatttttacagttaccatttttttccctgtgagatttatttctctttatgctgtaagttaacagttctaattttcttccagatgtcgagtcagttatgacaacaccacgtaagcctcttctttgtaatgaattgaaacacgaactttaagtgaataggcatatatgtatatttgaatctgttttgaaccctcagttatgttttacacagagaccattcttttttgggcccattgggtactactgtgattggtaagattggtaagataaaatctctcaaaactttccttgcattctcatatatttatacttccaccggtctttaaaatagtttgatccagtttgccaaagaaacaaacaaccagccacaggcttctgattacagctgcctaaattttatatcctaatttgggagacagtagtattgtgatgatactaagcttttcaacagaggagcatgccatgcctttttattcattctgaattactttatgtccttgtgataaaacaattttcagcagacaggtcttgcctttttgttacatttgttctttctgctttaaattttcttactactcagaagttagtagcctagcaagacttccagatcacacatgaataagaaagcacgacataacccaaccataacaaggtagtgtattgaggatggggagtggtattaacccccttggtggtccctttttccatttcccctaaaacataatcagaaaactctcaagagtgagctttggaaagcaaactaatcaaggagcacagcctaaagctcaacccaatttcctgcttactgactattttcacaaactagagtatccactcaatctattcaactctcccttgagtacctacttagctgaacacttcctgaccagatggcacacttttgactgatagcatcattgatcccttcggtcagtgggttgactgtttaggtggtttcccactcttacctaaatcagtttccactcatgaaacagaatcagtttcctctagagcccttcttctttttgaatagcgttactattcttaattgctcccattttaggctctcgctctgctgagatgttcctggagtcaggtaagttgccaattcagcatcaccaaatcacataacccaaacgcggcaggcttttttacttaaaattttaaaaaccgttatactttctagcacatgtttagaagaagcagtaactaaaagaatcttgatcgtccagctctctttatttactacttttttatttacaagaaacatgacttttataaagtgacgttttaaatctaaggttcagattttatttacttatgcattttttggcaaagtaacattggaggaagaatcgttcagactttcattagttcgagaaggaaattttagactacatccttccagatccatctcagaaaacactggaaaaaccaatttgccttgactttgatgtgatattcatttactgtcatatatatttttaacctcccggatatattttaatttttcattagattttatcttttctaagactaattatttcactttgtatgtttaatagtattaaatgtcaggtccatcaattaatctgccaaaacttcacccataggaaattttgattataaagttgtttttcttcccctataaaatatcttttcaaggaaggctgcccaaaacatggagtcaaaaggaattataaccatattacaatattatttatataataaataccaacactctgctacatgagtatgagtttcttttaacataatttaatctttaacgttcatctagaaaaacaatttttaaaatgtccccaaacgcatatcacaaaaatgggaatgtttctacctgttctttgactgaggcgaggatggcagaggtggtttctgtttcagagccatccccgttggaggtgtttaagccggggctcagggaactcgtcttctctgaggctgatgaaggctggtctggaacaggcatagctcctgcaaggcaagaggacatgatcaatacaatcagatgttgacactaaacaggtacaactatcagaccactttgaagatacacacagaaaaaaaagtaaaactataagctgctgagaaagaccaagacataattatagaacgggagtaatacagtaaagtaaagtaacagtacaagtaaacagaatgttttattcttttatcaactccaaccaaattccagaacacactcacactttctgttttgtctttgaggtaaatggggaaagaaatcatcagaaggaaaaagaaggagagactataagaataaagtaataaagaagtattgagtctaagaagctagtccaactataaatttatgactattttaggtaaatttattacctgcctattggtatatgtgctgttattacatgtttcctccttggttcctggctcatatctcccataacccccgttatagtcttgtgatggtactgggtgtgtcaggtctcaggagcaggcctcagaaagcaatctctctgaccttcccctgccctccttttacctgctctaaggcaggactctaatcctccctgcctcctttctgattgtgggtcataagatcctcattccacagagggtcctgccccctacgtcctggggaaaaaaatgctgatgtcaagaagcctccataaaaccccagaggactgggttcgtagagcttctggagagctaaccacctggaggttcctggaaagtggcacatcgggagggcttggaagctctgcacctcttcccccataactcgccctatgcatatcttcatctgtatcccttgtgatatcctctgaaataaacgtgtatacatatgtgtttccctgagttctctgagctgctctggcaaattaatagaatccaacccagggactgtgggaaccccagctgaagcctgttggtcagaagttctgaggcctggacttgcaattggtatctggggggatgagacagttttggggactgaaccctcaacatgtgggctctgacactctctgagagtggatagtgtagtagatagtgtcggactgatagagtagatagtgtcagaactgaattagaggacacccaactgtgtctgttgcttggcgtgtatgggaaaaaacccacacatttggtcacagaagtcttctgtgtttgttgttgttgtgtgagagtagaagaaaaatagagtttgagagggtttttcccaaaacagaatattttcaactcaaaagaaaatctatcagacattcccctttgcaagaaaatcatacagaagccatgattaataatttaccaataattaaagagatacctgaattaacataagaagcttagttagtattgtgaaatacagtcaataactaatctactccacaaatatttaccaagttcctagtccatgacagacagcagacaaaaactggcaaggccatttgccatagttgattttgtctgagtttatttgtgaaagaaagcagaaactcaaataacattagacccaatgcataagtggatgcatatgtacaggttaaaaacaagattctcagaattgttcccatctttcccgcacaaacaaatgagattgctgtggtctgaatgttgatgtctcccaaattcatacgctgaaatattaatacccaaggtgatggtactaggaggaggggcctttgagaggagatgaagtcaagagggtggagccctcataaataggatgagtccttataaaagaggcctgagagagacttctctaccctcccacgatgtgagggcacagcaataaggcatcatctataaaccagaaagtcggccctccccagacactaaatctgccaggacttaatcttttgcttcccagctccagaacttcaagttaatttccattgcttataaggagccaatttatggtgtttggttactctggtccccaagagagcagccatgaccttgtatcgccacctctctccatgtccaatggttcacaagggactttatgcaaggtgatatggtttgactatgttccccaacaaatctcatcttgaattgtagctcccaaaatccccacatgtagtgagagggaccaggtgggaggtaattaaatcataggggcaggttttgcccatgctgttctcatgacagtgaataagtctcaagagatctgtagctcaaatgaacttaaaaagggactgaagtatttgttacatgtatcatctagcagtgatcaacagagaaagcaatagttaactgaggatatttaccaaggcattacaaaacccccatctcaataaaagactgagagtaaacagaaattattttcttgcctaaagctattacattacacatccctccaggaaccagggttgtgtaaatattaaaagatattttctattataccatatctaagcatcctgggttttacattaagagatgtgatttccacagtagcctttgccctaagttattacgtatgtctagttaataatttagagatattccaacctaaaaaggccccattacagaattttacttaaaatatatgttaaggaaagcagtcatccaaatttcctattgaacatttcatctaattttttatttgttttaattttatgaagtacttataataatatcaccaatggggattggaatagcactgaaaaagtaaatctgttacaaacagaatatgtgagaaggaataataatatcaccaatggggattggaatagcactggaaaaggaaatctgttatgaacagaatatgtgagaaggtttggggaaataatatcaacaaaacaaaatttgagcaaagagttagaatcagattaaatatgatttggcaaaatgcaaccacagctaaaaagattaaagtattgaaggtgatgaataccaacaggatgacagaaagagatttgcgtaattatggtggtgtgttaggaagaacataataaagcatatttatgtattcaacatgctttctcatatggttttcttattcgatcaagtctcttaattatgtaaaatgtaaacaaccagttcagcaaatgttgtgcccagataaagagtggaacctatgaatttccagctagggaaggtttcagagatggtgaaagagcagaaagtaagaaggaaggacaatgcagctcttgtgtgcacagtcacctctggtccctgagaaagccgccgtgaccttctattgccacctctctccatgtccatgggttcacaggggactctatgcaaggtgatatggtttggctatgtcccccgacaaatctcatcttgaatggtagcttccataatccccacgtgtagtgagagggaccaggtgggaggtaattaaatcacggaggcaggttttgcccatgctgttctcatgatagtgaataagtctaatgagatctgatggttttaggaagggcagttcccctgcacgtgctctcttgcctgccaccatgcaagacatgcctttgcttctccttcaccttctgccatgattgtgaggcctccccagccatgcagaactgtgagtccatgaaaactctttttctctataaattactcagtcttaggtatgtctttattagcagcatgagaatggactaatacacaaggagcacctcatgctgagaaagggggactcttacatattttaaattaccattttaatttttgtttatttacattttattgggcccatgctaattcaggctctgagccagtattcttatcaacatatttttgacaaagaaattgtttaagggcccaaagttattaagtcacataagtgggcccagaactcaggctttctgccttttaattcctatttcaatgtcctttgatgtgtcagcctatttcctataacctgtactgcctcctaatgctactctactaactaatttttataaaatgtaactctttaaaagcataacagtgacctgtcataaaaaaatatgggatttaataggcactgaatcaaggtttctcctccggcacttgacaagtgtgacccacacagtatggggaataattaggcctgtttatctacctcctttctccttacagcaataacagaaagagaagtggaatcttcaaggcttattccaccgtacagagctaccgctacctaaagcaacctccattcctgaatgcaaatgacttggaataatttccatgattcataatttttttaatccaaatttaatgtaactattgtgtctggacagaaaagacagtcaccctccaatcacaatcttctcagctcaggtcacacagaagagagagaggaaaccacaaaagacctgccccagtgaatccctggatggccttagggtaagtataaaaagtgttaaacttctaacttcgcagtaatatggccaaatacgtcagtcttaatcacagctaatctactaaaaattagtatttaatctgtgcaaccaggaaatctgggaagtatagagaaataaaaagcaaaaaccaagaacaaaggaagagcaaccaccagcaattctgccattccagataagtaaaattactttgggattttggtgatttattatttctaatataacttattctgtacaatgttttttacataataaggtactaatgcaaggtttttgaatttcttgtggctcagcaacatctcatgaacaatttcttatatcaacaaacattgctctacagtttaattacaatgaatactcagtattcaataatctgtacatgttgaaagttatctacctgtcttttatatgtgatttttaccccatttttacatctatgacatattcaatacatgggttcccagcagtagaattggtaaaataaggaatctgtgtatttttcggccttttgttagccagtcctgctgccaggctggtccagcctactcgcccactggaaaggtcatgagaatgttacctcaccacaatgttaaccacacggatctccattatcctctcaggcttttgccaacctgatatagaaaaatgcacccctttgactttgtttttgtttgactgtgagtagagtgcacaatttacccagatttattcaccctgtacagcacttcttgctacccttgaagtggttaccatgtaagaagtcttcctacacatagtagaattataatctgcaaatacccaagctgcattttggacagacccatcttccacatgagaaaaagagacagcagtgcgggaagaacagccctaaatttcgggtgggttcttctagcagaacttggtaccaacaagtcctatgtccagaaaataataaaacaacaccactagcagtttcagggtgcaagtcaccctgctctatgcccacacatgcatgagcagtgttacggacagaactgtgttccccaaattcatatgctgaagccttaatccctatgtgactgtattggagatggagcctttagggaggtgattaaggttaaatggggtcacagagtggtggggccctaatataacaggacttcatgtgcttatacgaagagcaagtggcatcagaggtctctcttcccctttgcatacacaaagacagaaagccataagtaggcacaatgagaaagtactgttgaccagcggggaagagaggtggcctactggcaccttgatcttggacttctggtctccagaaatatgagaaaataaatttctgttatttaaaccattcagtctgtagtattgtgctatggcggcacaagctgaccaatacaaaaagtgttcaattttctcaactttctttcccttaattcccctgtgggctgggcatggagtcttgggaactgacaggagaaaggtaaaacatctcttggtaacaccttcatctaaaacgaatcacaggtctcaggaggaggcatgtgtcccaacattgcttcaaatcagcataccgggacaaagcaaagcttacaaagggatgtaccccattgtatgaaataagcctacagaataaaacagtatcttaaacacatccataatactaccactttcataaatgatgcaataagaaattcagaaaaattggcctgcataacaataacagcaaaagcagttaggccctgcatgccgagccttcttttcagtttgaactcttataaccataggtaataagatgttatgatgtccaaatgaatagtctaaacttttctttcccaaataggagtctctataaatttacattacacttggcaacatgctagaatcttaactgcattttggaaggccaaactctctagccgtcaatgcagagacaatattcaatgtcatattttattgacatccatcacacacacacaaacacacacgtaaattcttcatatttgaacttgttctttctttagtcacttttgcattgcaactgatgacttacacatcaagacatggtcatcttcaacaaaataactgatgatgtctgtatcacacaaccatccaattaagtgatacagccagcattcttgtgtcactcttacttggtggtcccctcctctccaattttccagtaagttcctgtggccattatatgggtttgctccttcttagctgccctcccctctctataagccatgacctcttatccttccaattctcctctcattctgtcactcttggggtcctagggccctcaggctctgaagtcacatgcttcaaattccagcatttccaaactgcaagtatgctgtgggaagctagagatttcattagttagacttgcactatagcagcccctacccacacatgactatctacattttaattaaaataacattaaaaagtcaactattcatatatttcaactgctccagagctagagatggccagtgggtacactattgaacagtgaaaagtggaagatctccatcactgcagaaagttctactgatagcccaagtctatgcccagtagtaaattctctgatgtaatcttccatctgcagctgaatccaggcaggagaggtcttgagatgtggtcagattaccaggataattggaaggcagaactggtgggcctcctgaaagattctatgtggatgtaagccacagtgagaggagaccaggtgagtccaagggcttggcctgagtgaccggccatcagccaagatgtcaagaatgtgggtggaacagacttggggcagggaaaggcaaccttgcctgcaaactttcaacctgaaatctacctatgactcttatgtgctgctgacatctgggcagctgagctctatggccagaaaccacactctgatgtcagtcagggaatgtaaagattgagagctatttatgacaaacccacagctaatatcacactgaatgggcaaaaactggaagcattccctttgaaaaccagtacaagacaaggatgccctctctcaccactcctattatagtgttggaagttctggcccgggcaatcaggcaggagaaagaaataacgggtattcaattaggaaaagaagaagtcaaattgtacctgtttccagatagcatgattgtatacttagaaaaccccatcgtctcagcccaaaatctccttaagctgataggcaacttcagcaaagtctcaggatacaaaatcactgtgcaaaaatcacaagcattcctatacaccaatagaagacagagagccagatgatgagtgaactcccattcacaattgcttcaaagagaataaaaaacctaggaatccaacttacaagggatgtgaaggacctcttcaaggagaactaaaaaccactgctcaacgaaataaaagaggacacaaacaaatgcaagaacattccatgctcatggataggaagaatcagtatcatgaaaatggtcatactgcccaaggtaatttatagattcaatgccctccccatcaagctaccaattactttcttcacagaattggaaaaaactactttaaagttcatatggaaccaaaaaagagcccacacagtcaagacaatcctcagcaaaaagaacaaagctggaggcatcacactacctgacttcaaactatattacaaggctacagtaaccaaaacagcatggtactggtaccaaaacagacgaatagaccaatggaacagaacagaggcctcagaaataacaccacacatctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatagattaaagacttgaatgtaagacctaaaaccataaaaaccctagaagaaaacctaggcaataccattcaggacataggcatgggcaaagacttcatgactaaaacaccaaaagcaatgccaacaaaagccaaaacagacaaatgagatctaattaaaataaagagcttatgcatagcaaaagaaactatcatcagagtgaacaggcaacctacagactgggagaaaatttttgcaatctacccatctgacaaaggcctaatatccagaatctacaaagaactcaaacaaatttacaagaaaaaaacaacccatcaaaaagtgggcaaaggacacttcttacaggcacttttcatacaggacttttcatacaggcacttctcaaaagacaacatttatgcagccaacagacacatgaaaaaattctcatcgtcactggtcatcagagaaatgcaaatcaaaaccaaaatgagataccatctcatgccagttagaatggcgatcattaaaaagtcaggaaacaacagatgctggagaggatgtggagaaataagaatgcttttacactgttggtgggagtgtaaattagttcaaccattgtggaagacagtgtggcaattcctcaaggatctaggactagaaataccatttggccaagcaatcccattactggctatatacccaaaggattataaatcattctactataaagacacatgcacacgtatgtttactgtagcactatgcacaatagcaaagacttgaaaccaacccatatgtccatcaatgatagactggattaagaaaatgtggcacatatacaccatggaataccatgcagccgtaaaaaaggatgagttcatgtcctttgcagggacatggatgaagctggaaaccatcattctaagcaaactatcacaagaacagaaaagcaaacactgcatgttctcactcacaggtgggaggtgaacaatgagaacacatggacacagggctgggaacatcaacacactggggcctgtcagggggcgtggggctgggggagagatagcattaggagaaatacctaatgtaaatgtcgagttgatgggtgtagcaaaccaacatggcacatgtatacttacataacaaacctgcacgttgtacacatgtaccctagaacttaaagtataataaaaaataaattgtcttatatattatatattcatgtatattatatatataatatatattcatatattatagtatacatgtatatattacatagtatatatgtatatatagtagtattcatatatatatatataatggaatactactcagccataaaaaggaatgaaataatgttatttgcagtgacctggatggaattggagccaattattctaagtgaagtaactcaggaatggaaaaccaaacatcatatgttctcactcataagtgggagctaagctatgaggacacaaaggcataataataatacaatggactttggggactcggggggaaagggtgggagggggtgagggataaaagactacacattgggtacagtgtatactgcttgggtgatgggtgcaccaagatttcagaaatcaccactaaagaacttacttatgtaaccaaccaccacctgttaccccaaaacttatggaggaaaaaaatatattgatgacttctaaacattgcttgtcaaatcttgtttcccgtcctgttccttctcttcaggaaggtccctttttatcttttagtttagagtagctagaaacatttataactcttctctcactttcttcttttaccttcagcaacagacttcaactccagagactctgatgttaactaccttgacttcctgccccctcacaccaaacaaacaagagaaccctgttacagccacacttagccttctttccttctctcatgtagatcaaagaaatgtcttccatttctttcagagaatacccccctccctgttcttgatcctatgttctaaaaaacaaatgttggcaaaatagaattacttttggctttacttccatcatcaggcattactttcataatctgccattaccttatacccaagtgaataatgaaatatggcattagaacatcccaggtattgttatttaaatatatatgtaaatatgagctactgaatgttttaaaaatttacatattttaaaatattttattttgaaaatcttccactgaataggtgacattttaaagactcctactacgtataattgaagaataagcataaacatctttttatgcatattagggtacacagaatgtgtggattagtacaaattagcaacacaaagaacagtattgagcacctcatttgtgtaatcactctcatcaccaaaactgcaattctctatttgtaactagcatatcgctaccaaaagaaataggcatcatgtcattctcactcagaagtgctctgcacacataaacatatattcatcctcacttctcactttacaaagagaaatctaaagttatcgcttatcataatataaacaatatagtaatagttgtcaaaactataaacaattagggcagaaactcaatctgtcttggtctatgttcaatttcccacagctaactcagtatgtaatatatagaagctagttaataaatatttgttgagctaatatatgaacgattagagtaaaatcaataataattgcttatgagagcatgtaacaaaaatataatgggctttgcattaggagcatttctctatgtggcatttgaaatgatactcctttatttcaactcaagatagctgcttttcagtaaaagcagaaataggattcagaatcctaggactagtttaagactttcgcttccgtcaactacctgagaatgatgtacactttgggtaagtggcttccaaggtagaatcgtcgatcaagtaggcttccagaacctgatacttgcaaccaacagcttgcaaatatagaatctggcaaaacatatagagaagatcatgcaaggatgggaagcagcacctttgagccatagtcagaacatgcaaccacaagggcatcagcagacaaaggcaggaggcagaggaatttcagttccacctgagaagttgggggtgtggcattaggtcttattcatggaggcggctacacaggtcatttgctgctgtagtggaagatgtgatggctggagggtggagagctggtgggatctcagtgtggagctcatgtgtcaaacacaaggggattaccgttctacctctgcgttcagacaggcaggagcagtgggagggtcaacatagcttggtgggtcaggaaacccattctgtatccttgcatgagctattcatcattgagaagaatgggatcatcctgaatatcaccacagacttaatttccacctgagttattattcttagtgacatattatgtgtgaaggtaaaaaggaaggttctgtgatgacttctacaaagcaagatggaacggtgctcctcatacaggggagacgcctaagcagccaggctctagcaaactgcggtcagtgaggatgggagcaggtcttcctttggctacgttccgaatgtctcaccgtctgtttctaaagcatgatctcagccaattttatctaatcttaacaagcattacactaacaacttatctgtcttaaaaatattattgaaaaggtagtgcttttaaaaacaaaccagtggttaagggtgaatcaattgctgctgctcctgagctctgccccaggcaagcttgtgacttgagagccagagccaacaccacaggtgaagcaaggaagatgcgcgacggccaagcaacaggttaggctctcagggcagaactgacagatctctcaacagcaatcagggtcccctcagacctgaggactgagaagaaagctaaaaaagtgtaggagatggagtgattgacagtgtaatggcacagggttagagcagagaggaaaggatcagaataaatgtatatagggagacatgaggagcaggaaagagcagcaagtgggctgagatgcagggagcactggcgtgagcctcgaaacactgccagagaagaaaagtggggtcagcagacatgctgttggtagatccttgaagaggagtgtgtgtgtgtgtgtttgtgtgtgtgcgtgtgtgtgtgtgtgcacgtgtgtgtgtgtgtatttctattttattattttattattattatttttttgagacagagtctcactttgttgcccaggctggagtgcagtgccacaatctcggcccactgcaactaccacctcccaggctctggtgatccttccacctcagcctgggactacaggcatgtgccaccgcgtccagctaatttttgtgcttttagtagacatggggtttcaccatgttgcccaggtgggtctcgaactcctgagctcaggcgatccacccacctcggccaaagtactgggattacaggcatgagccaccatgcccagctaaggattttaagaaattggatgatgaccttgaatttgttaatgatcttgaacttgaacctggtaatttcaggaaataacctatatataacgtactatattatcattgttttttaaaccaaataaacattgtatttatggatttgcattttcttggaattctgtgtcatatcccaataatggaagtgtggcacatacattgttggcaatgttgtcacccctcacacatgttggctccaccaaggcattctcaggagtcttctttagatgcgcccttcgtgggatactatattattatatcaacaaacgaagtgagccactctctacaactgcatgtggaatcctggggagaggctagtacaatgaggctgaaggccactggcatacgtatatgagtttccaaggggtccacactttctatttcctctcattgaacactatccagacctctctttggcaaagccatgcacacccaagattggatgtgcaagtaatgattcagatgtctacctctagctgagacctcacagttgatgtccatactatacatttgtaataagccacaatctactgcaaatggctccatcagatcctcagaaacacaccaaattcagcatgagtccaagtctcctgcctggacacacaaaaccctcctaacctgcctctcatgcctgcaatattacctccttcaatcaagtccatgcattattcattaaaagagtcaatcttccttaccaaccatctgatcacataatgctttttccctaaatttatttgagtggatctcagcatctaaacagaggtttccaaactttctttgacagaaaatgtgttttaactcatggcccaattacacataatcatgtattttaacagaaacaagacttcatgaaaaaggaagctttataacatgtgatgcactatattttatattttattccattttatttaaaatgctagtgtcacccactaaattaatggatacaaaacagttcagaaaccactgacacagaggatagagttcgatctgctttgcatgatgtatgaggctgttcttgccctggcccacacatctccactcttaaggctgttgcctctcctctcacaccttacactacacacaccaagcctcttgccactcccaatacatcttaataaactgtgttgtgaacacgcagagttctcttcctgcgtgtgccaattcagtttaccacaattgaatttatcatcttccctttaccatcaccaagacttttgttggctgccaaactccctttctcttttcactttcatagtcctaatggatgcatttcttcctctctgaagccttttggacaactccaggcaccatgaatcacttcacgtcctctttactgttacctttacagcttgaactttcctcagatattacatgatcactaagaactgtgatgatcttatctcttctgggattaaaaaaaacttttaatgtttttgaaatcgggatggttcttcatgtgactatggcccctttttcctttaagccattcgggataaattttctgtcatttgcaattaaaagtgttactaaatcaatgatatactcaatatcttagatctatggaaataccatatattttacattttacattttacatcccctaattagttcatgaattctttgagcacagaaattgggtcttattcatatttataacctcagtgcctagaataatgcctagtaaagagctggcatcattaaatgcttattgaataagtcaaaatgaaagaacatttataatttattgtcagccccattttaaaatgtcaaggaattttacacgtacaacactggcacataaatgtcctataactcttcccaggtttacaaacataaatattcaatatgttaaattaaatctattaagtatatagctataaaaatagaaatattcaaattaatgactttggttgatacatgatattaaagtagtcaaaccatatatatttctaccaatcacacctatgtctacatttataatggaaatatgtctagataaaattaataatcataataagttctagggttcatctctactacaaattagatagtgacacatttcttgcatcaacaaccatcctagttcccccagacaacacaaatatatttcaacagctgattgatgggtttaccaagctacagggacacttatccttatgccagaaaaataaagtctgggattctaaaattacagacccatcaaactaacagtagattgagccgaaattgaaataggcacagtactttaaaatttgactcttccagaataaaagaggaagttctaacatatttcataaaaatgaagttcagtgttgaattgactattcttttggctgaaacttcaaagaagcatgcttaccacagcccctaatacagtgttcaccacacacagtgactgtccagaatacactgtcactgccaaatgtctcaggttctggagttcctctcacacagctcctgtagacttcgaatccatctcatacattgcatctgtgcaagacactgaataaaagcatctaagcttataagtgaaatacaatctgtcttcctaaatattctccctagtaatatcctaaacaaatacacagttttccagcttagattccctatttaatcatagatttacatcataaaatctggcaaaaaaacaaaacaaaacaaaaaacgtgcttaagccagtcacaacaattttaccactgtgaattgccaactttgactgtcacaatctattaaacagaaagtccccaaatgccagccacacagtggttcgcaacatgttcttacttcacagtacttgaaagtgtccactcaaattatggcaatttacccttcatattgattgcaaatatgtatctgccacttcacaatttctcaagataccgaagctcaatgacacatctagtttttccagaattgctatcaatgggcagtcaagcacaaaaaatctcactctgcaaacagatatctgcactcagcccatatgtttaacctatcacaacagagactgtatcaatcagtgttttaaaattaactataaaaccgagtttcaactactcttatacaactttagtcactaccattgacttagcagttttttaaataaattgctgaccttaagaaaacaaagactgaatagagccataataattttatagctgccaagatacattgacattttttacccgcatataacaaattttgaaattttaagtgatataacctgcctattacaacacatgactttaaaagtaagctgtgcttaggagttaaatctaaattatatatatttaaaaggtattactgtaattgtaaatgttacatagcaaagaaactcattttttgtatataatcattcaatattacacttcagggcttcaaataccctggtatgtgatcaacaactaattttaaatggacaaataattagatattatgaaaaggggtgattatcaattcccagccttacttttttgccaatttgttttctgttttcttttaatttacaatttgtacaaatcattaccctgtcaagcaaaatttatagcatttctttaccgccaaattcccattttctccaaataagactctcagatattgttccctttttaaattacctcctaatgaaaatattttccctctcacctgcatttatatcttatctgcttattatttgttactatctctgttgggttgagtttgggagtatgtgataattttcaattatgtccacaggttctttcatactcctctcttcacgaagtagagcttacttcacctccccttgagagtgggctagacttagtgaccctttacacaaataatatggtagatgtgatggtatatgatcctgagacaagttatgaaagacactcagacttccctattgatctctctttgatcattcactctggggaagtcagcttccaggtagacaggatgctcaagcagccctatggagaaagaggtccacgtaaggaaaaactaaagcctcctaccaacaactggcaaaggactgatacctacaaccaatgggccatatgagtaagacatttagacagcagatcttccagtcccaggcctgcttcagatgatatagacctagctcccatcttgactgaaacattagaggaaactttgactcagaaatacccagctaagtggctcctagattcttgactcacagaatccatgagataaatattagttgtgttaaggtcctaaattctagggcaatgtgttatgcagcaacagataactaatattgagcgtagtgacaatcttcaggtgtttttgagggtcattacctaatgctgaggtttcagtgatttcattatagtctttttttgacaccagcacatggaaggagtcagaaaatatgccaggccagagattctgctccatccccaaattgtattctgcatagtccctcagagtttatgacttatcacagactcctcaggagccatctccaagaaaggttcaaagttaggaagaaatcaaggaaaataatgtatgaatgacttagcatgagagtaatcatgatttcacagtacattctgtctgtttaaagatttctaaagatgttcaaggattttacttagtatatatacacatttaaaaagcatttcataattattgctgaagtttaggttgatatttttggacacggatatcttctccatggtttacataaaataagtataaaataatagtcttacatatgaatgataatgaggatatacaatgtttttgtcatcagatgatctaatcttattcatttactataccttatttaaaaaaatagacccttgtatatttaggtttcaagtatttctcttaatgagtgcatatcataatctataattatatagctatgattagtgctaagtttccaatgactaattttctggcagggtttttgcaggatcctctgggcaagtgctcacactgaagccagtattctggcacttgactttcttcctattcttcaactagtacctttctggtcttggtatgaaccaactgcataatctcccaactcaaggtggagtgagttaattttaccttgatagatactagcgctgctgactgactttccatttttcttcttcatctaggacagcattcacctaaaatcagtcttgctgttatgacttgttttggttaaggaattataattgagtacaagcatttaagatcccctgtatgattcctcattctctgtttcttcctactttgaaaaaccctgtgtgttgtattagggtggcagaggcataagagattgaagagtaactatgtggaagaggaggtttcatctacccacagaggatatgttgcttgagtgattaactagactgcttggattaagccagtgtgattttggtattgtttgttactttggcatgcccagcccatcctgactaatacactgtccagagtgcatgacgggggatacctacaaaagtttctgagttaaaagaacatgatagtctaaatttctcttgaaaaacaaattttgttttgcccccaaagggttcagctttaattacagtcctactggaaaaatatttctctggatcttagtttcctcattggtataggtaacattggtatagctctatattgtaggtttgcgtcaagattcaaaaacagtaatttttattatattttaaaaattacaaagcttgtgactagacattagctagtctagactagactagacattaatacaaaatggattttaattcctaaattatctttgttaatatattttaaattatcttatacaccaagatgtaatcaataataattgataaatgaactatgactatgaatactcatacaacattgtgatatatggtttaagcaatgcactttttaaaaccaaatgtatttcttaacttcttggtatgataaaattaagatttcatagacactcacctgtccggggtaaaatttagtagacttttttatatcaggaaattaaagaaacactccactaaagtgtaaacctgaaatttctacttagggaaaccattaaataatttaaaagagatttatcagtgaattttgttgatgtgctcacaatttaatcaatattaatcatcttttccaccattcattctgaaatttctcaagtgtaaagcagaagaaaagacagcttgtttccaacttttatttcaggttcaggggtacatatgcaggtttgtaatataggtaaattgagtgtcatgggggtctggtgtacagattatttcatcacccaggtaagaagcatagtagacaataggtagttgtttgatcatctcccttctcccaccctacaccctcaaataggtcccagtgtctgttgttcccttctttgtgtccacatgtactcaatatttaccttccacttataagtgagaacatgagggttggttttctgttcctgctttagttcacttaggataatcgcctccagctccattcatgttgcttcaatgaacgtgatcttgtgctttttaatggctgcatagtatgccacagtgtatatctgccacactttctttaaccagtctactgctaatggccatttaggttgattccacgtttttgctattgtgaacagtgttgtgatgaatatggtgtaatgatttacattcctttgggaatatacccaataatgggattgctgggttgaatgacacttctgctttaacttctttgggaaatcgccacactgcttactacaatggctgaactaattttcatcccaacaagcagtgtataacattcctttttctccacagcctcaccagcatctgttactatttgacttcttaataacagccattcagacaggtgtgagatagtgtctctctgtggttttgatttgcattgttctaatgattcatgatgttaagtactttttcataaattgttggctgtgcacagtcttcttttgaaaagtgtctgttcatgtctttgggccacattttaatggggttgttttttgcttgctactttaagttccttacagattctctacattagacctttgtcagatgcataagttacaaatatcttctcccattctgtacgccgtctgtttactctattttattttgctgtgcagaaactctttagtttaattaggtggtcccctttatcaatttttgtttttgttgcaattgcttttggtgtctccatcatgaaatctttaccagagcctatgactggaatacaatttcctaggttatcatcagggtttttatagtcttaggttttccatttgtcttgagttgatttatgtaaggaagggatccagtttcaatcttctgtatatggctggccaatttatcctagcagcatttattgaataggaagtctttttcttattgctcattgtcagttatgtccattagatggttgcaggtatctggctttatttctgggctctctattctgttccactggtctatgtgtctgttctttttttttttttctttttccactaacatgctgttttcattagtgtaggcttatagtatagtttaaagtcaggtagtgcgatgcctccagctttgttctttttgcttaggatttcttgggctattggggctttttttcgttctatatgctttatacaataggtatttctatttctgtgcagaatgtcattggtggtttggaatagcattcaatctataagttgctttgggcagtatggccattttaacagtattcttcctatctatgagcatgaaatgttcttccattttatcagtcatctcagatgtctttcagcagtattttgtaattctcattgtagagatctttcacctccctggttagctgcattcctaggtattttgcactatttgtggctattgtgaatggggttggtttcttcatttgaccctcagcttggacactgttgatgtatacaaatgctactgatttttgtgcactaattttacattctgaaactttgctaaagttgtttgtaagatctacgagctctggggcagagactatggggttttctaggtatagaatcatattgtctgcaagcagagaaagcctgacttcctctcttcctatttggatgccttttatttctccttcctgattgctctggctaggacttccagaactgtgttgaatggaagtggtgacagtggtcatccttgtcttgttccagttctcaaggggaatgcttccagcttttacctgttcactatgatatggctgtgggtatgttatagatggctcttattattttgaggtatgttcctacagtgcttagtttgctgaaggttcataacatgaaggaatatttaattttattaaaagcctttctgtatttattgagataattaggtttcatgtttttagttctatttatgtgatgaatcacatttattgatttgcaaatgttgaaacaaacctgcatccaggaataaagcctacctcatcatggtggaataccttgttcgtgtgctgctggatttggttcgtttgaaatttgttgatgactttttacatcaatgttcatcaaggatattggcccaaagttttctttttttgttgtgtctctaccaggttttgctatcaggatgatgctgtcctcatagaataagttagggaggagtctgtcctcctcaattttttggaatagtttcagtaggattggtaccagctcttcttatacacctgatagaactcagatgtgaatccatctggtactcagctttttctggttcgcagtgtttttattactgattcaattttggaactcattatcagtctgttcaggattgcaatttcttccttttctcaccttgggagactgtatgtttccaggaatttatcaatttcttctaggctttctagtgcatagaggtgtgcatagaggtgtttgtagtagtctcggagggatttttgtatttcttgggggtcagtggtaatgtcctctttgttatttccaattgtgtttattgggttcctctctcttttattattaatctagctagtggtatatcaatcttatttattctttcaaataactacctccaagatttgttgatcctttgtgtaacatttttttctcagtttcattcatttcaggtctgattttggttatgtcttatcttctgctacctttggggttgatttgctcttgattttctagtttctctaggtgtgatgttaggttgtgaatttgagatctttctaacttttttttatgtgggcatatagtgttataaatgtttctcttaacaatgttttaggtaggtcccagaaattctgatatgttttatctttgttctcatcactttcaaggaatttccttattattctgttgtggttttttgggggagggggcggggaggtggagagttctgtagatgtttgttagatctattcggtcaagtgtggagttgaggtcccaaataacttcattattttcttctctgatgatctaatattgtcagtggggtgttgacatcttcctctattattgtgtggttatctacatctctttgtaagtctctaagaacttgttttatgaatctgggtgctcctgtcttgggtgcatatacatacaggatagctatgttttcttgttgagttgatccttttaccaatatgtgatgccctttttgtctgttttgattgttgttggtttaaagtctgttttgtctgaaattagaatagcagcccctgcttttttctgtttatatagtggatttttttccatccctttactgtgagcctgtgggtttcattccatgtggggtaagtatcttaaagacagtaaatcttgcttctttatacaatttgccactttgtgccctttaattggggcatttaggccatttacattcaatgttactattgatatgtacagatttgatcatattatcttgttattagctggttattatgtagacttgattgtgtggttgctgtatagtgtcactgatttatgtagttgtgtgtctttttgtggtggctagttgaacattctttcctttccataattagcactcccttcaggacctcttgtaaaacaggtctggtggtaacaaattccctcagcatctgcttgtctgaaaaggatctcatttcttcctcatctacgaagtttagtttgactggatatgaaattctccgttgcaatttattttctttcataatgcttaatataggcccccaatctcttctggcttgtagagtttctgctgaaaagtccaccagtagccagatgaggttccctttgtggatgacctgtaacttctctctagatgcttttaatatttttttctttcacttcaatcctagagaatctgatgactatgtgtcttgtcgatggtcatcttgtaataccttgcaggcattttctgcatttcctgaatttgaatgttggcctctctagcaaggctaggaaagttttcagggaagatatcctcaaatatgttttccaagttgcttgcttactctcccactctttcagggacaccgatgagtcatacatttggtctctttacataatcccatatttctaggagtttttgttcattcttcttttttttttttgtctgatcattttattttgcagaactggtctttgagctctgagattctttcctcagcttggtttattctgctgttaatacttgcaattatattatgaaattcttgaagtgagcttttcagctctaccaggtcagtttggttctttcttaaaatggctatttcatctttcagcttctgtatcattttattttattccttatagttcttggattgagtttcaactttctcctgaatcttcatgatcttttttcctaccctatgttcctgttctgaattttatgtctgtcacttcaatcattttagcctggtgaagaaccattgctgaagaactagtgtggtcatgtggaggtagaagccactctggctttctgagttatccgagttcttgttgtggtctttctcatctgagtaagctagtgttccttcaaaaagactgctttttaatgctaacattatgcaaaaactttgtgcctagatttaacataaaattcggaaaagaaaaccaaaataattttaaacagttataaagcctaggctgcaagcactacaaaattattaacaagtggctgattcaagaatatagaaaatttttttaaatattataacttctatctgatctgagtaaaaaaaatacagtactcaaaaactgaacactggataaacagttgtttagttgttatgtgaaaagtcaataatcacctctaagtattttaaaaatacatttaaactgataaaggaaatgtaactccaatataaaattcatagtgccattataaaatgttgcttaacacattgaaaaattacacagtatctggctttcaaatattcaaacaacttaaaacaataaaaacaacatattgacaaatttctcagcagtcatattttatgggtattctgctagttttcccctatccatttacatatatatgtaaaggtacacacatatacataaatacatccacatccacacaaatcgatatacacacacatacatacacacacacacacacacacacacacttaacagaaatgtgatgatgctatatatattgtctgtaacttttttttccaatcagtatgttttggagaccatttcagaccattacttatgaatttatcatgtttaaatctgtcgacagctatcccattgtattgatgtaacatttttagttctctcctctacaaatgttgttttcattgcattgcttttagttgttatgtgaaaagtcaataatcacttctaagtattttaagaatacatttaaactggtaagttaaaggaaatgtgactccaatataaaaattcatagtaccattataaaaagttgcttaacaccctgaaaaattacacaatatctggttttcaaatattcaaacaacttaaaacaataaaaacaacatatagacaaatttctgagcagtcatattttatgggtattctgctagttttcccctatcaatttacatatatatgtaaaggtacacacatatacatacatacatgcacatacacacaaatcgatatacacacatatacacacacacacacataacaaaaatgtgatgatgctatatatattgttctgtaactttttttccaatcaggatgtcttcgagaccatttcagaccattatgaatttatcatgttgtttaaatctgtacgcagctatcccactgtattgatgtatcatttttagttctctcctctacaaatacttttttcatttctttttttattttgctcataaatatatgttgaaatcaggatcactttataagggtgtatgtgtgtatgtgtgagtattattttagaataaattcctagaaatgaatttgctgtgtctaagaatacaaacatcttaagctgtgacagatgcagccatcttgttcccaacgcatttccaatggagacttcgccaacaacataaaggaatgccaaattacatgccctttggcaaacagagatatgagtcgtcatttaaatttttaataatctgacagttaaaatgtaatgtataattgttttcttttgtgtaaaatgacattttaaactgtagagtccgttagacaaaaagctgattccattaacagaaaaacatgagtcatctttctatgacttgtcaaagtagtgttgttgtatttctcttatagcactttacccactttactgcaattacagataaaaatcttctgacccttacatccaatgtaaaaagtcattacttttaacttcatttcacaaatggagaaagatgagactcaggaaaaataaacagcatgtacagtctcagaagtgtagtcaggggcagtcaaagattttaaactaaatttctgacatcttgtcatgtattattttgattagaccccagaatagtcaatgtttggatgtaatagttcttttgcatatacatcctattacaaaacaatacacattagtttcaaggaagttgtttttataattttagataaatccttcagctttgtcacttagacggtaattacttctgaaatcctgaagatgccatctttctaattccctatgataccaatatctatttaaaatttgtatttttaattgatacataattgtatacattcatgagggagtatgatatgatgttttgatatatatttatggtgtggaataattaaatcaggatagctaacacatttataaccataaatttttgtttgattaaaaaaaatttcacttctactgttttaccaatattaaaatatgcaatgcagttattttagtcactattctgtataattgatcaggaaagctcattcgtcctgtctaatggaaactttgcacctcttgaccaacatttcccctttccccatccactcaggccttagcatctggtaaccatcatatagtacctttttaatgtgttgtgaagtcagttatcttccaagagaccatgcttattcaaaactccaaagacaaatttcagaaaagctgtaatttctctgtgtttacaattactttatgtaaccatatcatatagtaaatcttagatatgagtaaacaggtttaaattatcatattcccagtctaaaaataatatttaacatttcaaaattcatttgtagtattctctactgtatttttaaaagtaatttccctgaccaattaaattattctatgtttaggagaactcccctcatggcagtagacttcacacattttattttctttgttctttcttttcagtacatttagaatgtttcacatcatcaacagttaccactctctaatacataaattattcctgaataaaatgtcaaatattttaatatttagttgttagaaaatcagtcaattataagtgctcaaaaatattaaacaaatttaaaataaaacaagaataacctgtggaaaaataaactttgactttatgtaaaaaaacaaaatttctgtaaattaggtaggaagcacttgcttctttacatagaaatattttagcatgattggtctttttggagggagaggtccaagcatgaacctgattataatctacctttttatgtcactgtttttttaacaaactttcctctccaaaagataattgggagatgaaattttaatcaattagggatattatattttacaaagagcaaaaattgttttatgtttaactgtctattatgaaaaccttaataacctgcaggagctattaaaagcatactagcaaatgcttaaaatcagaatttgctttttataaacatgtccaaggatcttaaggaaaatgatacataaatataaatcaatatgatgtttctttttaaaatctcaattatgcaaacatggtagttatacagatttttgttagacaaagcacaaatattcaactacaaaagttttttctatatttattttacaatcaggtttcttatcaattaatttctctgtcttagatcaaaaagcaataaaaatgcatatcagtgtcatactgatctcagcatgtatgctaaagattatctatacatggattgttatacatatgaggtaataacattctaagttaaagagaaatttttacagtgtaataataacactaattgtgtacgtactatggaccaggcattattctaagctcctccagtactgactcaactaatacagcaatgctatgcagtacttctattattatcctcttttctagatgatggaactgagatacaggaggttaacctccccaaggtggcaaagggaagggctactgtttgaactcacatggcctatggttcagtcactacactgtgctgttaatctactggatgcctctaaatactgataccaatttggtaaattattcattaattaaaaaatcattcatggaccacatactttgccaggtccagtacttggcattgagtactggatgcaaaaaaaaaaaaaaaaaaaaatcctatttatccctccttcctactttggagaagccataggtaaaataattaatatagcaattggatctaaagcatacattttggttatgaagaaggaaggtttctaagtaggaaagtcttcagagggcttgctttggtgttccagtgcctaccacaatggccacgtattctagaagctcttgggaatgactccattccacaatccttgttacccagcccctcattgcacctgtggtcatctatctactccacaggagcctgggacccttctgcctcctctggttaaggggcctattaccaggagctagttgtgttgcttctaaacccattcatttcaattttatctaataattatattatgtgattaaacatatgtaagacaatgagacataactgcatcaagaatagtttttgttattttatgaatacttgttgaaattcctttaagataagccactgaaaaatgccgtggtattatagataaggtaattgtaaaaggcaaaggaaaaattataaacatctagaaggattcttctttaaaatacttcaaaagtttcttagattcctcctagaggaaggaaggaagagtagggagtggagcagtaagaatgctcattccatgttattacgagcagactcatatttaaataactgacctaggtcctatacagttagtgaacacatgtacaattaagttaaaaataaaacgaatacagcatttatgtagtttttttttaatgattctctattttaaatgactcctcttaactcaatctcttgattgaaagagtttttaccaaccatggtctcaacacttattggttgaatgaatgaacgaatgaacagtaagtgaattgatcacgtttaacctattctgcctgttatgtgattgtttagttggtcttttcattgtatgagtatttgttttgcctggaatcatttacttgctggatcaattagtcatttattaacttaattaagaaacaagtggctactggtacttgatgatgtcaataattccaccaaagacgataccgagtgttgaagggctcttttgtttcgcctggaatctgcctctgctcccttgtaactgtgtctgcacacggcacccgcatgaggcaatgcactcggatagaccaatttcatgaaactgtaattactctgagaacgatgctaaatttaaattgtacaagtgactgaatttcaatttagaataacaaatctacacatcatcttattggaaaatcattatctaatttctgtgtaccacacatataatttgcacaattgagaaaaaaagtctctcaatttgctatcttaaaaagtgaaacagctttgtgaactttgaacagaggattaaagttccattgatattctgaacaaagtgaagtgaactaaataggaaaaataatgttaatcagaaattaatttgtagattttatattcaagatggtacaatatctagtaacaatctaatcgctttttcaccaaggaaaaagtaaataataaagtattggatttgaatttattgtatttaaatttgtatcataatatttcaataaactcaagttattagagttgctacctactgatttagaacaaacaactctagtgcagaggatgaagcttgtgtgaatacaggaaactctgttttggctgtaaaagactccatcaggttttcaagtagcataggatctaacactaattatttctggtatactgtgcactattttatacaaaaaatgtgtagcttatattggtaaccaagaaaacttcctatttaaaaatctaagttgatcaccatagttaacgcaatgggcaaatttggaaaactagattctaccataattagaaaaaaatgtggaaattgaaaaatgaaaggaccaggtcacatatatatagattaagtgacattagtcaaataagagaaaaaattgtgttatccacaggcataggcgacttctatcatatttagtttctattatctagaaaattaaatgcacctttaaatacaaaaatatgcttactgatataactggatgaaatctcaatttcacgttgtcaattctagagtcccctacaaaaatggcatccattctatacatttcctctttgcacacagcaaaaactacagatgcacatgagtaacccttgtgcagcacaagggagagtaaggactcgttgcccagacatcttataaatgggagggtaatgaggcataaagaaattaagtaacattttcaaggtcataccctgagtctttaatagagcagagaatagaaacgtaagttttggttattagatctatactgtaatgtctagagcatgcttccaatcttgcaaatcttgcacaacaaaccaaaatgaagtacctggcacaaaatagacctcatatgtgcatatgaaacacttgcttatccaggaaactaaatgatccaaaaaagaattattttgaaaagtaaattaaagacaaaataaagctccattacaatttccaaatgaaagcttgctttaagatggatgatagcaatcaagcaaatttctcctttgcttgcttttatgcatgacatattttgtaatgaccttctgagtttaacccaggccttcacgaataataagtttatcgtcctggagttgcctggagcagctctgtacagcaatacatcttccacatggactggtcaaaccccagtactgccttctgtctagttattttctcctgttcatatatggatttggatctgaaaccacacatttgagttcacaaaagaatgataattcaccaactgaattttgcctgggcaactgttcttaatctaaaatacagaactcctttccacttgctgttagtaaatattactgtttggctctgtgtccccatgcaaatctcatgttgaattgtaatctccagtgttggggtggatctgagtaggaggtgaatgggtcataggggcagatttcccccttgctgttctcatgacagtgagttctcatgagacctggttgtttaaaaatgtgtagcacttcctccttcactctctctctcctgctggccatgtgaagatggtacatgcttccccttcaccttccatcatgagtgtatgtttcctgaggcctctccagccatgattcctgtatactttgcagaaccatgagctaattaatcctcttttctttataaattacccagtctcaggtagttctttatagcagtgtgagaaagaactaatacagtaaaggcttacataaggcaatgaaaatgggagaaacacactctttactcagccattgtgctttctgcccaactacccaagcccaagtaaccctatgacagtaagtcaatggactaaaaactcctgtaggtcatttcattgtatgatcatgacccattctgcacaggttatttggcttattaatgttccacctgcctgtgcttcaattgaccagagaaactcttgtagaagaaacactgacttagctttaattgtcctccaaatttgatccaatgagcattacaagagcttccaaagtaagtaatagagaattcagaggaaatggcttccctgaatgctactttaaacatttcatattagcaaattcactgacacaatttcagatattctcattgaatggagaaacatctttacaaggcacttttagcgtcaaaaatggatgatatgagcttcaatgagtacagtggaaattagttgttttggttgatcagtagctggtttccctgtttttgttcattgcatcttgatcttccttgacagacttactcatcctgacattgcatgaaattttatggactcccaatcaagggtccacaactctgcagtcagagttggcccccaaggatatccaaattccaatccttggaacttgtgaatatattatgttaaatggcaatgaaaattagggcacatgaaagttaggtttctaactagctggctgtgagatgtggagattatgctggattatctggttgagcccagtgtaatcacagggtccttataaatggaagagggaggcaggaaagtcagagtcaggaaggagatgtgacaaaggaagaaggaatgatgtaattgctggcattgaagatggaagggtccacgagccaaggaatgcaggcagcctctagaagtcagagaaggcagggaaatgggttcttctctagaggcttcagaagcagtgcagacctaccaacaccttgatattggccaagtgaggcctatttcagactcctggcctccagaagtagaaagtaacaaatttatattgttttaagtcaccacatttgtgacaatctgttacagcagccgcaatttcctggcccattgtgggcatgtctctgagtgggctcctcttgggatcaaaaagcaaaaaaaaagatagaaaacagttgaacttgattctgctggtgaggccaccccaaagccactgtctactagtccctgatgctcatatccctggagtcttcctgggtcctgcctttcctaactcctggcttttggacatttccctttcttttatgggcatgtcatatggttccaacatgtgacttttcctttccccctggaagcaaatcagtggtttcttcaacttgtaaccaaagatcgtaactgatacagttcagtcagctctttaacctggttctagcaatgccattagttgactgtgctattaaacataccttttctgtgggccagctactgtgctcagcactgaggatcaaataataaacaacaaaaccagtttctactacaaagtgttactgagtagccaatactgcagacccaatgcacatgaatcaaagtcaaacttacatgtatgaaaaaaaaagtgtccagataaaaaataaagaatattatctaactcagactgcaaatttatcaagttccattggccatggggcaacatgaatatggtaaaatccatcctcaataagtgagtcattaatcctgccccccccaccctcccttcctttcttcctcatagagaaaatgtttatgagcctctatttgatgcattgagcatagagaataccagaccaatttaatgcagacaagcaaagtcagaggatcttgcagttctgtggttctaggctaagggcagatgaattaagagagagtctctataatgaaacaaatgttaaaatggttagactgggatggtaaggtcaggatcatgcctggggaacacactgctgggccaaatgcccagggacgagcagaagccgctcagggggaaggtggagaaggggcagtcccaaccactgggaggtgtgacctgggcagaggcagtcatacacacagcaaggttccaggctgccaggtggatcagagaaggggagcaaagaccagaagaaaagaaccttagatgatgagactggaaagaaaaggaaagccaggccagacaaggtctgtgtccactcttctgcattcacactccttagattatctaaaaactgacaatgaagtaaaatattttgtatgtgaggtatggacttcaagatcagatttgaatattttggaaatattaaaaatatagcttgaaaatggcgtcgaactctcggcagagctattataaggctcttggggtcgtctgtgtatgcaacaagctcaaatgagatgtagaggaggggataaattggagatgcaaggaattcacctccacaggccttttgatagacataggttttccaaaatgactcaacacagcttattgttagaaaacaaatcaaataatttgttaataataatgtattaaaatttcaattaaaataattttaaattgtaaaatgctatatgttcattacatcagaatagatctgttatacactgtggattctgtattatttcttaataactagagtcagtatagagatagaaagcaaaagcttgggttttctaaaatacatgccatgaaactagcactgtaatgttcaattttgggaaatctcatgacatatataaccaggccttttaactatttaccttctgtaataagggctcatgttagacatgatttttatgtttccattgtttgcaccaaataattaaatcacattccaggaatcatttatttacatatacttgcattgtcaacatccacttggctgactgagggaatgtgcaccccatagggagaagtaaaacattccatagggataataatgcaagttacaatggtattagtgttggtggctcagagccgcttgatgttcaaatgggtggtgatatggtttggctgtgtccccacccaaatctcatcttgaatttccatgtgttgtgggaaggacccagtgggaggtaactgaatcatgagggcaggtctttcccgtgctgttctcttgaatgaataagtctcacaagatctgatggttttaaaaagagttttcctgcacaagctgtctctctctttttgcctgttgtcatccaagtaagacatgacttgctcttccttgccttctgccgtgattgtgaggcttccccggccacatagaactgtaagtccactaaacctctttcttttgtaaattgcccagtctcagctttgtctttatcagcagcgtgaaaactaactaatataggtggcttggggcacttaactgaccctcaatttagaccagggtggtgctgggagtctcatcgaagtcatggagggaaggctttcagtcctgtctcacataataataataacacgctgtgaattctatttcttatctcctctcctccctcctgacatatggtaacataaaatttcaaacctaccttgaatttcagggcaatatttctaagtcagaaatgttcacggtaataaacacctcaggaaaagagaaccaggaaactgattgatctctgtaccatacagctatggccaggagtgtggcatctccttgcatgccagagctcaccctgagacccaccccaccccactgcacaacactccatccatctacattgtcatctgggtcttcgtgactccatgtagttagtacaccagcagcattagctatcatctgggagctcattaaaaataaaaaatctcacctttccctggacctaatgaatcagcattgtaacaagatgctaagcacatgtgaggggcacagatatagatgaatagcatctcctagaattgagtaatgtgcaacctatgcagctgtgtatggtagctccaatcccatcagtgcttcaatagtgttttgatggcaggaaaaccattggctacacaatgcccattaattactagtaggccatgtggtggcaggtgtgaggttgtgtgtgggcatgtgtctatgcctccatctgttcatatacacccactgcatctctccaattccacttccagaaatgcagaactcatgcctgtgcacctctgtcctaagacaaaagatcactgagtatgtgtcacactcaagagatggtttagaaatgaaccacgaacaagaattatattccctttgacaagcaagttagatgaacgcccattttttatcttagggtcttttggaaaacctccaatataatgctcaatagcccctccttcatcatattgaaaatggattcctaggatgcctatcaaggcagactggcatacggcaccattctgcttgagtcgatgctaggttttgactggccaagcactgatgaccactttgaagaagaggcagaggcagttgaggtaagctctgtatttggcaaatatcaaatgaggagcactgggaggtctgttgacagagccttcatcgctgttccccctggctagaccattgtacattatttggataatatctgtcaaattatgtaaaaagaaaaatgtatggtagatataaatattgtgtatatctcatagttttgtctgctaagagaatattccaataatgtatcactaaattcttaactgtaatacaaaaattctaggttgaaacaacaaactccttcatttccactaataatccaaaatgggagttgacctgccttatcacactaattttttttttctaattacagcattcagcatgaaaaagctcttacatgcatctttatgaaactaaatggaacaggttttctgtggtctcttcattagtctgttgtcttcctgacaatcactgcacaatattagggctgtattatactaagtcatgagcagtaaggggcacctagcactcagagagtctctctcccactcaggagttttgttttgttttgttttgttttgttttgttttgttttgtgacagagtctcactgtgtcacccaggctggagtgcagtggtgccatctcagctcactgcaacctccacctcccaggctgaagcaattctcctgcctcagcctccccagtagctgggattacaggcatgcaccaccttacccagctaattttttgtattttcagtagagacgggttttcatcctgttggccaggctggccttaaactcctaaccccatgtgatcggcccaccttggcctcccaaagtgctaggattataggtgtgtgccaccacacctgggtgttattaaatagccaaaacatctgagacactaagagacattgctgaagttcacataaccaatgagtaactaagccagacccacactgcatcttgtgatcacatactatcccatgctcattgataaaaactacctgcaatcatttgtgaggacaaaccactgccacagacgaatcactgagaggtcccaagagaaacgaagcctccctaagggtcctgatgcccagtgtcttcaggatcccagttccttctccatctttcaaacatgtggggaattcagtgacgaaatattgctgggagttgtctggcccagacttttatttctgtaggtaagagctcccctcagttaacataatccagcccatttctcattaaggggaaagaagatagtttttgtattctttgtctttccatagactataaataagaggcaactcccctcagaatcacatcagtggttctcaaacttcaatatgcatccgaatctcctggggaccttgttaaaaatggagaattctaggcatcagactcagaacttaaaccttctgaattccttcagggatccagtcctgggtcactttcgggactacctgctctatgccttgctttgaaaacccagacacagaaaccacagtgaggctgaatctccagagggaactttatggggtgcaaagttggggcctccagaggtctctctgaaggtgatgcgcaccaggtccccaacagtattaacagaaatgatatggataacacacttgaatttataattaactacaataagagcatatcagcagaaggcaatcatttcacatttgtaattgcaaaaactaaattcttaaaggaattttgtggttaatattgtatttgagcaattctcgtgatgtacttaaagtgaatattatacatgcatataaagataactgtaaaacataacattcttctagagcttaaaaatggcaatttattctactaataattttacataatatccatttgcctatatcactgaaacagacacttaattcactagaaactgaattccattaatgaaggtttaagtataaaacaagatggtaaccagagatactaagtggacagtacatatatgcaaattaacacacacataaaatatatgccccagaataagccattcagttgaaatcattacagtataagtgattaataattatattttcatatttcagtaataagatgatttggccattcataaatatgtataattttctgtaccaacactgtcgacacataatttgttttccaaccccactgattttctccaggcagatgtatcattttccaattataaaattaaacattcaacttgaaaatatgttagcagtctaattccagtttgaataactttctgtatattttcagaagtatattctggaagaattcagggggaaagtatggaattcaaaatggctgatgaatttaaaagatgtaatcagcctctgagaagtattaccaccatgggctaagttgtgaagaggagtagaagcttttaggataaggaaagtcattgaagaaaagaaacagaaactccctagggcttaggagacctcacgggcatcacagacatagggagagacagaagaagaatggaaacctggtctctgtatttttcaaaacatggaactaatatttatgggttttgatagtaactcactattctaaccttaacgtgaatactcagtactgaactaataacacttgaagtaaacagaattagaatatataaggatcctgaaatactactgaagattcagattgttacacgtggtattaaaacagaaaaaaaggaaagaaggaaggaaggaaggaaggaaggaaggaaggaaggaaggaaggaaggggtaggggtaggggaaggggaaggaagactgttcaatatgatggatatatttttaatctgaatgaatatttcccatcattcaggaacctactcatgcctgcacagtgatcacaaaaaacagagtaggctgacatcttcctatactttcctgcaccccttcccctgaggcaaatgtctagccatctgaatttgaccatgctaggacagagagaacctgtcctgggactgttggatttggggcgcaaaggagtcagccaatccttcttcaatgactacaaatatgatgcaaagtttgagaacagtgagtagatcagaaaagcagacacaaaaagagagagaatatgtgtgtgagagagagacacagagacagagacaaagagactgggacttggggtgagaagagagacagagactgaacacagtaggtgcccaaaaaggagggggggactagtttcagttgctttctgatactcagctatgttcctcttcttggttatgagaaacacaactatatcttataaaacaaaacaaaatcacttcttttctttaatgtatgtccactggattctgtcagaatcaaatattcctagtaacatactcataaaatcacgatatacatatgaaatggaaggctttacattataaaaaggaaaggggtccaaattacctttgatagggtccaaattaccatcctggaaatagctctatcatgaacccacattgttagctttttttttttttttttgggatggagtctcgccctgtctcccaggctggagtgcagtggcacgatgtcagctcactgcaacctccaccttccggctaatttttgtatttttagcagaggcggggtttcaccatgttggtcaggctgcccttgaactcctgaccttgtgatctgcctgcctctgttagccttttagaatttgaacatttttcaatgtttaaattatctaattagtgcagatctacattataaaatgaaaaataaggaacataaagaagaatagagttaaaatacttaaaaacactaccatttagagaaaagtcaatgttaaagggtttttttaaatgagagatatattttttcacagacacaaacaaaattctacaatgttgctttatcacatgtagtcttctttatcattgtagacctcacttaataccttctcctgacccccgtctatttacataatcatttatgcagtcactgtaataactttctattatctattacttgatgccttataatttagctacctgagctactgttttgaatatttaagttttctctaatttcccactattaaaagagattagaatggaaacctttgcttgcttgttcacttccttaagataaattatttgggttaggatcattgccttaaagacctataccacgtgagggcttttgaaacactgaaaatgttcactctgggtaggctgttggatttatgagctcagcaggcacactgaaaagccatgttaggtactaggattttctagtcaagtttgctgatccaaaggacagttacttcattgttttatgaggcaaaaatgaacattttcccccatatcttggccatgtttacttattttacaatttgaacatggtccctgcctgttctaggagatagcagattttctaatagactattccttaaatagcagaaattgattttctaactaaattagaagttttaatcttaattaatcttaattaaatcttcaacttttttcctttattatttctgcttttgttttcctatgattatataaataccctttgttttatctatttctaaagtcgtatttttacacttcgcattagatcacaattgcattcattttggaaaagagtttaaagtcaagtggtagggctttttgtctcaggtttttctgtgggaaaattaataataaaaacaataatatgaaatttagataggcgttctaacatggggtccatagaagagctcacagaggactttgaatattttaaaccgtctctgaaaagttgaatgtgtatgcatttgtggattttactaagaagtcctaaagcttatatgaaattctcaaacaggtgtgtgagctcttaatggtgaagaactttgatttaaagagtaaactatagattaaacacatagcagtcctttcctttaaaaaggtggtaaatcccttttaatttcagaggagcagacagagtcctgtgatcttttggccactgaagtttttgatccaattgaatgtcacacaaagccccacagatacaagcagttcttctgttaaagccacggtgggggagtccggaaatctggggcagaatttgaaaatactgcatcagaatatgattcaaggtggcaagatgttctatgaatacatcttctacctcttcaaataaaagttttcagaatgactcaacacaactcaaatttgttatggttgtggagcctgaaataaataatgctgcagattaattaagagaaatgcatctttttctcaaagagcagaaatataagatgacccagatcatcatccattatcagactgtctggcattagtgcaaagctggaatgtcgatatcacaaaagaagctcttgtgctgaacagttactgtcagccatgaaatcaacctcaaatgccagtggagcccaataaacaccaaaacttcctctcaatcatctgtcagtgcacctattttaggaagtgatgggaaacaatgcatcaacatataaattcaaatatatctatgaatccatacaaatgaaatgattttttttccaagcagtaaaatccaggtctttcagcttttctgctttgtgccgtacaggtattactattaggactaatttacacaattagtaatgatgcaaattactaataatattgctgaaaacacttaattatttaataagtacaatagtcaaatgagttggacactcctgtgatacagaattagttatgccaatgtagccttagccccagatgctatttaagtacagaactatcaaacttattttttctttacaagtttccatatataaggacttagtaaaaaagcatgcaacagggctgggcgtggtggctcatgcctgtaatcccagtacactgggaggctaaggcagatcacttgaggtcaggagttagaggccagcctggccaacatggtgagaccctgtctctaccaaaaatacaaaaatcagccgggtgtggtggtgcatgcctgtaatcccagctactttgggtggctgaggcagaagaatcgcttgaacccgggaggcggaggttgcagtgagccaagatggtgccactgcactccagcctgggtgacagagggagactccatctcaaaaaaaaaaaaaaaaaaagcatacaacaaacatgcaaatttataaccaatcaattttaaaaggaaatcatcatgtattaatagaagtcattaaattcttttttactattaagagaatgatcaatagaaactatcttttaatatctgcacttcctgttctgaccaatttcttagaatagataaaatactaaacatgttgtcaagaaagaagagatcatacattaatctgtagaattgaaactaggtaccaaataacattaagcagaaggaaattcaagtagttgttttacaaaagaactgaactttgacagtttgccacatttattattaaaaatacaaagaaaaactcattgagatatatttcaagcacacatcaatttgcctattttttgacagagaataaaacaatgttcttgcgatagtttactgagaatgatgatttccgatttcatccatgtccctacaaaggacatgaactcatcattttttatggctgcatagtattccatggtgtatatgtgccacattttcttaatccatgagatcacatggacacaggaaggggaatatcacactctggggaccatggtggggtggggggaggggggagggatagcactgggagatatacctaatgctagatgacgagttagtgggtgcagcgcaccagcatggcacatgtatacatatgtaactaacctgcacaatgtgcacatgtaccctaaaacttaaagtataataaaaaaaaattaaaaaaaaaaacaatgatggctttagtctaaaatactggttggtatgccagccatgctgattaccagatagtcacattttcgcttgcaatatggaagtagtatgtatctcagtcttgatttaagaaacacttttttttcaactggagaatacagtttaattttgtgttaccccatgataccattttattagtacgattttcttcaaggactcaaaaatagctctgttcattaatctgagcacacaggtaactgcacattagtacagttcaactaactgagcttgtctgcatatggaagacacatccttaacaactaacgtcaaatactggcaatgttctaactacatacaacaccgttcagctggaagtgcagtcaccagcttctcacttcttacatccaatcccatcctagttgtccttctgtctctcaaaatgcacatcgtgtctgactttatagtcacagtcatcaaagacagccaaacagagctgggcgggggggcggtgcgggcaagaagacctgtgtgagaactaaccacctctttcaaaaggctgagaaaagtgcggtttttaccacattaccttttaggaattattctcccattctggccttacataaagatgatagaattttagtacacagttaaacaaaagagtgaaagacatttcctaaattctcggagaacaagaaaggacttgggcatttgaattgacgaaaattggacataaaattctcttctgccacatattagctacaggaccttggagaagtcatgcaactttccctgaatatccgtttcctcaaatatccatttcctcatctgtaaaatcgagataacactaaggacactcctgaggataagacgagagaagcacaggaaggttccgtaagcactcaataactgtctagcatgtccccccattgcactgtccccaactctcttgctacttgatatcactttatcttgtcaaggatctccccttggagtatttacagcttttccctaatgaatcaaagtgtgcaatatcacaaggagagcttgctccttccccttcctacagaactcagggaggactgcggttgctcgtaagggtgctgctgctttcagaggagtcaaaggagcgaagctctgggccccggaagggactctgagtagagtatgtgtctgcagccttggggcgctgggaggaataatatacccccgacatttatgtccactggaatctgtgaatgtgaccttatttgtaaatagagtctttgcagatataatcaagttaaaatgagatcatattggattagagtggtgctaatacaaagactagggtccttataagaagaggggaatctggacacagacgcacacacacagaagacggccatatgaaggtggaggtagagggtagagtatcctgccacgagccaactccaaggattgctggcaatcacgagaagctggaagaggccacgaaggattctttcctagagccttcagagggagcatgggtggcccttctgacacttgggtttagaacttccagcctccagaactgaaagagaataaatttctagtgttgtacaccgctcagtttgtggtaattggttacaacagtagtaggaaacaaatacagctagggaacaatggtgggggcagaatcctaggttttctgtagtcacagaggacttcaggcagaaaacactggaagcagagggggagaccttcccctcatcagccagtgagtgagacaaaggacgctgaagacaaggagttaaaatagccaacctctgtaagatagatacccaacaacaatgcatttaaaataatattttctgttaattgcatttctaatcataaacctctactgtgagcactagtgtttgtggagggtcagagaagggggtaagtaatagatgcagtctacaagaccgtaaacagctttcattatttgaatagatactattttgctaggcttattgcatacttatttttatccacagaatgagaaacataatattatcaatcccatttattttatacatgggaacactgagactcagaaatactaattaatagcctcaacctcacaaagagctgataagcgactgatcagggatttccacccagaatatatctgattgtagctattatcgatgctttatcgcaggtatacatccccaagttattcatctagcaaataaaaattacttttaaaaaacaaaattactttaaaaaaaggcataatgttgatcaccagaagatagaaatattttattgttaaacattctgtatttacaagtccttaataagtgaaaaattttataatctcttgaaaagtaggaagcatcccataataaatcattaggcaagttatactactggacatccacactcctaataaaaacagtataagaaaatccagattttcaaaaaggataatctattgggtgactacttgttaaaaaatactcatgttaattaagtaattctcaataaatatataacacacatgacactttctatttcaaataaataattgtataagcaagttctcactttcaattactttgttttaatatactccataaattgtttaaatatattaccataatcgaccctcaaatgagcaaaatataatgaaacatctcttggcatgtaaatttgcccttcagctacaaatgaatcacttactcctcaatcaacaggacgtttgtacacaattaacaatagccatctatcattcctccaaagatggcattttgcccatgactagaaccatcacagtccattgactattggttataaaacacttcttcagtcatatctaccttagtatttcataagtcaacatttaatttattgtgttgattagattcaatgtttatattcatacttcccattcatctgcttaacttcagttaatgaggctgattttgttgtttccaatcctggatcgagttctgagacctggaagatggaggtggttgagtggtgaagcttgcagaaaagcaccactcctgaatcttagacagaggccagcataaaatttgggaaatgggggggcttctctaataaatattggggactgtgcctaaagcaggggaaatgcatgcttgctaggcaaaaacaacaagcatctccctacagcaaaattcttctatatccaacatcttagttttagttcttgaatgttggtcctgtcaaatttcccctggagaactggtaaaaaatacaactctccaggcctggctctctaaataaccttaggtccctgtgttttttattagctctcccaggtgattttgagatatctaaatgtttttgagaactactggtctattccacaaacttttaagtttttgcacctggtatttggacctaaagtagtcccagaataaaagattttttggaccaatcagtcttaagcatgtactgtgtgccacttcgtgcactacttgtcccaaactacctgtgatctcttttaattttagaatcaaaatttccagatctcaggttttgactgagactggaaatctcagtttaagttgttaaggatggaagagacatccttaacaactaacatcaaatactggcaatgttctaactacatacaacaccgttcagctggaagtgcagtcaccagcttctcacttcttacatccaatcccatcctagttgtccttctgtctctcaaaatgcacatcatgtctgacttcatagtcacagtcatcaaagacagccaagcagagctgggcggggcaggggggcagtggtgcggggaagaagacaggtgtgagaactaaccacctctttcaaatggctttgaattgtcaacaagttctccaggtgattcagatcagccactccaaccaggtgacattgtcagcatcatcagagatgagccatgcttgacaggatgagcccataatataagaatggtactttactctgtggtctcttcccctaaacctataatctcaattgaatcatgtggaaaacagaaaaatcctggttgagagatattctacaatataccagaccagtactccccaaaactgtcaaggttatcaaaagcaagcgaagtctgagaaactgccacagccacgaaggatcctagagagacctaactaaaagtaatgtggtgtcctgaatgggatctggaaaaggaaaaggatactggagaaacattgaggaaatatgaatgaactacaggctacacttagtaataatgcatcaatattggatcattaatcatgccaaatgtaccatgcgaatgcaaaactttaataatggaggaaagtgggtgtgagtcatatgggaattctctgtaccatctttccaataattctgaaaacttaaaacttttctaagatttaaaagtttcttttaaaaatcccccaaaatcagtttaagcagaaacactggcaaatattgacacatcctttaaacatatctttaaaattagaacatatttccaatgccccatctttttatggcatgacaggccttttttgggtgtaagcctctggtcagaaggccacagcgtcctcatgcatgacgcatggtgtatccgccatatgttcttgtttcagttaatttaaagaggcaaggaaaatcagaagaccctgaaacatactgagtgtaaaacaattttgaatttttatgaattttttaaccatatatttttaatgttttctcacacaccctaattcaacaactatttttgtcttctcactctcaagtacttatcatagcttttactaagacaatagctgtctttcacactttatcctcacattccattggtttagtgctatttacctgagttatctattgataacacaacaggcacaaacagacaaacaggtatggaagcaagccctgttgactccaatcgacctagtgggggaagaactgcaggctgccttgcagagagagggtgcccagcaaggtgctggcatcagttccaaatgtaacatgggttatggcatagcctgtaacaggaattatgacatgggttggtagagctggcaagtcacttcgatggagatcagctggtattacagcttctcctgcacttcaaatatctaccttggttatatgaggagtcgccacttgctgatgtataaatatcaaatggttttagttttgtccaataactgctacctcttgtgatttgtcaaacttccttttatactgggtggctggtttccttaaaaatagttcagtttaatgtattaaatttccagcaattttagtcactgaaacagtatcatttagcaaacaggacttgatggttgtccattgtaagagtccatcatcattcctaattccatcttcccctctctagcacacacggtaaagcaaggacctttccctgcaactgccctctctcttctctcttttatcccactaggattgggggaaggacaagaggaagataaaagcagggcctccatttaaccttccctgttgagcgtgatggccccttcctgggagggaccccactcatccagttcctggaaaaacgagagaggaggagctgagacctgagtatctactgcagacagtagtacattgaaggcagggccaggtcctgaagctgaccgcctctgggatcttcaagtcacacaccgtgtcatcccctagagtgccagcagtcctcatctcctctgctctttgccacccaatcctgagcccctaggtacagattggacccttctttcttacctctcagaaaccaggaattcaatgctatgccagccacctcatcacatcttccccacagccaatttgagtaggactgagaagtagatgtcatcctctattccacgtgctgtctcccaactttcccagtgattgtcatgaccttagaaagactggagggatggctgctgctcccagcaaactttgcccacagccacctcacatcttcctctgccctctcacctggagagtgcagaggctatgggggacatgttgaaatagcagcttttatctctgagctagactccacagccagcaggcctctgaactagaatgggattgaatccagggacccccattcccacatgcagcaactagaagatccctagagccacatcccaagtaaacagacatttttcttgctggatcctacaaggagggagatgcaaagggtaggagaggctggcccaggattttctagagtaatagaggtgacacacaaagctgaagctgaagttgcttaaaataggtgatgcttttcctgtgactgcaccaaggccagccagccctgggggaaatcctgagcagtgacacaacagatgacccacggagccactgcaagctggccagtgatgtcagtgttgggtgaagaataggtgaagtagcctgcccaggaccatggatttctacaataatttatttacccgataaagtgctatttccttcaaatttaaatgttacaacctccttagcctttgttccaagccaactactttactttccttttaaaggcactgctttagtgaaacacactgataaactgttttcaaggtaggcatggaagagaagaactatcattaacacacacctgttgctgccagtcactaggggtttggcaaatattatctcaccccgcagcaagcaaatgagagagagaacactaatccaactgacagaggagggatctaaggagtgttaggtggaaccaagattgagcttcagcccaattaaaaaaaataaaaaataaagcttatgcctttccaatttcatgctgcgattttccatgatggcatgctaatctatcagttccctaacacaatcattttctgaatgctgagtttaacaaagccacaaagaaatatgaggtttctgaggaagccagcctccgccctttaggaagcttataatcaaatgttggggattcctttcccccaggagtctgacttttgctttttattgcccttcaactttttgcaatacaatttataatttgaagaatatttgataaaactgcatgatgttctttgaacacaacctctgttaagacaggttttgaaatgaagaaccatatatatgagcaaacctctgtttttgtgttttgttatggataatttacacaatacacaatttatacagttacaaatgactcctcaactctgaaccaggtaaaataaacatttcattactgatctttttttcttggaacttctccacactgaattatactcaagtgcatcacaattacccatttgatcttctccccgtgtattttggacctaccatctaatttataaatactaactacctgtaaatgcactacttttaaattatagctacaatgatttttaaatgtgcctatacttgggcatcatctagggtttctaaaaaatatattgacacctgggtccacccaaatctcatcttggattgtagctcccataatccaaccacgtcatgggaggggcctggtgggaggtaactgaatcatgggtgcgggtctttcccatgctgttcttgtgatagtcacatgagagctgatgtttgtacaaagggcagttcccctgcacacactctcttgcctgccaccatttaagacatgcctttgttcctcctttgtcttccaccacaattgttaggcctcgttaaccatgtggatctgtgagtcctctttttctttataaattacccagtctcggatatttctatataacagtatgaaaatgagctaaaacagcccccaagagacacgatgcaattgggctcatgcaaatgtttgaaaaccagtgctctactgaacactaaatacaaaaaaaaagctgaccttttgtaaacttactacgtttgaaatttttaagaaaatgagatagaaggagattaaacctaaattatccagatatctgaatgcacactcatgagggcaataaaggtctgagaaaaggacctattatgtaaattccaaccatgtgtacctggtgcccacatggaggtataaaacaagccttcataaatgtatgtttctcttgtgaagtctcatcctttgttaactagtgctaaaatagtttaataatggttacattccactacgacgaatctatttcaatcagcattccaaaaaaatttatttgcttggtccttaattcaacctcttttctttttgaactgtctgggttcactgtgaaacgctcagtatctttcaaacaacccattatcctattccattatgagattcagatttcatttctcatctatatgttgatctttcttttacatgcttataatcaagtccccaaatctgtgatgtgagtattttcagggaccgagtaaataatcacacccatgttcactgctcaagttagagccaagtaagagactcagaaaggattcagatgaaaggacataacaagttctcttttggtgctggtctagtggacattggagaacatggcttacagctgtggcccagagggaatcgtgatgctgaagcacatgcatgactagaacaagctaccggggctgcctttggtcaacttaataaattatgaagaggctcatggaggggcagatcccggagagaagagagagaggttgagatcatgtgtctagctctttctcccaggctccccagtcaccctaaggagagatgagcgagggagccaagagaatgcaggagaatttcctagttggtttttctccattgcatagagatattcagtatactgcagatttgcttatgacctccactgacaactgtctaatatgcactattatttcatcttgacagctctccccatttgctacctgcaattatgtaatctgctctatatctaaaaaccattcttctgcaccctactctcaggaatctgcctctccactggccctcttcataatttgttaagttgaccaaaggcatcctcagtgggttggtctagccatgtatgtgcttccgcatcgggattccctctaggccacagccgtaagccacattctccaatgtccactagaccagcttggtttttcataatggtttttaggtatagagcagatgacataactgcaggtagtaaatgggaagagctgccaagatgaaataataatgcatatttgacagtggccagtggagatcatgagcaagtctgcagtatgctgaatacctgtatgcaatggaggagaaacttcttttgactactttcctctttccctgtggaggcacaccaaccaggaaatcctctagtgtaatggtttttagatatagagcagatgacataattcctactttccttcccagagctatcaggtgaggaggcaaggccctgactacttgtgctatctgtctcttcttaaggacaactctatagatgtctctcgatggcaccctgggtgagagatcacttagcagaaaagtgagaagagtcagggagtagacttgtgaaccaccctatagagctggtgacccagccacgttcagtagatggaccacataccatgtccacaaaagttgttgcaaaacaaaccagaacaaaaacaacaaccacttatagaacacactagggaataagctgactttttgttgtgatcagtggacaaatacaaactggatactgtaaaagagctattgttgacctgctgaaaatggcataagcaatagaaaataacactggttgaaacacacaggcacaacatcaaactcatgtccatggaattcaaatggacaatgggaaaatataagagaaatgaaaaaaggtaacgttttaaattcttgtgaaaaataacttgatttaagtggttaacaggtgaaaataatacaggatctgtcacatattcatgactcaaagaatatcagtggtaactgattttaggaggtttttcttggggagggggatgtgataggcaaaactctaaaatgacccccatgtaatccatatccttttattatcctctcatccacagatgtggaaaagatctgtaaatacaatgggatatccttccattgattagactaagttacatgacagatgcaaagggatttttccagatagaattaaggttgctaagaaactgacttccagttaatcaaaaggaaatttatcctggttgagcgtgatttaatcaagtgaactggttttaaaaagtgcctagagatgaaagcctcaaagcagcagatgtttctattgttggcttagaagaagcaaaccccatgaattcaaccaccaacaggaaaggaattctgccaacaatctgagatagcactgatgtaagtgggtccactccccagtcaagcctgcagatgagaccacaactagtcaatgccttgatttcagtctaatgacaccttaagcagaggaccaactaagccaagcctggacttctgacctttggaaattgtgagttaacaggcattgttttaagccactaactttgtgctaatttgttatgcagcaacaaataattaatatgaggataatttgcaccagttttcttctattgttcttgcaacttgactatacatataactatcttgctcataagtgcatacaatgtaaaaataaaaaaatttccctgattagagttcttcatcataataccttatacacaggctttttcctcacatcaaaacataaattgttattgtgtatattggtaattataatacagtgagacataattaatgtatcccaacattatagtgttcacatttacctagaagatgaggatgatagtgtgttggtcaaaaatagtcacaagttattttgcaagccatctctttggaaacaggacagatacagattttaaaaggaaatatcatgaataatgatggctggagtaaagaagggttaattcggatttttgaacaaaataaccatataaaaacacttttcagtaacttgaacatcaaatataaaatgttattttttaaaaaactaagttccaatttaaagtgaataaaatatgaattggatggataatgtatgttctatcaaaataaatctaaactatttaacacagtaggaagcaagcattagatggaaatatgctactaacatatgttaatgtgggaaaaaaggaaagtgtaagacagaatgtataggagtatcccaaactcgcaggttaaatagtggaaaaaaaaaaatcctaaaaattattatcaaaatctaccttgcagaaagaagtatgttggtagaatttggaggctgggttactagcatcttccccaactttatcaaagagggtaatttcctcccccacttttctccttcataggggagggagtaacaaacacatcagtactatcaggacagggtgtttgaacttgagcacctttctgggtctggaagccagccatggaggggaactgccctgctgcaggaacagactcttcatgagtcagcctcttgggctggacagccagtgcccggggcagtcatggaggggggtcacactgctgccgctgtcactctcaccaactgcacccgcagcatttcctgggtgcccagaccagtgcagagcacatggctcacctcaccctattcgaccagacccccattctgcaagtgggtacatgtaacagcgcggcagcagggctgagctctgggtacccagccatctcacaacaaccacaggagccactcaggggaccaggccagctggcagaggacaggggctgctttttctttctcagtaatcacaattcacttctacaactgtcataattccattttagaaaagtaaagtgtaagactgccctctcagaagggaattcatcaatttgcatatttcctggagacttctttctgttactctattaatttattaacactttttaaagtgatgcagtttcccaagatgctctctgtctgataaatcattgaggtggttataaataaagcattacaccttaattccctaggtatctaacccagaaaactagatgctactgattttctacagagatgttctgaaaattaattgctactgataattcaattcttccctaaaatcaggaaaggctgaagcaagatgggcagataaaatgttttcagatgctagacagaacaaaaatgacaaagacaatgtaaacctatgctaggataattaaagaaagtttgtgccttatttcggactaaagaaactgaactgaaggagaaaatggacttttcctgaagatccctctcctttagttttttgtttgtttgttttaaatcatttccatgaatacacacttatcttgaattatccaaagttctcacactgtgctaactaacatactgagcttgtagttcccagagaaattttagggtttacccacattttcattttattcttgaactaaagtcacaacattttcccgaatagagttgggggacagaagtaagcatatgaaaatgtcagaggaagggactctgccttcctaaagcttggcctccgcaaacatgcaaaattgtttaaacaataaggtcacatctcatcagcaacttaggttcctccagacctggagtcggcagtatgtttgtgatgctatggatggaatgatcccatgacactaatataaaaacttctggactatgcgatagtggacaagttattaaagtccctaaaatgtagggattggggaaagcaagtctttattagtaccaataaattttcttaatttaagcaatggcagctttacatagtattctgaacaactagagctaagcaaaactgttacgcatgtgcacaactagtttggacagtctgttgataatcaagatatactaaatgtctccaattatgttaacaactcggcaagatttgaaagcgaacataaatcataggtaaaataaatgcaacaacactaataactgtaatgcatgacttactagaaactatatttcagccacttttctagagaatcatttacacgccaacatatctagccaccacagccacaccatgaagtagacccttcagttatgactaatctgcctgcaattgatgtacttattatgtaaagcatttgtaatgttacctttttatttcttagtaggttgaattttgagcattttaagatttttttattaacagaaagtattattggaactccatttgaaatacttggttggttatattggaaatcactgaactttacacattcccataatttaataaaggaaactctgaatgtgtatgtccatgtctgtgcacacgtgtgtgcatccatgcctgaacaatatggattactttgtacagttattctcgagcttttagtaggtaaagataaaatagagttgcattttgttaggggaatttttctattccctagtgagattgtgttcagttcttaatgtacttttccttagaagtgcaaataaatgaatatgaattgacaggatcctataaattagtaacactgactttccaacaaaacacagtagacattcatttatagaacattgctccctataagtttactgctttgaagaatatatgcttaaaatccaatgatatttcattgttgaaatgatatttgaaagtgttttttaagaagatttcaaaacagaactcattacctaatgatcacatctaatttttaattccagttgatgcttctcagtttgaccaaccgtagccttaaaataaccttggttaaattttttaaaactaaaaattcaaaaaatatgtatcataatattcaggactcaagactttcacaatttggctattaaggttattcccacacatcaacattaaatcagtctaataacttcttgcacaagacagtgtgctaaggacccctagtcctgtcctcaaatctgtaagagggctgccttcactccagcaaagagcaagtatcataactttatctcacattttatactttttaaatatttagggcctttaatcaacttggaatttatgtgtttagtgggaagatgaaaatctaatattactttacttttccatatagacagccaaagataccacattaagacaacagcactgattgaaaaagtctcctctgtttctcccttatatatgaaattctcacatacgtagaagtctatttctagttatatcattgttttaagagcttagtgatgcaatccatgtaaataaaaacaagcacagtgctcatgcatactttgtcttattaacattattattattattatttattatactttaagttctagggtacatgtgcgcaatgtgcaggtttgttacatatgtatacatgtgccatgttggtgtgctgcactcattaactcgtcatttacattaggtatatctcctaatgctatccctcccccctccccctaccccacaacaggccctggtgtgggatgtaccccttcctgtgtccaagtgttctcattgttcaattcccacctatgaatgagaacatgcagtgtttggttttttgtccttgcgatagtttgctgagaatgatggtttccaacttcatccatgtcaaagaaatgcatatcaaaaccacaatgagataccatctcacaccagttagaatggcgatcattaaaaagtcagggaacaacaggtgctggagaggatgtggagaaataggaacacttttacactgttggtgggactgtaaactagtcgaccatcatggaagacagtgtggtgatttctcaaggatctagaactagaaataccatttgacctaacattattactactttctaaattatcctggattattttgttcacttacattttcatgtgactttctgaatcaattttttgccactcctgaaaaatcttctttggattttggagtgggagagcattaaatttgtttattaggagtaattttctcttgccttcccattcacaaaccttctactgtctccttttatcctgttcttctttatgagcttctatgaaatttatctcctaaaaagttttgcatatttttgttaggattttatttatgcatcttataattttattatttctgcgagtaagaatatattttctattatattttctagttatttatggctggtatagaggaaagctattgatttttgtattttgagatttaatctgaatatcttaatggactcatttttattagttataatagcttttcagttactcccttgggttttctgggtatatagactataaagtctacaaataatgccatatttcttgcttccaaatctttttacccctgccatatttagaattgcctagtatctcaaatacaatgttgaatattggaagtgatacaaagcataacattccagattttaattaaaatacttctcatatttcaccactgaatataatattctgattggtaactcctttacaagtttaagaacttccttttattttattctgctaagagatttgttttttaaccaagattgggtattacacgttatcaaatgtatgttgaacatctgctgagatgaccagaaagcctttcttctgactagtattaatgtactagttttcattcatgagttttctaatattgagccatccttgcatatttgcaacaaaacatgctttgctataactagtttttatgcttcgaggattgaatttgctccagtgtttaaaattgagctggacctatcatttcatttactgatttccatttctggccgggttactggggtatcctgtattgcttatctaaaaattaaatttctcaaaaataaactttttttggttaatcaatttgaattgcatcatgtcattcatttgtcagtctttccattatcccctactccagaagaagtttcagccacttagtgcctgccatatgcttgttgctgttcattagaaaaacatttcaatatgaagtcctggagccctctgagttgactgacaatgtcatagaggtgtagattgagcatgggcttttgagtcagagctgacaggtccccttactgtgtcagtttaaacctatgctctcttcctttgtaaaatgaacataattcctacgttatatgctgctgtaatgactgagtaaggtaatgctcacagtgtacctagggcacacaagattttctacacgtaatgatgtgctgatttttcttgatgaatgtgaatgtgaacatttgcttctttgaatatgtcagccttggtctctgcatgttgagtgatgcatagagtttacacagtaaatctacaaatatcactcataaaagaaatgtttacgggtagtcctttgaaaacaaattggcatttatttacaaaatcaaaagttagatacagaccctgggacaatctgacagtggagggaatgaacaccatgtggtagggtcaggagcccacatagcaattgtcacagaatgaatggtattccccagatagatacgttgagggcttaattctccagtatcagtgaacatgatcttattcagacatgggatttttgcagacataactggttcaaatgaggttacactgggatgggatgggcccaatccaacaggactggagtccttaaaaaaagagagatgatgatgtgaagacactggcaccctgggagaacaccatgggaagacagaggcggacagtggagcaacatatctacaagcaaggaatgcctggggttaccaggagctggaagaggcatgaatcctcctccagagatgtcagagggaacatggctgtgccaacactctgatttcagatttctaacctgcagaagggtaagataatacatttcagttattttaaaccacatagttggtcatactttgttacagcagcctgcggggtatgggcagggggtatctcatggatcagagccatgaaataacttagaggttcaggttgtcaagcaaaccaagaggaagaccgtgcaacaagaaaatgctgatattaagccaaatgttatctgagctagtatgaaagcaagaacatgttctcaagtgcacaccagctagaacaaatggaaggaaatggccgaaagggtcagagaataaatggcataaatgccacgatggctacttatgttgaagatttattaaaagtgcatcagatgctcatcaatccactaggtaatgggtgtgactgtaactgttaagtatatttgataatgtatttggcaaacgttgccatagaaacacaatttcatggaacaaagaaacactagcttaatctccaatgtaattttgctatgaaagtggttcacgaaaacgaatctgggacattgaggctctttcttgcctcagaattaacatttatcctattaattcattactgctaaactttgggatccataatctttcctaggtagtatcaatctcagtcttcagaatttcaccctccccatccctccctattttctgagtgctgagagaagcaaagtcaattgttattctaactgatcagatactctaggcaaacaaaatgcagtcatgctggtttcacactggtcaaacaggatcaaagatgaggatgccatgccaagaaagtgggtgactgcatttaacattctacaaatagaattaattgacttgctgtccaagtcatatgatgaagctattctaactctgggaatgaaaccagaatttctcaccatcaattctcttttctcttctctagaccatgcggtctcaaagtttttattctccaatgataatcagtttaaatgagagaatgcctgccaaacccaatgctctaattacatagttaggaagaactgataataattattgcaatgttctaccctcaaaaactgttaggcaatgctgactgatttagataccgagacacaattttctttaaaatacacacacacacatatatattttaaaaactgtctaaatgtgtacatgccacaaaaatccatcattaatgattgttagcataaatttgtaactagcaaaactagttctgaggcttatgtttcgctttccatttttaagtaattcaaaagtattggttaaatcaatgaatgcatgaatattttattaacatggtctgcaaatataagaaagagaaaaagtcctgagatgctccttccccacatatttttgtgcaagcatgaacgctttcaaatatttaaatacaagtacagcaggggtctaagaggaagcacatcaaggccgatgaattgagtgttcaagatattattcatgcctgacatggctttttataaaattacacttcttgtcacctagaattttactgattctttcttttaattatcaaattccatggttacttccaccaataaaacagcaatgtcctcttaaaagaaaaatattctagcagcacacaatgcttctattctgcttccatttcctctttccctacggaaggcttccttgccagattccattcacagccaaaaaactcttgccaacaaaggcttaaaatgataaactaactcagggataaatggcagaagccacatttatttagggggaaaaaacgtccacatttacagaactctctaatacatatcatgatttcccagcgatgcattttaagtaaaattagaaatgctttagatggctaaaaattctaatgcaatcaattttcataattttttccatacaatggacactaaggtaactgatgtcgatttccacagataaagaatttgacaaatattttacagtttgctgtgctattggtttatggggctcccgacccttactataaatgtccactcttcacataggcccaacaggtggatctttccgaggccccacgtctgatctgctctgcctacttgctcctctccattttccatttctcaggaaatggcaattctgttcctctagtaattcagtccaaaaaacctggattcatccttgatgcctttcataatgtcacacacagtattattggttacaggataaactgtgtccctcccaagattcatatgttgaagtcctaacccccaatacctcagaatgtgaccctatttggaaataggattgttgcaaatgtaattagttaagatgtggtcatactggagtagggtgagctcctaaaccaatatgacagatgtcctcatgaaaaagggaaatatggacacagacatgtgcacaggcagaacgccatgggaacactggagtgatgctgccaccagccaaggaactaccagaagctggagagaggcctggaatagacccttccctagcacctgctgagagagcatggcacagctgacaccttgatttcagacttctgacctccagaactgaaggtaaatttctgttgttctaagtcactcagattgtggcaatttgatacagcagccctagaaaactcatagagtgatcagtctatcaaccaatcacattggcttttgatacctatgaaattacttacaaatgtttttcttctaacactggggttatttattcctagatgttattcctcatgtgacagttttcatagacatagtattatctctaggttgactcccatatttatggcatatacttattttgaatttactgaaaagaaacactgtatggtgtaaagcgtgttttgttgttttctccacccttggtgaccaattacagggacactgctcgcccactgcatgtcagtgtaccatatcacaccttgggaggggctgcccctggcattaggccaactcctgaaactatcatagtattcttcattcacagacaagcttccaacattaattctcttccctaaggaattttatttctggaagagggatgagtaaatggcaccaactggcatcctcaaagttactaagcaccatctactgtccccgtattttaatacatccatggtaattatattatttccatcagtctgctgaaaatttaaacactgatctaaacttagaaaaaatggtgtatcaacgtgaaacacaatagctactgataaaaggcgttatataattaggtgataaattgtgtgcgcagatgctacatgctgtaagagatcagagcggccttagatcaatgagagcgcaccagaggactggaatcttgctgtgtcaatttgtgtttttctctttgatttgctttgtcatctgtagactcttctttgttttgggtatttttaagtacttagaattaatttacaatatgaaagcataacttatacatctttgtccacaaggaatgctgagttttcaacaggactgtaagatgattagttgcaagccagtagggagcaagaactataaacatcagtcatttacaaaattagaatttataccatcttttctcccacgtatgagtgatcgacaggatataaaataaatgcttaggatccaagcagatgggttttctccatttgcaagactccaagtctttctgggtaaggaatgcctacttggatgctcttttgcatctggaatggtttaaacattcctatttatgattcgtaggctcaacacaaaaaactcatggtattagccccatacaaaataaatgtacaattattattttcccaaacactactatatttgtatttaccatattttcccatgtattttttacttctcccttttcacaaccttatgcaattggataacaaacaataaattaaaacgttcttcagggaccataaatattcatttatttatttaactcatttaatttagaaacaaagagtgagtgttcctcctgtgttagacagtgtactacgtgccctgactccaatggagggcaagtaagccttactgcccacagggtgcggcagtagctatcataaatgccaagaatgtctttatttagaaggccaaggaaggtctctggaggaagcgacccttcagctgagccatgacataaaaagaggagtgagcaaactagcaggtgaggatacaaaccgcagggaaggaataaaaatctggaagtgagatttaacatggtttaaggagattccgtttatcctacaggtaatgagaaaccactgaagagttttcactttaggggactgccatcatgaagttcattttaggatcccagtctgtgactccagatttagtgggtgggagaagataggggagtaactggctaagggagaccagtgaggagtcagattccatcatcttggttaaatgtagcgtgggagggatagaaggggaaatgaaagaactgaactgctctgagacaggtttagaatgtggaccagcccagacacagtggctgatggcccatgatagctgaggaagaagacaaagatttcttgggaaggagaatatggtatcttaaaatccaaaatgttattcatgtatgagaaatagccattcaatatggagatgtgactcttctgtcttactcagtaaggtttctattgttggtggagaaaaggttaccacagacttagtaacttaaaacaacacaaagttagtacattacagttctttaggtcagaatgtccacacaggcctcagcaggccatatcaagccattagcaggtctgtattctttcctggatgatctggcagagaatctgtttccttgtcttttccagcttctagaggccacctgtattccttggctcctggcctcctacctctatcttcaaagccagcaatggcaggttgagtcctctcctgaccctcctccatcatcacccatctgtacagacacacccagggaaggttctcagcatttaggaactcacgtgattctatgtggcccgagaggatgaactagttcctctgcacctcccacattagctgagtagcaacctcaactgcatctgccatgctaacccccctcaccgtgcaatgtcacatgttcacaggttccagggattaggacaaggtcatctttcagggctattcttccacgaactacactgatgcagcatttctgcctacacatgctagtccacatccagcccaattacttccctagaaactacttttgcactattctcttctgaacaaagcatattatgggccacattcttcccatagagccttatctgagaggctttcatttgcagtaatattttagcataatcctatcaagaatgatttccaaataaagggtattttgtccctttgtacctataacattgctaaaaccttatctcatcctttgtgctgcttaatttacttcttatagctttccttcaagggcatataacattttcaaacataagcatttgcccatttttaaggtaatgagcccaatctgttttttgaaaatgaaataatatacttaaaatcatatgacttagggctgtttataggatgtcttaatttttcagatggttaagtattacaaaaatctatataaaaactaaacctcaatttacaccatccatttcctacatttttataacaaaacagtaggaaaatatattgctgctaaaaattaatagttacagaaattgtgaaaagctcaagagaagtactacttctggtgataaaacttaaaaagcaaattatcaaggaatagtatgtaactattattgtctttgatggagcacaggagtgaggaattttacagaactattgtccataaacactggattgtgtttacatttatctcattgtgtttatatgtatctactagcagtaaaaaggcaagtatcagggaaaagagccattacagatcccgaaaatggcaaaattaactgaggaaaaaggtttctttgacattgagattggctttacaaatatttttcctaaatgagatctcctaataaaacaactaggaaaagactttaaaagtctcctccattcaccacaattgaatgagtgatcaccgatcatttcggtgtgagtaactctgatatgcacacagggcagtggggatgctgcattcccgtcattgtcacagcctggcacttgcctgcgtctcaccacagggtggagaatattcctggcccccagccaggacttccaaaatggggcaaggataagtggaattaattttccctcattttggatgtattccaagtttcagggttcagtggtatcattaccacaggatcaaattgtgatcaaagacaaaaatgcataaatattttatagagtaaccaagtgtaagcttacaactccaaactaaaatgtttagtattaaatgctattctcaaatattcacctctaagctcccatcgtcctcattatgtacttgaataatttaaatataaatgatgtagttatatctctgaatgtggaaattttatagaagtaaaattatgaaaataataaacaattttcaaacttctcaacaaatgtttgctagtatcctagaaatttaagataacatcatttctggatttgcattttatttatcttcttgtatctatgtatatgaatagtctaaatttgtagtatagttgcttgactttacttataaaaagacagtgccataagtttcctttgcccctctgtaacaatgcatgcaacaaagcatgttttgtatgtttataactgttttaaatgactttagtttaaaagtaccacagagcaaaagttaacagagaaagtgtcttaatagtttgtgttttggctgagcttggtggctcacgcctgtaatcctagcattttgggaggccaaggtgggcagatcacctgaggtgaggagttcgagaccagcctggccaacatgatgaaaccccgtctctactaaaaatacaaaaaaaaaatagccagtcgtggtggtacatgcctgtagtccgggttactcaggaggccaagaaaggagaatcgctggaacccgggaggcggaggttgcagtgagctgagatggtgccactgcactccagcctgggtgacagagtgagactgtttcaaaaaaaaaaaaaaaaaaggtttgtgtgtcttcaaaccaagatatcaatttacttctttaaattttaaatattgtaaatgctattttcttttagtggggaactattttcatgtatgttagactctttctactcttctggtaaccactgattatgccagtgtgcatgtgtgtgtatgaagtgagagtccacatgttttaatgtcattttctacaaaaacagaggatttggccaggtgcagtggctcacgcctgtaatcccagaactctgggaggccaaggcggacagatcatgaggtcaggagattgagaccatcctgatcaacatggtgaaaccctgtctttactaaaaatacaaatattatctgggcctggtggtgcgtgcctgtaatggcagctactcgggacgctgaggcaggagaatcacttgaaccagggagtcagaggttgcagtgaactgagatcgcgccactgcactctagcctggggacagagtgagactccgtctccaaacaaaaaaaggaggatttatatggttgcatttatctccatataacaagtatttcaggaaaaaaaagtaacgttttgtgttaaaacgtactgtatacactttatgggccatacaaaacacagtataaatcatgactttaaaatgtttgtgctctttatcatataaataatcactattttaatgtgcagaaattaagggaggtaacaggcagtttcattcatgtacaagagtgctatctcaggattctgaaatacttgaggctgaatcctggtttgtcaatattcttttttccttgctgagtgatccttgagtaagttaacctctataaacctcaattcatactaaagatttgtaaaaatctttagtatactagcatttatatttaggtcttaaatcatccatcacatatttgttcatcgttttaaaacctttctacacactctccaggtgcttcatgaccattttctacttcactggtgtagtttcccattctgtgattctatcttaaattctagggtagttttatgtcactggtgatgtttttaatcctgtattgttttaatttaccacctgctttcttcctttttatctctgaataaagatatgggttccttggcaatttccaagtctttgttttgagacagaatttcatggcttacagttcaatgtctctttcttcttcctcccgttgagatgtgtatagttttcaaacattttaccttctccaatggctttttatcaacttctactccctgtttttatctgttacatcattttcaatgcatttttgttcactgacacaatatacagacttttttgtggaatttaataggaaaagacattagctgttattactaccatattatgaaatatcccccccttgctctgtccatatcgctacttggataaagagggagaagtttaatattttatccatgctagcaatattttgaaacataatgaaacagcattctaactgcacagacagtgatagatactattaatgttgcacttaagttgtgtcaggcaagctactgtctacagataaaaatgaggcatgaaaagtttatgtagtttagtcaaagtcacacaacacacaaagaggaatgctagattcagactcatatcaaaacactccatgcattttctactactccaaactccctcttcaattattttaagaaggaattgactagggtggtaaagtttgacattccagaattttggactagctgcccatttagccacttactactttaactaaggaactgaattcatttctcttagcctcactgtactttttctaaaatttaagcaatgactgtcaacttcatgtgttaatgatacaatgaaatgaaattaagtatatattaaaaagtctgaaacataataagtgttgagaaaatatttgttgaatggaatttaaaccttcaaagaattactcccactatagagtatcaattttggttttccctctatagtcacctatcagtaaatagggaacttctgagaagaactgaaagcaaagatgattcaatacgatatggtttaaagatatctgagtttctaacactaaagaaaagcttgaagacatagaatacctggaaacacacctttcaaaattcaatatagataggatctactcaggattgtggtcatgaaattacatagtacatttaaagatgttattgagcgtgatgatctaattagcagaattaataaacagaaactgactagcatacatcccttaatttattcaccataggtcagacctttactgtgatactactgtgtgccagacactctactgagcaccaagtgatgaaggaaaaggcatacccttccgtccattagagaaacttctaaaaaaatttttcatttgactcttccacagcatataaactaatgattgataaacataaagtcaattgagataattaggcagaacagtttcttttagtagaataacagcattgtctcatcatattctcagctattggaaaacctaatccttctcacttagaattgagtattatatttgaaatccaaagataaagtaatagatactttataagtcttatttataaatcacaaaatacattttagaattcccttctcttgctttcattactttcagaaaatactgttgttaagtagcagtaacatgctaattttctaatgagaaggtacatacagagtttcacgactgtttttcaagagggtgttctttgcatctatcaaggctaaaagaaagaaggtatttaagaagctaatttcctacgggaataatataaggtttaaacactttcagggctgttcttccataattatcttttacaattttatcttccaaagtgaatacactcttttgtcgttgttgttctgtgagttaaatagcacactggcaaaatgtcttgttagctgatgggtaccagttaagcatggaggttttttgtaagtttgcacagtggttttattttctgagccaacacagaacaaatgtaataatgagcaaactcttactcacctagggtgagtaacagtgatagctacatttactaagggcagagcatccgactgatgatacagttgcttctgaacctcttttaactctcacatctgtttttggctctgtgtttaacaacaaaacctgggcttttcctcaattgcaaatgaactaatttgaataggcacagagatgtgtaaaggcaacactggtttcttcttacctatgataatccaactattatagtttccatttttgcaatgtttctggcaggacattgtaactaagagcattgaaatgagatagctggcaccctccaggtatgtaattgggaaaactccataggcagcaaccaatttttttttcttttgtatatgcttatatgcccttagttatactgtattatttggaactggaaattttactctatgagcataaatataaaaccagcatctttttactttagtaaagagtaattctatagcatccaataactggacaataatcagtaattctgagttgcatatagtgatctaaatagcaaatgtgtattttacagtgatttgtttaacaaaataagcaattgcattcttgatcctataatatttggaataacaccttccaaacatataaaaaatgaaactaccacccagaaaatgcgatacatttttcccaaacttttctgcaggctcgagtgtgtatctattaaaaatcttctaccaggcatggtagctcatgcttgtaatcccagcactttaggaggccaaggcagaaggatcacttgaagtcaggagtttgagactagcctggccaaaatggtgaaaccccatctctactaaaaacacaaaaattagccatgtgtggtggccatgcctgtaatcccagctactcagggggctgaggcaggagaatcgcttgaactcgagaggcagagattgcagtgagctgagatcgcaccactgcactccagcctaggcgatagagcaagactctgtcttaaaaaaaaaaaaaagtccaagtgcagtggctcatgcctgtaatcccagcactttgggagactaaggcaggaggatcacctgaggtcaggagtttgaaaccagcctgaccaacagggagaaaccccgtccctactaaaagtgcaaaattagctgggcgtggtggcgcatgcctgtaatcccagctactcaggaggttgaggcaggagaattgcttgaacctagaaggcagaggctgcagtgagctgagatcgtgccattgcactccagtctgggcaacaagagcgaaactccatctcaaaaaaaaaaaaacgaatcttctaatcatactatgtaagtatttcagttaattatgacttgttaccttgttacagtgtatacactttaccaggtcatatataataaaaccatgaaattaattgctatatagtagcccactgtatggctgtttactaatttactgaacaatttcccatgattatctatttcttctttttatgataaatagcaatgtaatgaacattattttatcaaatacatattcattcaactaataacttttgagtcccttctatgagcatgtgcctaggaaatataatctttgttcttaaaaacttatagcagcccagatgtcataaacaccaaatatcagtgactctgacatatttcaagacacccagattgtgaaaagaagagaggggaatattctcaaaagtttgttaaccaaaggtaagttcatgcgagacctttaaaccatattaagaagttccaggactggcgtggtgactgacgcctgtaatgccagcactttgggaggccgaggcgggtggatcacgaggtcaggagatcaagaccatcctggctaacatggtgaaaccccgtctctactaaaaatacaaaaattagctgggcatggtggcgcgtgcctgtaatcccagctactcaggaggctgaggcaggagaatcgctttaaccagggagtcggaggttgcagtgagctgagattgcaccactgcactccagcctggcaacagagcgagactgcgtctcaaaaaaaaaagaaaaaaaaatatgcacaagagtgcacaagaggggtcactgagaaatttaactttttgcttttgaaaaatcatctttgctccaaaggggaaaaggaatctgaactgtataaacttgtgcagagcaggctactgctagcagctacttatgataggatgacataaaatagggcactgaatgatatttcggaggtagacgctataggatttctggatccactgaactgaagatgagaaaaagagtcactgaatgttaaggctaccgaaatattaaggaagtgaaccctctgcctgtcacatgtgactcacacagctcacgttctaaggttttgcaggctgtcattgtctagtgcttctccactgtgagacgagttcacttcctattccacaaactgtttttctcactgtttcaaagggagatcctacgacccattgaattttatatcactcgtcttataattcactgttgtatcaccagtgcccatcctcccagatatctggtctgcaatattgcaatatttgaaatttttcttttttttttccactcatttttctcctccaatctagtcagtaaaaaatcttactaaatcctggcaacctccatttttttaaactcatttttgctccaaccaagtcagttaaaaatcttaccaaattttagccactggcctctgttctgaggactcctatgagttctgtacttctataaagtcttcacattttgtggggcaagactctgacagggacttctaggcagatgcacttttaaatacaagtcatggtttctgtttaacagtatattacacattaaaacaatcatgagatacactatacaactattagaatggctaatatctaaaaaacctgacagtaacagttactgtcgaggatacagcacaacaggccctctcattcactgctgatgggaatgcaaaatggtatagccattctggaagactgtttggcagctgctttagtatacaactaaatatagccttactatgctatccagtctttatactcctaggtatttacccaacttatttgaaaatatgttgacacaaaagcctgcatgtgaatgtttatagtagttttattcattactgccaaaactggaagcaaacaagattgccttcaaaagatgaatggataaataaactggtatagtcatataatggaagattattcagccccaaaaataaatgagctatcaagccatgaaaagacatggcttaaaccctcattactaagggaaagaagacaatttgaaaagggtacataccgaatgattccaattgtatggtattctagaataggaaaactatagagatggcaaaaaataaaaataaaaagatgagtggttaccaggggtttggaaggaggagaaaagggttgaagaggtgaaacacagggcaatttttagggcagtgaaactattctgcatgacactactcatttgtcaaaacccatggaactttacaacacaaagaatgaagcttaatgtatgtacattttaaaaaacatttaggatagcaaggaatctgaggatgaaatgccagatgtggcaaagcaatctaactgtacaaaacaacctcactgaagaaggtgagaaaagaaatggtgttctaagtaactttggaaatgaatggcgattgcaagactaaagggaaaataatcattttaatcattgtgatttaatcaatgatgttgtttcccatggaagcatgggttaacgactgtgatcttgctatacttctctactgtcactgaacaattaagtaaaaggatggcatgtggtttgagccaggtttctcatatttggagtaggcagatacatttaagcaacaggaggagaacagaatgatccaggaggtaacagactagagttggacacatcactgtgaactgatatatagctttgtacagatacagatggttgaatacagaaatattcataggtaatgtatatactcagattagtatacactcatatatttatttgctatatcaactgacagtctaaaaacaaggacactccactagcaacaagcacatctaccacccttggtttttaatagtattcttcaataaaaggaatcacggctcctggaagaaatggctgatcctaagactggatcagggacatgtaagatgagttcagagaacctcataatgccagaaaataaggaagtacaaataaataaatgaacaatgaatgaatgaatgaatgaatggaatatgtcaaagccactcagtagcccctttgaagaaagctagaataattggaacaacaaaataaatatgctagcattggatcataacataaagtataaaataaatatccatgtgtctatactaatataaaggtttgaataaataagtaaatggggagaaacaacaaatctcccatgcagaattccacgtaactcacatagaacatagatccaccagccttaaaaagtagagtatattactccatactcaagtggatactgtacattgtgacttccttccaattagtagagtatagaaagcaggagagagcaactttacaatggagaaatatgacaaacactgtctcagctaagtgagcaaggtcaacgtcaataatggtcagtcatgtcaacagtgtatacactaaccctatcagacagattccaggagagggacatcctataatatgactgaccaatactcctcaaaactatcaaagttattaaaacaaggaaagtctgagaatcttccagagtcaagaggagcctaaggacacatgatcctagaagagacaaaaagacattagctaaaacctaggaaagttggaataaagtgtggagtttagttaataacaatacagcaatacaatgttgtaattacaatacatgtgacatagtaatgtaagatgttcaagatgttcagatgagggacaactgggaatgggatatatgagaactttgtactatcttctcaacttttctgtagatctaaaactgcacaaaaaattatcttaaaatgtattttaaaatgcattatatatctaacaatttaaagcaaataaaatcaatagtaactaacgctcactgcccacatgtcactctaaatacagaatactacaagaactttaaagtgatcagagatgtcatagtatctaatttacatttaataaggtagaatatattcaatcaaaatttgtttgaagatcttttggcactgccattcattcatttccagggttcatttcctgagccagccatctacaagcaatgtgcagatctaaaacataatatgggcaatgtaaaaacctgggtaagttctttagcattctgggttttggttgccccatctaacacatcagggttgtaacagcacttatgtgcacattggggaaatctaaaaagttaatatatatttatatatataacactgagaagggtgcctacaataatgaacataaatgttagctatcattatgattattttgatgatcatgaataattgatcttaaaaaaaagatgagcagtacttgctcccataattccacttttattaagcaaaaccatgggcagggttgaggatagacagtgcactgctagtagtaattacatttgagtggatggatcataggtgattctctttttctttatgttttgtttttattctcaagttgctaatgggtgtgtattcaattataataaaaataaatatttaacattctgcgtccatttgctacatgagatcaatgcttatatcacccctgcttaaactctgtattattaaaataatacatgcacatagtcaactgctaaatagttcaggaggatttcatattgaaaaacaacttgttccttcatttctttccacacttaattcctctggtactgctggcaactttaatactttcctatttgtgtttttccccttggttactcccatatctctaaatattagacttatataaagaatgcttgttgtgtccaattaaacattatcttttgactttagactacaataaataaggattcagcttgcttaaaccatccctactaccttctgcctcccagattttggtacgtacatcataactctaagtccttgtgttgattaggtttttaacttacgtgatattcagaaggctgcttttgcccttagtgttccacagtattacattagcaaatgtgctccacactcccaatgtcatcgagttcaaaggaacaggtgtatttaacacagagttcagaattatgatcaacgtggtagaatttattggcaatctggaaaaaatgtagacttacatctaatacaaccttagaattgtgaactgtgtgatcattacagacttaggttttcaaagcccactctaaaacactgtgtacttcctctcagaagttcaccatcgccacgtactaagacgcacggacagaggcataatggttctgtctgcatgttcccacaggcctacttcaccaaaaggaaatgcatgacatggtttgtttctgaacatatattaaaacagccatctattaaaactgctaagcctataaattaacttatattattaatgattgtgtttgagtaggttatgtactgttcataacagtgattctcaccctcatattgtactctgtacaaaagaagtataggaaatatagtctatcagtaatagtggctccctacaatagaacttctcatcagatggagggtaccacaagacatatgagaatttgaatgggatggcataagcactgaagcctcaaaataagtcctacttctctatccaaagagattctgctacaacttctaaaagcatatggccacttccttccctgtcctcaactgtaccacaccacattaaacatcacagatttaaaccataatgtgaagacttacagtcattggaccataactaaacatactttattcacttattgccatatatttaatgaactcccaccacctgcagatgacggtcgaggagctgagagcccctccctcaagagcacagacagaaactgctatgctcacagagctgacagtctagagtggggaacggacaaacaaacaggcaattacaacacagagccatcaggacaagatcaaccattacttaaactaaccccaactttctctgggaattctttaatttagaatcagatcttctcagtgcttttctgcagctcttggtctgcaagcagtttcatgccaactgctctgaagtgcttttcatagctgccagaagttgatttctgttacaactacatggtttctattttaatattttccccttctagttggtctcacccattgccttggattctcctgcatctgctttctttcttctctctaccacaggcagaaactctgatagaaatacacatcacattcactagagacagcaatgcaaaccaaactttctacattttcctaacacagtaatgtttctctaagcctgtttgttcaggaccctactattttcttagtaaaaacaacacagtgattaaaaataagttttattgtatttattatctgaaaagatattgaaagtggaaatgaaaatattgacaactgcagacaaaacatccacgatactaagaaaattaacctgaactactaatggaacaactccagctggaatggaaagctgtgagaattatcatcgctgaggctgcatggagatacttcaatatgggcataatgggaagaaaattcttgggatataattccttggtaatgctgcaggttgagcattgcgcaaaattctaaatgtacaaaatgtgaaagcacaaatttctccttgtaataaggatgacaaatgtggatgttttcataatcaggttttaactattactaccttattttaagattctttggagaactgaatatcagattctagttgagatatccatttattctaggattccattgattgtatcactttcaaagtgatgtaaagctaaacataataaaacaggatataaaagatgaattttgggagactcttacagagttttcaagctccaaattctaaaagcatatgcatgtagcaatacattggtgggattctaacttagtcatctttacttagaatatctaccaagaaaattattttaaaactcaagacatgttcataattttattacctaactgaatttactcactgccacaggatagccataaaccatgaatctaacaaatgatcaacaaagagtaagtcatggtggaaattcatatgtcattgtcagggagaggaataactgagtcagggcggaccacaggtctccaaatagcaaagggacttcatcatcatcgccaaatattgatttatcaccaggcataaacaagggaacaggtaaagctctgttctataccaagacatagaaattggtcacagctcatcgaagggtcacagtttagtagaggagaaccaaaaaacaactgtaaacactgactagtctcttgtcaaatgcatggtgcagccagtgatgattgaaagggtacagggcatctgagaagtcactgcggtcctattgtaaataattattttatcaggagagaggacttgcagcagttctcaatggaagagcagaacttaagaaacaatcatgtctataaatgctggccttgaaaatcccaggctaaacatatcaaagaaactatcagtccctgaagcaaacatacagaacctgacaataccttactttttaattattgagaaaaccatgtccccggacaaatctgacatcttaaatataagaacttatatgtaagactatacatgccaacttgaatgtgacattctttaacatattaaatattagcatatactatgctatatttttataggaaaaatccatatctagtatctactatagtagttttcaatggtattaattttgctaaagttgacatctgagctaccacgttaagttaaattgctaagattatgacgtaagctttaaaagtaattaacaatgcctgtgacacagaccttgaaaaggaagaaagggcttcatgaaggataattgtagaatttgggatgatattcataattttttcaaggatttactatagaaaattactttttaagcttaatcttgaaaagcaatttgataaattataagaaaacattgaaccattgcctcaagcaatgttgtgaaaattaagtgtgcattgcattaaaagtttaaatgtggattactactttttaacaaatgttaatttctaaattaaaaatgatcacgttttcctcttactataaaaattatttgcaattatatcaattgtggcatgtcagaaaaatcattatcttgaaaaacaactttgtttctaatgcttattataaggcatgattgtaatttggaaagcaaagcaattactggcatgtgtacatgggtgtatgagtatacaggtatgctattgattaaaatgagaagcaatatgcctcttaaattagctaattacgcattgtcatactactttaaatttgagcttaaaatcctagggtaagttaggcaacacctggtgtcggcacttaagggcctatttttttaaaaaaaaagacagactttatgacatgcaacagagaaagtggtacttatgtctatttccataatgtgatattttacatatcatctgaattttactgtagtttgtgctatgagttagacatacttattccacattaagccataagaagtcatcttaaaagtgaaatatttgtatttataaaccactactctacctatataggattttatcttcagcccacaaatattcattgagtttcctaggaaccagtcactcagggtctgtgaaagatgctgaggaaactgaggcctgatggaattgactgcactgctaagctaaaatctgactctgaccgtccaactccaaagaccaggctctttctatagcaccaccatacagcttaatggagaactgggcagacagaatgaagtacagagaatgtggttaaatactgctgccttggggacttaaaacaccacctcccgtgctcggtataatgggatagtgaaacttcatggccattctgatttccctgattgagtgtgcatatatctaacacaacttacccattccacatgagatttctttaaagattatcatgaaataaggtgtatgaacataaataaatccaataggctagtataaattctcttggataaggcatgatattgtaaaggtgtcaaaattttccattttgtgcatttaaaatttagatccatccaattccaatttgtttagacagggtccaatggatgccctagttttatattactcattgcttaagtactagagagtgaattaagcttctgatctattttcattttgatatttaaggatcaaacagaacaactatacatgaagtccccatttccataatgggagatcagcaacatcacaggatactgaattctaccgttgctttataatgtccagcttggcagctcagattctttctagacactagatctacaggtaagctgtttgttgttgaacagcaggaactaggcaatgttttagaagtggcatcacatggcatccagagaaaaatatggaagtgctttatgatgatttttaaagatttttaaaaaatcattattaaaatggctatcctcataaacttcaactgccactataacacaaaaaaagcatactgccactgtaacataataaaaacatggtaatgtagccatcaaatatttattaactttctaccaaatggaagcactatttcattcaaggttccaaatagtcaaaactccctgtccttatgaagcttacctttaaaaggagagaaataaaccataaacacaaagaaattagtaaaacacagatgtcctgttgtgcggggaatatcaaagcagagacagtgaatagcaatcgctgggagaggtactgctttttcttgcttttccagctctatttttaatcttaagatgaattagaacatttttaattctgtgaaaatcagatttttggcataagaggtcagtttcaaaatagatccaaatgctttctattctttcataactgcaagccaggaaaccatcctatggctgacatggcatgacccctatttaccttctcatcctcttattccaaactctccccagtaacagacactgtggagttctcccagcatcaattccttttctatcccatttgttaatggccatgagtttgcatcgaattgcttggccaccacattggggcagtgatggggaggtacgctgccccatccattgttagaccccatccaggtctaaacaaatacaagcaagttgttggatttcaggaaaataacagtaaagctgagcactttcgtttgatgattaaagaaaaaaggttcctttctccaaacaatatatttgaaaatgtgagattcaaacatagtagcctttgttttctgataagggaagacagcctacaatcaagctgactcttaggagaggacacagtgctgggaaccacacaaaaaaagttactggagcccccatcaaagcatgactaaagcccacaatgccaggacacgtttccatgtcaaacaaaaaattcccaccattaattatgtgttcttgcctgctttgtgtatgcaaaagtaacccaaactatcaccccccacacacatactcatatatacaccaaaatctactcatataatcgggtgtgttttagaatcttatttgtagagtcatgcactgcataaggacatttcagtcaatgatggaccgcatatatcaaagtagtcccgtaagattagaataccatatttttactgtacctttgctatgtttagatacaccaatacttaccattgtgttacaattgcctacagtattcagtacagtagtatactgtacagatatgtagcctagaagcaatgggccatacaggctgtaccaactacttgtgtgtaagtacactccgcaatattcgcataacgacgaagtgcctcatgatgcatttctcagaacgtatcccagtcattaagcagagcaggacttaccacagtcttccggaacaaagtgaaatagtatagttgtgcctcagccacccgaatcttggaatgttttcacagtctgaagtgttctctgttcattttttttcatttcggaagcctgaataacaacttcccccaacacttgttatggaaatgtatcaaaccatttctgctcctaatttggtcttgtacaagctgaaatgcatatccaaatatccttagcaacagatatttttggtgatacatatatctcattctaagtcaacatcaactttctaaaagagtccacatctgttttaaaacaaacactttttttattatctatttatgtatttatttagaaattttttgtagagacagggtctcgctatgttgcctaggctgggcgcaaactcctggcctcaagcgatccttcagcctcgacctcccaaagcactgggattaaaggcatgagccaccccactcagcctagaacaaacatttaaatcagcatgcatgtaactgacaaatgaacaagacgttaaaatgatgctataattttcatgctttaccacacggctactgatgggcacacttttaatactccaggtaaatcctgtaagaatctgcataatgacttgagaagcataatctattacaactaccatgaaattactaatagaatgaggctattattttaatttagatgcttttttctttaatgtgtatttacgtacctgacatatattttcatcatctatgtaattacatttactttatgtatctattatttctagcatatgtcattgtaacaataatggaagtcaaatattcaaagttcaattaagttgtacctaaaacatattaaatcatgccaatgtagattttttacataaatataaaatgcatctgtattttgaaatggaatgtatctttgtgtatctacagagagcaatcatgaatctcatatataaaactgaaggcgtcttgacattacagaactttgagtccccagtggacaaacatctaattaaaacatgtggtagaggacagcagctcaagcccacatgagtgggatatcactgatggacgtattaacactgtaatagactgctggtttaaagagttctataacactaaagcagacctgtctaaaatttactttaaagtttgcaagaaatggtgacagcacatgtggtgagccaggttggagagctgcaaagcacacatggaaaaggaaagtgagtggctcctggccagctgcaaagggaaagccagacgcagagagccaccgttggttaacgctaagctactttcaatgatttccaagctgcagtttttaatggacaaatatcaaggatcttgctagcaatccctgggtttcactctgaataggactctgcaatgttgcctaaagataaagaaagtgttctctacttgacaaaataaaataaaacatcaaatgaaaggatagcagaatagcaacatatttctggttgtgagactacaatatagattgttgtatgtaagatttctaaacaagagaactgagttgatatttccattatcatgatcaataaaagctaagttagaattgaccatagcagatttaatagtttcatattttagtagtaaatgcaatttaaagaacttatttttaagatcttttcttatttcataagattctcattagtgagaattttgtggatgccagaatcctacttgctaaaggaattatatctacaaattatatctaaacatacaaatccctacaaaacagaagttcattaagagacaacagatatcactaagaggtaatatataggcagatatagaaattatgtgaaaactgccatgaataaaatgaaaatggaaaaggagtttaattcaaaaaccatagagaaattagaagtttctgtaccaatgaattagaattaacattaaatgttaattaaaattaacgttaatgtggaattttcacctattttacttacttaacatatggaacttgtagaaaatactgtcataattatgcctacttttagaattataacaatagcaaaagcttatgtgaaagatgtcatttaataaattgttttaaccaattggcagctattaatgaattttatcttataaaatcctcaggagactcaaactgtgttttatgatttatgattatgatcagttgttctctaggctacataaacaacattaatggattataatcccaaggggttttttttctatataattctattaagtagtaactactacacactgttgcacaaaaccagtggtatttcatgatagatctcgtaaaatcaagtatgccattcaagtaccagcgcttgtgccagcagtttgttaatacaacaggatgaagagtagggttcttgttgtgtaagcatttcagcaaaagcccaaacaggttcacattctcaggagcacagctgagagcagcgaccatcagcctcccccaagacttgccaacaggtgggggattcagacacccccaagacttgctagcaagtggtggctctgttccttctaactttgtgggagcagagaaaaggctcctcctcatcatctcatgtcactgataaggtctccaagatacccactgagatacatgggagtgcctgtgagcaaggagacagcatctccttgtcccgtggccagctgggctgcagagcccacgagtgtaccctggtatccagcacagaacacagttggagcgtgcctgtgagagcctggcaagaggccctggtcctgggacccactcatgcacctgggggctgccacttgcctcctgtctggagaaacctacaaacacatgcagtgtggagcagccaccacgcccagggcgaggagagaggatgtgaatagattacgtaagctcctttctttggtgagatcggtcagtgagtatagagttcccactggctacctgaacaccacaaaagagaactgagcttgaaacttttcagagagatcctgtccccaagggctacctgctgggacaaggagaacacagaaaccagatgtggttgggagatcttctgtgtgcagcaacagtttgagagagggagtcccaaggctgtgtgaccatgcaaacaacatgcatcagggtctacgcagaacctcagaaaaacgcaatagaggggccgcagtcagcatctggggtgcctgtggttggctggtgttagcataacggtttttccttaaggccctctccccttgctccagtaccagagaagccaagtgcagagcaggtaggggagggaagagagagagagagggaagagggagagggggggaagagagagagagagagagagaggaggagagagagagagggggggagagaggggggagagagagagagagaggaggagagagagagagagggggagagagagagagagaggaggagagagagagagggggagagagagagagagagaggaggagagagagagagaggaggagagagagagagagaggaggagagagagagagagggggggagagaggggggagagagagagagagaggaggagagagagagagaggaggaggagagagagagagaggaggagagagagagaggaggagagagagagagagaggaggagagagagagaggaggagagagagagaggaggaggagagagagagagaggaggagagagagagagaggaggaggagagagagagagaggaggagagagagagagaggaggagagagagagagaggaggaggagagagagagagaggaggagagagagagaggaggaggagagagagagaggaggagagagagagagaggaggagagagagagaggaggagagagagagagagaggaggagagagagagagagagaggaggagagagagagaggaggagagagagagagagagaagagagagagagggggagagagagagagagaggaggagagagagagagggggagagagagagagagaggaggagagagagagagaggaggagagagagagagagaggaggagagagagagagagggggggagagaggggggagagagagagagagaggagggagagagagagagagagagagagagagagagagagagagagagagagagagagaactagcgctggagtgagccagagccagcggggtcagcatagcaccaacacaaccccattccccacaggtcaggccaacgggagggaaggagaaaggtagtgaaggggggaagcggaggggacagctttgcggggcagctgtggtggaaattctgaatcggatgagacttaagacataaaagccgtgtggctgttaaaatcagactgtttttatatgtggaagggcatctccacgctctgtctccacaggttacggcggggatgggatgcgagtccactcacaaagtgagaaaccatggttcagctcaatcagggctcagaatttatgttgaacaccagcagaagcatatttttaacacttaaggaaaacacgattataaaataagaaaatgaatgcttgggaagaagcacataatctgattcggaaatggcagatacagactcaattacaactccaggcaaaacaatctcaggggagtttcaaaatgccatgaagtgaagatacgtattatgaggtgtttttttttttttttttttttttcagttctcctccatccaatatcaaagccgcacattatatttcttttcagagcatagaagtgacgttcatttggtaggttctacaacacatgcttactaatacgacagtgcggaaatcaatcattaataatcttgaaaaattaggaaggaaggaaggatacacagatggaaaaaaggacatttattgattatgacatgtctagacattatcataagggctttgacaatatggtaatgcccatgaattaattcattaactaaatgcatcaactcatatagcggtgatacccgtgttgcagcgtttacatcacacggctcatgactggaggatttcctttgacccaagcagcctggctcctgtatatgcgttttttcttcttttctttttttttttcctcgctgtcacccaagcaggagtgcagcgatgtgatctcggctcactgcaacctctgcctcttgggttcaagcaattctcctgcctcagcctcccaagtagctgaaactacagctgccaccaccatgcccagctaatttatgtatacttagtagagacgcagtttcaccatgttggtcagactggtctcgaactcctgactttgagtgatccacccaccttggcatcccaaagtgctgggattacaggcgttagccaccgcccacggccctgtatgtgcattcttaaccgatatgccctattgtatccaagtggcaaggaaatactagattaagcaaattaaataagagtacatcaaagagtctacctaagacagcatatgtcacacatccaccaggaaaagctcctctgccaggtaacatggagccctcactgtgagtaacatggtcaactctggttttggattatagcgggtttcctctcctcagcaaagagttgtggctgtggaggtgatgagtggagggaagcaggcaccatgtgtctcaaagacctatttgttttccttttcagaacctgttgagaggcttataagtaggctttacagttttttctttcctcttagattgctggttccttgcaggcaggggctgtgcactgctccttgaagatcttaattgaaacagtatctgtacagtagacattcaataaatacttcattaatactaaacctggctttgcaaatgtgaccaaaggaggtatatggaatttagaccacactgtaatcccagcactttgggaggctgaggccggcggatcactggaagtcaggagtttgagaccagcctggccaacgtggtgaaaccctgtttctactaaaaatacaaaacttagccaggagtggtggcgggagcctgtaatcccagctactcgggaggctgaggcaggagaatcacttgagcccaggaggcaagaggtggcagtaagctgacatcactccacttcactccagcctgggtgacagagcaagattccaagacagacagacagacagacagacagacagacctctttttattttcttaatgaagaaaaccctgcaaaaccttaagtaattttctttcctgacacttatggggaagcaagactagaccagtggatccacccctgttcaggctcagtagctgtgacagcagcaactaggatgtcactattttcctctccttttgggtcttcctaaagacctacttagcagtgggaaccagtgcagagtctaggccaaagtaacttttgccgcctctttcactgtatagccctgttgccagggacatggaaatactcttggcaaactctccaggaatggcctcagcagaatcctgggccctgtcttggaagtttatgatattccctgctatggagtcctcagggtggcagaggagctctaaacacaggcctccacactgcctgcaacagtctcagaaggtatgttagtgattctcttcttgcaaggtggtatgctaagcaagctcttccctgactgctaaaggaagagccctcaggagcactcagcctttagctttctcctgtattccaatccctgtctttcaggacttgtggttggaagagtagacacagggtcacatgtctgactgcctgcttcccccgtgtttgtctcccctctttccaacactgtcaaggaaagaaaatgtgagttccctggtactttctgtctgagatggactcagatacgaaaccccatagcataacctgttaatcatggttattgacacagtctatgggaggcaaaagaatatgggaaatcctgttctaactgcacattccctgccatttatgtatctgtcaagttaaaaggttaagaatgtcaacttgagatccaaggctgcctctttaccttgggcaatgtctaatatttcactccatgggactataacccttaaggctcaaacttagaagaagaatggtgccggggaacacgactggaggtaaaaattaaaatgcaatactttaatacttagaaaatagtatccatattgcattaactcctgctccaaagttaacagaatgccctgtattcacattgcagagttaactctatggtgaattagtaaaatgactatagtcccagctcacaaactaagacgtgctcatgaagagttttacatattaaaatgaaattctcttgactgcttaccctatgttaaagatttcctttatgataatttacacaactgctccaaatctgattttcttttcctatatggactgtaaattaatgtgctgctttgataggaggtctcctgttaatggggaactcaataattcttgctctatgtctgttgaacaagttgagtaaactctttgaaacttcaggtactgcaggatgtgggttttaaaaggtgcttgtgtctgcacttgaagtaatgaaaggttcatttcatcccacaaactaattggcaattgtctgttactactaggattatcccggtaacagaaattatttttaaagataaattaagctttcagagggattgacaattcacaaactagacaccactggtcaaactactaatgtccatggtattctctgatgatgtcttgcacatattatgaaacatcatatctttaattcacattgattttttggtaaagaatattactttctccaaatgttagccagttatcaaaatacaattgtctgtaccttaaactctgacttctaacatacaatatatccaatataaacttaggtctaatactcatttgtcagaactttttgaatataagcttattcgtgtcatcttatgtaaatttttattttaaaagaaacatagggaaatactgagatctagctgatgttacataaactgaagtatttaaatgtgtagtctgtacagtgtacttcgcttcacaacttactctgaaagcaccaacaatgaattgatggaagagtaaagaaatggcaaagtgtatcaatacatgaaagaattcatagagtaaattgttacctgcacaatctaggtgggagaattctttcaacatttctgtcgctttaagggtttcataataaaatgttgggaaatttatttcaaatccttcatgaagaataaaatagcaaaaccaaaaaaaaaaatttcatctgatcctgaattgtataatctcttcaaatgacctgttggttgacccctgtgtcagttctacactgttctaactgcccagtcttctttataggaaaacttagcatctggcaggccatgttccccactgtaaatcactttcagaaattacttctgagagaagtgtcaatggcaatggcctaaaatcagtataagagagatttaaattcgctttgttttatcaattagaaatatgaaaatttctatttagttgagaaaaactaaatcaattcgatttcatttactagtgttattattttaacaatttaatttagtactccatatactgaaaccatttcctaataaaccaccagcccagcaaatatgtcccccaaataagtaaactacacattcagttcagtaaggatgcattctgagtttttcatcaatagaacaggattcctcattctttaagtaatgatatgcatcataataatacaccccatctatgtagcaattactatgtaatagtactatattaagtggtttatttttattatattaggtaaattgtaaaaactatcaaatataatgtcaatattatcttcatttgaaaaagaagaacttgagactcagagatataaagttaatgacagaacaggaatgtgagcaaactcctatcctgacctctctgttacacctcttccattaatgtggcagtaactgtctatcagtctgtatctctactgctatgttttggagagttggcataaattatggcacaatagtaatacctttggttgagaagaagttttagtgacatggtaaaaacaatgagcagtgtatgcgtttcaaattcttcaaagcaattttaagataaagaactttaatgactccagcaatatattcaaacaatacatggtatgtgtaacaaatgagtactttattgtggtaggcagtctcaaaaacagtcccaaataatttccgcatcctggtattcacggtcttctccttgaataaactccctctaatcacacaacaacgttgatgggattatcattaccacaaataagttataaaatattgtgacttccatattgatagtagtccctctctagtgctgtttgactttcacactttgaaaagtgagctgccatattggagagaccagcatggcaaggaaatgaaggagacctctgaccaaaagtcagttaggatataaagacctgagtccaacaatttatgagaaactcaatgctgctaacaaccactaggtgagaatggaagtggatccttccctacgcatgttttcagatgagactgtagatctggattcaggccttgtgagagattggcaaacagagaatccatctaagccatgtccagattccttacacacagaaaccataagataataaatgtatgtcactacagaccactaagtgttagagcatttttgttatgtaacaatagataattaaaatattcaattgcctgttaaaattactcaattattgtagccattgataatttacatttaactccaaattccttgaatccatattcagtgcatacttttaatattcatgtcaacaattaaaatatatattcaacaataatgagaattatattcagaagtaaaacactcaataaatgaggattaaagacctgcacatgggaaagatttcaagttctgacacttcatgtcttccaaaagactaatgaaaagatgaaattaaacaaaaccactaatgatgcatgcaattttttccaattaacgagtttgtggatttgtgctgggtgtgcgttgggaggattactacagtcaatcacgaattgtattgactcaaatttgtactcaaatattttcaaagaaaatgtctcagtatttattttttagcttgattctgaaagtgtaacagccactgttacaaaaacacactggtggccaaattgttaatcactgaggatattttcattgctgaataatgataaaaacgtaaatatcagtcattataaaactttcagatttttagctgttatgcagctcatttttattagccaaattgatggtatatgctatacttttttatataatattttataaggcaatgttctcacattagtaaatttaagggaaaggtattattcatgctatgtaaaaggtttctaggccattaggtaccatggtaatatcatattgtacagtagtactttaaaaatcaagttttgaggaaatatgaattttatccagggaaatgcttataataaaaagtataatataaaatgtgaagctcagctgggcacagtggctcacacctataatcccattactttgggaggctgaggcaggcagattacttgaggtcaggagtttgagaccagcctggccaacatggtgaaaccgtgtctctactaaaaatacaaaaattagctgggcatggtggcgggatgcctgtaattccagctactcaggaggtaggggaatcgcttgaaccggggaggtggaggttgcagtgagtcatgattgcaccactgtactccagcatggcaacagagtgtctcaaaaaaaaaaaaaaaaaaaaccatggtgaaactcaatttaaatactgataaaaaattaaatgtttaaaaaattattagacttcttgttgccatgtccctcagtatccatccaggcttaaactaagtgagttatacataaataccgcattggccaatgagaatccattttataaacatccatagtattacgtcaaaaattcaatcaacaagtgtaaaacacaaccctcttctccacacctttgctatagaaaacaaaggcattaaaggagcgtcagcaaatgtttcacttcaggcctgatgcaggagacagcagtggcagtggtagaagcagaaagtgtcccttcaggagggagatggggaggaaatcctccaactcaccatgaggaagcaggaaactatccactgcttttgggtaaagggtagaagcaaaagcaatctgcctctaattgaagggaaatctctagggctctaaattcctcagtgacacaaagcagaagtcagctaccattaggagagatacaggaaactctctcctacccaagaaaaatcagagatgccgacgaggtcctaaaccctagacctaagaggataggttctgtaaaactaaatctagacttggagaatcctgctggcacccatcatgtctaacactgaatcataagccacaacactttacttctgaggaaggataagaatgcagagaaagacacccctctgtggaacacacagtcaagtactgtgtaagagaatagggtgacagaagcctgaacaattctgtcaccccaaacagagtaggggaacaataatagctgcaagataatcagagtgcatcactgtacacatctgagcctgtagtgaactgaggataatactagctaccacaaaacccaacccagctaaactactggattattgacttatcctccaacactaacagactcacaaagattcccatttccagaggcatatagtatttacctttgattttgctgttcttccacaaactcaaaaagaaaaaaaactaccaggaaataaaaaaataaatactaagattcagaaatgatgcaagtattgaaactatcacataggaactttaaaagaactacagttaatatagaagaggtgggaacacgcacaaagtgatggggatataagcaaagaaataaaactataagtaaagaatgaaacacttatgaaaaatgtgaaaataaaaacacaacaacagagctgaaaagtaccttatcagccttatcagcacaaaagagctgaaaaaaggaggagtgaatttcaagataactcaatacagattatctttaaaaagaatttaaaaaattaaacagagcatccaagaattgtggaacagtatcaagaagtctaacctatgggtaactggactcccagaagaagaggaaagaatgaggcagaagaactatgtgaagaaataattcctgagaatttccaaaataaatcaagaagagacaacaaaccagagactatcagagaacattaaagaaaatgaataataatctaacaatcctgacccatcataattctgttgcttttatcattattaataatattattattaatttgcttttgctgaaaatcaaagataaagataaacttatgctggtagacagaataaaaagagaaagaaatattacctccagaggatgaaagccaaggattaagcagacttttcccctgaaattatgaaaggcaaataacaacgatgcaacactttgaagggctgaagggaaaattatgtcaactaggaattctatacctagtggaaataaacaataaaataaatcaacaataaaaataaattaaaactttttcaggaaacaaatactgagccattttcttgccaacagacatgcaacgtaaggcataataagggaaattctacagagcaaaaaatatggtgacaggagtaaatcgagatatacacaaagaaatgtagactagtagaaacagtaaaagtcaaggtaaaggaaaaagttttaaaattttttaatcatttaaaaacataacgttgacataagcaaaaataataactattattgtggattttacaacatatataggaaaaaatcatagttcagattctgagaaagacaaaacaaaattatactattgtaacttccttacaatatataagccacagtgcaatataatttgcagtagacatagtaaattttatatgaaccaaacacaataaatcctataactactaggtaaaaataaaagaaagagctagactaatatgccaatagtggagataatgtaatactttaaaagaaaactcaattaatccaaaagaatggagaaactttgggggaaaataagaaacagatggggaaaatataacacaatgatcaaaatggttgatgtaaacccaaaatacaataatcacatgaaatgcacatgaattaaatatcaccaaataaaaggctgagattgtcatattatatttaaaaagtgatatccaatctaatatggtcaacataaagccaaatttcaatatattacaaaaatacaaattaaaaataaaatgacagaaaatgataatatcaagtaccattcaaaagaaatccagagtggttatatcagacaagacagacttcaaactaaaaaacaattataaggagtaatgatagaggagtcaattcatcaagacataagaatccaatctatatattcatacaacattattcaaaatatgtaatataaaaatgtatataattcaaagaagaaaaagataaaatccataattattgttggagaattcaatactcccctctcaatagttgataaaagcagtagacagaaaactggccacaataaaagaaccctacacaacggtatcaatgaacatgatgtcattgacattaacaaaacattccacacaaaaatagcagaataaatattatttaaaggacacttggacattgataaagatagatcatattcagtaaaataaatcaaatatcaataaatttaccagaattaaaatccaacaaaacattccctctaaacaaaatgaaattaagtttgcaacttacaacatgcggacatctgaaatatccctaaatatatgaaactctaaaactcaggtgtaaataattcatgggatgtcaaagaagaaagtcaaagcgagattataaaatatttttaaattgaataaaaacacaacatagcatatgtgggactcagttaaactgttgcagtgggcaaaatgtgctgcattaaatccttcggtaagaaagccagaaagattgcaagtcaagaatctaaacttctacccttaataagatgcgaagtaacaataatgaataaaacaaagatagaaatcaatgaagttgagaaaagggaaataatagaaacaaatccatgaaatagaaaagcctgttctctgaaaacaataaaattgatacatcagtagacacatcaagcaagaaaaagatagagaaaacataaaatactgaagtcagggaaaaacagaacatcactacaagaactaaagacattaaaaggaaaataaggaattattattaacaattttatgccagttatctttgataacacagataaaaccacaaactccttgagagacacaaatatctaaatctcactcaaggggaattgcacaacaagtataactttctccctcttatagaagatttaattcataggtaaaatccttcacccaaagaaaacacacaatttgcttcaaaggtgaatattttaaaagaaattataccaattgtatataagattttgcaaaatatagaaggaactgaacacttcttaaatcattttatgaggctctttactcataccaaaatctagatatatagtcattgccagaacagtacagtccaaaactgtaagtcagaagagccaagatggctgactacatgcagccagaaagagcttctcctaccaagagcccagaccagcaagaaaactgacagactctgatatggtttggctgtgttgccacccaaatctcatcttgaattcccatatgttgtgggaggaacccagtgggatataattaaaccatgcgggcagatctttcctgtgctgttcccgtgatagtgaataagtctcataagatctgatggttttaaaaaggggagtttcccggccgggcatggtggctcatgcctgtaatcccagcattttgggaggccgaggtgtgtggatcacctgaggtcaggagttcgagaccagcctggccaacatggtgaaaccccatctctactaaaaatacaagaataagctgggcatggtgggaggcacctgtaatcccagctacttgggaggctgaagcaggagaattgcctgaaccctggaggcagaggtgacagtgagccaagatcatgccactggactccggcctgggcaacaagagtgaaactccgactaaaaataaataaataaatagaaaaaggggagtttgccccacaagctctctctgactgctgtcacccatgtaagacataagttgctcttccttgccttctgccatgattgtgaggcctccccagccacgtggaacagtaattccattaaacctttttcttgcaaaaattacccagtctcacatatgtctttatcagcagtgtgaaaatggactaacacagtaaattggtaccaggagtggggtgctgtgaaaatgtggaagtgactttggaactgggaaacaggtagaggttggaacagtttgaagggctcattaggcagggaaattgggaaagactggaacttcctagagacttgttgaatggctttgcccaaaatgctgataatgatatggacaataaagtccaggcagaggtggtctcagatggagaggaggaacttgttgggaactgaagcaaaggtgacacttgttatgttttagaagagactggtggcattttgtccctgccctagagatttgtggaacttcgaacttcagaaagatgatttagagtatctggcagaagaaacttccaagcagcaaagcattcaagaggtgacttgggtactgttaaaggcattcagttttgaaagggaatcagagcataaaagtttgaaaaacatgcagcctgacaatgcaaaagaaaagtaaaaccccattttctgaaaagaaatccaagcttctggcagaaatttatataagtaatgaacagccaaatgttaatcaccaagacaatggggaaaatgtctccagggaatgccagaggtcttcacagcaaccagccactcccatcacaggccaggaggtctaggaggaaaaagtggttttctgggccaggcccagggtccctatgctgtgtacagcctagggacttggtgccctgcatcccagccattccagtcatggctgaaaggagccaacgtaaagctcaggccatggcttcacagtgtacaaagccccaagcgttgtcagcttccatatggtgttgagcctgccagtgcacacaagtcaagaattgggatttgggaacctccaactagacttcagatgatgtatagaaatgcctggatgtccaggcagtagtttgctacagaggcagggctctcatggagaacctctactcgggcagtgcagaagggaaatgtggggtcagaggccccatacagagtccctactgaggcactgcctcgtggagctgtgagaagagggccaccatcctctagaccccagaatggtagatccactgatggtttgcaccacacacctcgaaaagccacagacactcaaagtaagcctgggaaagcagccaggagggaggctgtaccctgcaaagccacaggtgtggagctgcccaagaccataggaacccatttcttgtatcaacatgacctggatgtgagacatggagtcaaaggagatcattttggagctttaacatttgactgccctgctggattttggacttgcatagggactgtaacccctttgttttgacaaatttctcccattaggaatggctgtatttacccaatgcctgtaccaacattgtatctaggaagtaactaacttgcatttcatcttacgggctcacaggcagaagggacctgccttgcctcagatgagactttgaactgtggactttcgacttgatcctgaaatgtgttaagacttcaggggactgttgggaaggcatgattagttttgaaatgtgaggacatgagatttgggaggggccaggggcagaatgatatggtttgattgtgtcaccacccaacaatcatcttgaattcccatgtgttctgggagggaccctgtgggaggtaattgaatcatgggggcaagtctttcccgtgctgttttcaggacagttaataagtctcatgagatctgatggtttttaaaaggggattttccctgtacaacctctccctttgcctgctgccatccatgtaagatgggacttgttcctcctttccttctgccatgtttattaggcctcaccagccatgtggaactgtaagtccattaaactctttttcttgtataaattacccagtctcaaatatgtctttatcagcagcgtgaaaacggactagtacggactccacgcagatctcccagaggaaggcattgagaggcgagaggaagcagaccctgggctgaaaatggaggaagctgggaaccctgcaaggagctgcagagcacccggactccttacgcacctccagcaactcctaggtaaggagtgagttaaacagacctgatgtggcccactctttccacagacctctggaatcttcaatgtagaaaaatctatttttaaaatatatacttgcaaatgacaattgaaaattaaaataaaacaataccatttataccaccaaagcatgaaatatatagggttaagtgtaataaaatatatttgaagtttattctgtgaaaattataagacaataatgcaagaaattaaaggagagtatgtttgtgtgtgtgtgtttatgtgtgtctgctgggttggaagactcaacatgattaagttgtagattctttccaaactgttgatcttgaaattcaacacaatcctaataaaaattccggcatatatttatgtagaaactaacaagttgatattatatttttgtgccaaattgagggacctagaatagtattaacagaaaaaaaaaaaaaagcttgaaaaagaaaaacaaagctggaggacttatactgcctcaatcaagacccaatatgaagctagagtaatcaagacagtatctttttgacataaaaacagacatatagaatgaggaggaaaaaagagttgccaggcgtggtggctcatgcctgtaatcccagcactttaggaggctgagccgggtagatcacgaggtcaggagatcgagaccatcctggctaacacggtgaaaccccgtctctactaaaaatacaaaaaattagccaggtgtgctggcgggcgcctgtagtcccagctactcgggaggctgaggcaggagaatggcgtgaacctggaggcggagcttgcagtgagccgagattgcgccactgcactccagccagggcaacagagggagactctgtatcaaaaaaaaaaaaaaaagagttcagaaatatttccccctcataaatgagagccactgatttttgacaaatgtattaatgtaattcactggagataggaaagtcttcctaacaactgatggtaaaacaactggacatatttttgtatataagcatgaaaagaacctcatatcacttccaaaaacttcaagttaatcatagatctaatgtaaaagttaatatgtacgagttctagaagacaatgtaagagttaggcaaagatttcatatatatgatgcaaaagggaggcatcaaagaaaaaatataaaaacaaaacttcattaaaatacaaaagctctggccgggcacagtggcttatgcctgtaatcccagcactttgggagtcctagacaggtggatcatgaggtcaagagatcgagaccatcctggctaacatggtgaaaccccgtctccactaaaaaatacaaaaaattagccgggcatggtggcgggcgcctgtagtcccagctacttgggaggctgaggcagaagaatggcatgaacccggaggcggagcttgcagtgagctgagatcgtgccactgcactccagcccaggcaacagagcgagattccatctcacaaaaataagaaagaaaaaaaaaacgaaagctctgttctttgacatatattgtcaagaaaatgaaaagacaaggcacagtctgggagaagatatctccaaagcacttatctaataaaagacttgtatccaggagctaggaaaaaaacaaaaataaacaaataaaaacccttactactctaagaaacagaacaacacaactaaaaaattggcaaaaggtgttaaaaaatacttcaccaaagaagagagacagttagaaaatagaacataaaaagatattcaacatcaatggctgtttgggattctctcccaaagcaaaaccagaatgaaatgctactacccacctactaaaatggataaaataaaactatattccaggctggacgtggtatttcatgcctgtaatcccagcactttgagaggccaaggcaggcgaatcacttgagcccaggagttcaagaccagcttgagcaatatggtgaaaccttatctctacaaaaaataggaaaattagtgggtcatggtggtgtatgcctgtagttcctgctactcaggaggctgaggcaggaggactgcttgagcccagaaggtcaaggctgctgtgagcggtgattgtgccactgcactccagcctgggcaacagagtgagaccctgtctctaaataaataaacacaggaaagaaaaaaaattatatatattccacacagtgctacacagagctgacaaagttgtggagaaagtagaacccttatacctggaatcttggaaatggaaaagtggatggcaattctgtaagagtttggtgtttttaaaaagctaagcatgcaattaagaatatctattccattcctaggcatttacgtgagaaacaaaaacatgtttgatattttaagcaaatgtttgtagcaaatttattcataataactaatgactgaaaacaatgtcaaagtccattaactggagagtggataaacaaattgtgacaaagccacaatgaatactactcagtatttttttaatgtactgtgatgtatgatacaacatagtttaacctcaattccattatgctgagtgaaaaaagccagacacaaaagactatgtatagcatgattctatttatatgacattcggaaaaaggcaaaattacagggacagaagtcagatggggtcgccagggcagggagggtacaggtggtgactacagtggggaaggagggagcttgcagggatgatgaaactattttgtttttttttgttttgagacagagtcttgctctgtcatctaggctgcagtgcaatggcacgatctcagctcactgcaacctctgcctcccaggttgaagcgattctcctgcctcagcctcccgagtagctgggattacaggcacccacgactactcccagctaatttttgtatttttagtagagacagggtttcatcaggttggccaggctggtcttgaactcctaacttcaggtgatccaccctcctcagtctcccaaagtcctgggattacaggcgtgagccaccgtgcccgactggaactgttttctatctcccttttggctgcagtcacatgatagtacacattttgtcaaacttcactgaatgctaaaccaaaacaattgagccttatagtatgtatattatacatcaaatcctgaatatatcctgaaacaaaattgaattaaaaaatgttaatcatatgactgagatcaaaaggcctaagtccaccaaaaaataatcctttgtgggagaggcaggtgagacctaggggagggaatggggtagtttgccttctgaaggagtagattgtagtaaagtgctaaggaaaacagaaccttggggaaataaaataaaagcacacagccaataaaaaagggcttgcattcttaataactgcaccatcaaatgctcataaaaatattaatacatcccccatggtaaacgtatgcatgtaaaaataaatgcaaagtaacatcatagcaccttaccctctcttcctctacccatttatccaagacagctgtaaccagctggtatctacagatcttttctatgcattctaatttttcttccctagataacataacatgccaaaacaagtaattgaacaatgttgattctgaatataaatacaaaaaagtcttcctcaccaaaaaatggtaagtatgtgagggtgatgaatatgttaattaacttgaattagtcattccataatatatacatgtaacaaaacatcatggtgcaccccataatatgcatgttttatttgtcaaattaaaaaaattaaatacctatataaataaataagatgctttcaaagtactcagtaaaactgaatacacaaacacctatattctgcaggatcttgggttgaatatcattgtgaatataccttttattacatcatagaataataaattctgactcctacactgaagaaactagaactacaaacaaaagtagcacccactttcgaatctcctgattcacaggtctttgaatttgccccctttcaacatgatatccctcatagaaaacataggactaaagaatatttaaaagtggatggagccaggtacagtggctcctgcctgtaatcatagccctttgggagtccagagcaggaagatcatttgagtctgggagtttgagcagcctggccaacatggcaaaatcccatctctacaaaaaatacaaaaatcagccaggcatgctggcacgtgtctgtagtccagctactcaggaggctgagatgggaggatcacctaagcctgggaggtggaggctgcggtaagccatgatcacaccactgcactccagcctgagcaacagactgcaactacctccaagaataaaaataaagtggataaatgacgaaaggaagaaaacaatttttttatactgttggatttgattttatcatttttgaggatttctgcatctatactaatgaggagtattggcctgtagccttattttcttctactgtttttgtctgagttggtatcagggtaatgtggcctcataaaatgagttgggaaatatttccttccttctgttttctgcacaaaagcatacactattcaggattgttgttatttcatctttaaatattttgtagaattcacttcaccgggaaaccatctaggcctttctttctttttttcttttctggaaggttttaaattatgagttcaatttccttaatagctatagaattattcaggttacccatttaatgttagtgttggtagtttgtgtttcttgaggattttttccatctcatctaaagtgtcaaatatgtatatacaattgtacatagtattcccttactatcgttttaatagctgcttagtatgtaacgatattcccagttttgttgctagtgtcggtaatgtgtcttctctctcttctttgtcagtcttgttagaagactgtcaattttattgatcattccaatgatccagctctttgttcactgattttctgcaatatttgtctctctttaattccattgatttctactattgtctttcttctgtccttctttctgtttgttttggtttcatttcccatccctcttttcttttttttcctagagtctttagctgggagattagattactgtttaggacctgtccccttttttaatgcatgcatttagtgctatacattcccctttcagcactgctctgcttatgtccccaaatttttgatacaatgcattttaattttcattcacttgaatgtactttttaaatttcctttgagaattcctctttgagccatgaataatttagaagtgtgttgtttagtttccaaatgttgggagatatcatccccctttaaatcaacaaatcaccactccatgttggttgggccacgtcaagaacagagcaaaatgtttcatcaatggaacacgtttttatacataatttataaagtacaacataaaaaagcattggagactagaagagagtgctaaaatgatcatgatttccctagattctaagagaaaactatagaaatgtggagaatatgcttatctgagaaaacttgagaattagagaaccacatactactctttgacagtgactagctaatcagtaggcatggtagggaagacgtgagcacatgatccttctgtaacacattagctccactttcatgacactatggttctgcaaagtctcattctgctttcatttttaaaattagataataccactaaaaggagccaaactaccaaaaaaaaaaaaagattccattagccaaacagacaatttaaagttcaagcaaagaaatgaagtacccataaagaaattctctactttgaaaaaggaaatacatcatctcttatcatgtgctgattagaaccaagaaaaaaaaaactctactttgctaaaaattccataaaagcacaaaattattttaaagtagcctatttctttgctactctgtatttagctttaccgaaggtaggtatattggcaatgaaaatatgtgagacagaaattacaatcacaagagagctgacaaatgacctatgctgcctctgctcctgttatttcagggggatgggatgaaagaaatccaaggagaaaatatccatcgccaccagtggtccaaggcaaaagctccaagcggggccgctctgggaaaggtggtcagcagcagtaaagggaattgccatagagcctaactattaggatatgagaacagaaggggatgtagtttcaaagaataatcagggaatcagttgtggatctggtacttgttgttttctgactttggttcaaccaccacaattctcagggtgaccacttctctagctctgaagtacacaggagagaacacatgtccgttaaagtccccttccagatgaaaaatattatgattccaatatttactggacatctacctcaaaggacatgaaaaaatctggtgaatggagggaaagaataaagcactgaatcaaaacaatgggatcagatcttcactttacattttatgatctgtgtggcttcagaaagtcattggaagtatatgaagtctatcttgttcaacatggatgattgtttgaaaaataaatgtgatgatgtgaattaaaatgctctgtaaattgtaaatatacaatgggacattattgccagtggtcaaggtttgaagaacagaactggtaagggcttgtgagccaagggcagggaagactagtcatcataagagaaggcaatctcgaatctccattcgtagctggacaatcacaccactgccctagctactgggttttaagaagatggatctgcaaacatttctaatctaaatttacagtatgagtatctttaggaacaagtcagatcctctggacaaaaggtttgaaggttttgtttgtttgtttgttttctttctttgttttcccagctcaaagacttgtgaatctgttttttccttcgaaaaaaacaaaggtttttttctggctccaagactcctgagtgtactatagagggagatgataatgtgcacaagtttgggtcactaatatctacaaagtagttggttattgaaactctaggtcatttttggagaagaaatcaattctgaaaacaatcaaatgtatatatttttgctcttattaatttccaggccctttacttgtctccatcacagtagccatgactccatgacaagctctaattaccttcagcatggggcatcaccaggcccatagaattggattctctgactccagtcttgtgctctgccaggacaatcaattttacacaagcttctgttctaggaacaccaaacatttttttgcaccttgtattctaacattcccttcctataaaacatgcccttcccaacatctcaagggactctgagatgtttctctctccttcccagggaatttcctaattctccacattcaggccttttgtttccaccaaacttcagaattcctgagatgaatctttacgccttgtggagttcttttcctcccagctctgcgtttttagattaccttagctgtcctttaaaaatttcaaacacagcaggcacatttattttgaactttctctgccagatgtgaagtaagtatgttccagagtagtggttctcaaacttcgggcaatctgacaaaaatacagaggttcaggctctctccttaaatgaatcccagcctttttatgacttattagctctccaagtaaggacagggatagacatggacgttgctggggtttgaggtaataggattcagctgtgacagattcagtttcaagtagctgactacttaaagttctacattttagaatgaaggtcaggccctgcatcaggttcacccaacttatgactcctccctcaagcctatcctgaatttctgagatattctttgctagagtatgatactatcatcattaaatattacattgcatcaatttaagagataaattttttcacatttcaatgtctttgatattgtgtcatatcttaaaatctatgacatcttaaaattatttgtcagcatcttttcttccacattagcacctaacataatggtgcttcttacaatcaagttttcttagatttggtgaaaaacaacagcaaagacatcaagaaaagaaaattattctctaactcaaagttagaagaagtaacccaacagctcaataaatattgtggaaataaagtggtagaatgatgtaatattatatgatttatcgaattcaggctagcatgcttaaatatgaaaattttgaggaggaatttgtcatctgcacaattttgtaaaaattcagaggcgtctagctctctccttaaatgaatctcagcctttttatgatttattagctgtccaagtaaggacagtggtacagatggacatttgaaaagtattgctgggatctggggtcatacaattggtgatctagtatctaattacccagagaactgaagcatattccatcgaatagccaatttggtctgctagggaccaataaagcatggggcatggaccacatctcagttcttaactgtctattgacttgtgggtcatcaaacttaggttcatcctgataacacttcaaaaacagaggtgtctatatctgtgtaacaaactaccccagatttagtggcatgaaacaatgacaattttttttttaaactattgctgtctatcatggctccagggattacctggacttaactaagtggatttcacttggggacttccatatggatgttttaatgcaaaatcatgagtggctggggctggagacagcccacatgtttgatgcctgggtgggaagacacaaacagctgggagctgaaacagagggacaccttgggcgcctctcccaatctccatgtggcctgtttatgaggtctctacaagacactagcttcacagtagtcctatctcttatatgcaggttcttggctccaaaagtgagtgtctccagaaagagagagagacagagagatagacataggtagagagagagagagagagagagcatctacctgtgaaaattgtgtagctcttcgtgacctagcctaggcaggcgtgagtctgctgcatcctatttgctagaattgagtcattaagcctgtctacagtcaagagaaagataactaaacttatggatatgttttaaaaccaccataaagagacatcttaaatgttagtgatcattctctgaatccaaaattcaagtcttgcattttaaataatctgaaagttaatcaacacaaaatcttttttcattcttaaaaaaattataaaagctactgcaatatattcattaggaaaaaaaaattgtaactacatctgagtggtctgctgagtcaaagagaactctaagcaacctataaacatagaaaaacccacacacaacctataaaaatagaaaaacccacccaccaaaatccatgatgcctgtctttccaaaacacaaactggatcaacacaaaatcgctcatcaaagatgcttaaagtagcataaataatgtttctttgtcaaacattaattgtttactactatgtattgaagataatttttaaagtacattataaaagaacttgtgtcccttaaaattacttctctcaggttagtggctgatttcatttcttatctatgaactgcacccagagagatgggaaacctagaggtctgaataatcaagacgataaatatcttctatggttttatatttttcaaagaaataaatattaaatgggaagatgcccattgtttgtgattttgactcaacttttaaaacttgcacattttgatctgaatgctacaaactggacccaccaaaataactcgtatcacttcatgctatttaagaatcatgagtgtttacgtgtaggaattcatgctgtttagagtaaaataaagtctccagaatcagcattctggcacttattttcaatgtaatgtaggcacagtgggaaactgtaggtttaacagaaggaaatactggtaattaatgtattaaattttaaaataagaaatacccaaaaatctgactgcccatgtatctatacattcaagtaatttggaaactccactttttaacgggcatatctaccctatcaggcagccactgacaaacttgaaatgggtaacataaaatatctaaaatatttttatgttgataaaactactataacaaactttatggcaaacaccatgctgaatgccaggaatacattttcattgaattctcaccagaaacctataaggccaataatattctattttagatctgagacaactactgtattaattacccaattttatataaatgattcaaggaatcatttgaactccttaaaataaacaacgatgaacaaaaaaaagtaaggtaactttccaaagtgcaatctttaccctcttgtttctcactaatccattttagagacacttttatttctcatgccagccccttgttgaatttcagcattgctactagccttataagatgtctaaagatcagcatttaatctcagaacaagaaccaaaaacacaaacaaaaaaattaatgagccatcacccccacccctaccccataagtcattacagttaaataattatctaaacttggaatatggatcactgtgtttaggtcataagttgattaagtctgtaaaaaatgccttctaatcacatactctttgccaggcaatgggagaaaactgttaaaacaaaattatggaacttttatttagattgaagttgagagagacaaaatacaaataacaaaatagatataatagacataccacaataacagctagtggtgagaaagagaaatgaagcaggccaggagatggaaagagcgggctctctggggtggtgacatttcagcaggggtgacattatagcttctctagacaaatcacataacctctgtatgtccatgtttcctgatctgtaaaatgaggaactggactataatgacatttaatggacctccaagccttgaagttctatgaccctgagcccttccattcacaagaaagcctcccaaagaagagttttctctaatagctcatctagtatccatccaattccaatggaaccaacagtatcaatcaatcgcactcccttatgaatagtacctctcatccctagaggtgaaggtctgctctcttctttttaatctgataaagctttctggtaaatattgcaatgcaagagaaacaatatttctaagcatcagcaaggaatgtggcaggattccacactggctgatcttgtagactagacagggcaagagatgtaatttgctgaattatttaccacacaaattctcacaaccttaaaaaaaaaatcagtgaaccagtttcaatgcagagaacccagtccccttttttctctgaaatgaaggatggtattgtgtaaatagtgtcaggatgtagggatcacttaaggggaggcagcaattctgaaaacacagattaaagaacaaagatgcacactgacatctcaagctctgcttgatgggctgaatatagtaagacgtaccagtaacacaagcaaattctatactatggtttagaaaaccaaagtgcaagaataatatggaaagccaaatcttggtagcaacatatactggacaaaatctccttagatatgggccgggcgcagtggctcacacctgtaatcccagcacactgggaggctgaggcgggcggatcgtgaggtcaggagatcgagaccatcctggctaacatgatgaaaccccatctctactaaaaatacaaaaaattagccgggcacggtggcgggcgcctgtagtcccagctactcaggaggctgaggcaggagaaccgcgtgaacctgggaggcagagcttgcagtgaacggagatggtgccactgcactccagcctgggtgacagagacagactcggtctcagaacaaaaaaaaaaagtaaactgtctcttttataatttttatactgaaaatgtcaaaataatatgttggtgtgttggtttaactcaaacacattattaaatttaatttcacctgtttctatttgcattttttcatgtggctactagaaatttaaacttgcttatgtggcaaacattttatttctcctggcaatgccgctttagagacaatcaggaacaggtacagcagtttttttcaaacatgtgaagcgctgttgtatagaagaaacattaacttggctcagtctagaaacaagaattagaaccctgctttaatattgcttcatcagcaaaggcaggtaacaaatctttctttcccaacaatgcccagaagggaatgtcatcactctgacagatccatcattgaataggacacttatgaaaaagttgcacttcttatcttactaaaaaacgtgaaaatatggcaataaaaataaaacaagaaaaccaaactacctatcaaaaagcactgtctcattagtagttcccaatgcactctccttttgcctccagagaataattacataaatcattttattttctctttagagaatgagaggtggacacccagcaggcaagaacatcatcagagggactgacattcaggtttgcaaatgaacatttttctgaagatgccacctacttttgttaaacttcctcatggatacattacagatcatctactggaagaaatatttgctgtcttgagactgtcaggattcccagacagcctgtatcatcagtatcacaggaggaaaaaataaataatttgtaaaaccaccctgtgtccataaacctgatctcaacaaagtagcaagactgtcaacagagtttagcaaaaaatgtctatctcaccactatgatatttgagataatactcaagaaaatatcttacctttattacaagttaaagctacaataatgcgacttatatttcactagttccacatagttcaccttctaaatgtgtattagaaatgttaaataattatttatgatcctaggaaattgactctttgactctatttggatcaataaaatcagaaaaaaactcattttttttccaggggtggtttgtttgattttctttaacagaaccaggtttttaaaggaaaaataaaagattatattgtttgtactagcacagaaaatcttaacaatggtttgacagaccttcaaattataaaatatcagtagcccaaagtgtttcaaacactgctgtctttaagaaaacaatttagattcaagagaattcagtctgagtcccagttgtcatcaagctcaatctgtttatgagattttagtttactcatcatttactgagggcattggctgttatactgattcctccagctttaacttcccacattccacatttctatgtaaatagaagggaaaaatcacttcccatttaactaactaaagcccatgcatatttattttaataaaataggtgttacttagggatgaacatctttacagaaacttttaacacaggtttctaagaagtctgtgtaatagctccctgaagaccttttaaagttcatagagagatctaacgtgagtgcattgtaaatatcttgaagggatggatagactgaaatacacacacacacacatatgcacacacacacacatacacacacatacacatacacactgcttgccggattttgaagactaataatgcaacctctaaagccaaattaggattcagatttgtagattcccattaaaatgaaagcaatcatcagttatacttacttcattccattctgaaaattggaaaatattttatagcataaaatagctctggcattagtattacaaaaagtaacacagaagttctggcatatcccagaactctaattataaaactaatgaattcagggagcacctgttgtttaatttgaactcttttataggtaccatgtatattctgtgccagcattttgatgaactgatttttaaaaatctcaataactagctcatttttctaatcaatcactgtattttcctggcaacctactttcttcctagtaaattccatatatactaagtcacattaatattgttaatcaagcttcagaggaagtgtctgagttgaatttggaagtcctgaggttggctatacataaaggtaggaaggtgaagatcagggagttagcctcttaactgactggcggaggggggcaggggggcagggagccatcattttcatgaacgggagctagcgtgtgactctaactggagtcccttactgtatcgtggcaagaaacctgactctccagtggctactagccgaggacgcataaggaagccacagctatgttaggacagcagcttcaacgtggaaatcaggtttctaccatctacttttaggaagtgaaatagccaggacctgaatgcttgtcttagcaccattttgaatgtgatctgccagtcagctttataaaatcagggtctaaacatcttgttttctttttttattaactgctatatcactcacccccagcacagtactttaataactatttttaaatgaaaaagtaaatctcatctactccatggtggctgatatggactatattatgtcctcccaaaaatcatagcatcataacccccagtacctcagaatatgacttatttggaaacagaggcatcgcagatgtgattaagatgaggtcatactggagtaggataggcttctagtccaatatgactagtgtccttaagaaaaggagcaccacatgaagatgaaaacagagcttggagtgaagacacaaaagcaaagaaacagaaaaggttgctagggaactaccagaaacctggaagaacagactctccctcacagccttttaaagagacaccttggtctttgacttccatctccaaaactatgtttttattaattaatccactcagtttgcgatgctttgttacagaagggctagcacactaatacaatcgtcaagacgatctatggcttgaaattacacacaagtcatggaaagtttaaatctgaataaaatcagtaagatatcaaggctaagaaaggattttttcaagggatgtgtagcactatacttaatgtttgagtctgtgataaattgtgactagtctatatttagaaaagcataaatgcctaaaataaatcaagacatctaaaatgtaacccccgtgagaaagagaaactttgatttgtactttgacacatccctggaacataaatcacagcctagcacattatggccacaaaccataatgatttctaaatgaatgaatggctaatagagaataattattccaaatataggagcgaattggtgaacttgcttaatgaaacattaaaaactcaaaatccaaaccagaaataggtataaaaagaaattttcttacctatttctatttggacaattttgtcattgttttattaagtgaatgtcagtcaataaaaacagaaatattaatggaaaaattagaaatatggcatatgggctgtcagtttgagaaaaatgcaagtacaataaaattttcaaatttcaacaaactatcaatctttgacttcatactgtacagatggcaaaggtgctgtgtttttaagcatcaattagaagtaactgtatatccacatatagaagaatgaaaccagacccctatctctcaccatatacaaaaatcaactctaaatagatgaaagacttaaatgtaagacccaaaactatgcaattagttgaagaaatcatagtggatcaatgcttcatgaatttcaactggacaataactttttgtaataagatctccaaagcagagacaataaaagcaaaaatagactaatgggattacatcaaactcaaaagcttctgaacagcaaagtaaacaataaagtgaagagacaccctacagaacaggagaaagtatctgcaaaatatgcatctgacaaggggctgatagccagaacttataaggaactcaaacaattcaatagcaaaaataagcaaataatctgattttaaaacgggcaaaagacccaaatagacatttctcaaaagaagatatgaaaatggttaatagacatccaaaaaaaatcaacatcactaatcaacagataaatgcaaatcaaaatcacaatgaggtatcacctaaccccagttagaatggctattatcagaaagacaaaaaataaatgctgggaagaatgcagagaaagcaaactcagtacattgttggtaggaatgtaaattagttcagctattacagaaaacagtatgaaggttcctcaaaaaattaaaaatataactacggtttgatctagcaatctcattactgggtgtatatccaaaggaaataaaatcagtatgtcaaagattttatatatatatatatatatatatatatatatatatatatatatatatgcacacccatgtttactacagcagtattcacaatagccaagatatagaaatcgatctaaaagtcatctacaaatgagtggataaagaaaatgtgatatacacatatacacataatggaatactattcggccataaaactgaatgaaatcctgttatttgcagcaacacagatgaggacattatgttaagtgaactaatctaggtacaataaaacaaatatggcgtcatctcactcatttgtacaatctaaataagtaggcttcatagaagtagagagtagaatagtggttaccagaggctgggaaggaggaggaggaggcaggtaataggacagtttggtcagtagttataaaattacagttaggaagaataagtgttgtgttctgttgcacagtagggtgaccacagcaagtaacaatgtagtatatatttcgaaatagctagaagattttgaatgttgtcaccataaagaagtgataaatgtaaaagtgttgaatgcgataattaccctgctttgttcattatactatgtaaacatgcattgagacatcacattataccccatgaatatgtataattacatgtcaattataaattttaaaaaactaaatttaaaaagaaattaactatgtgaaacaatgtggaaatagatactgaaatttttaaataagcataattatgacaacatatctacagatattttcattaatgaattacttgtgaattacattgtcaagtgtcaaatagaaaaatctttcaataacaatggcaattatgttaaaaactggacggcgtttagaattatgttaaaaagttatttaatgcttattttaatatattttaaaatatcaatgagaatcctaaattcctatagtaacaattttctatacttctacacataattttcatagatttttctcccttgcaaggcaaaagtttgccctctattctttacactttaatttcttttattcaacaatattaaaatatttaccaaattacttccttgtgtttaaacattgctacattttatggggaaaaaattataacctggtctaaaaaagtacgtctttcaagaaaaataatgataaagacatacagtttcaaattatttttattatagttaggcatggacaaatacaactaggctagaagtccttaagtttgcagaaactacacacttataaaatgtcaaattataaaataaatgtaaaaagtataaaataaataaaattcaaaataacaacattaatatagtgcgtttgatgttgtagcatgggaaaattaattactacccataacgtgaatttgggactgactggtaatggtgtagatcttttgaaatttggtgtgtcacagaatgactaaattttccccctaccttatttacacaatggcaatgtttacttcctaaggacatgttgcccttcactttgcacaaacccttcatgaatgtcctaagcctgtatcatgccatgcttcacactgttagttcaggctatgtcttccacacccagagcttctcgtagagagcttctatacacatagctctgagggaggcatatggtatatgtggattgtgtatcatgtgagtcaaatcctgacccaaacctcctaggtcagaatatttctttctcttgtccaggatgattcccatgagatccaggctagatcaggcagagtgaatccttaacagtctcttggaaccatcaggaaaaagtacattcttcctatggttgctcaacaactagcatataaacttggagctcccattgacatattgacactacttataaaaagcctgctaaagatgaaggtagtaaagaagaaagcagaactaatagacagtgtattggtccattttcagggtactaataaagacatacccgagactaggtcatttataaagaaaaaaaggtttaatggactcacagttccacatggctagggagggctcacaatcatggcagatgacaaaaggcacatcttacaacgcagcaggcaagagagagaaagaaccaagtgaaaggggtttctccttataaaaccatcagatctcatgagacttactaccatgagaacagtataggggaaactgcccccatgattcaattatctcccaccaggtccctcccacaacatgtgggaattatgggagctacaattcaagatgagatttgggtagggacacagccatatcagacagaaagagaaaaaaatgagccatgatcagtagaacgtggggacggagcaaacctctagcatttttacttatgagagtctgtaaattccacatttcctagtactccaggttaagttcattttccatggtttgcaaagggagtcccaactaatcaggaaacttccactggctgtcagtgatatgcccagaataaagaactggtccatctggtggtacggtttaggtagtgagcacactgcccttaactggaaaggtaggtattcactatctgttaacaaagtggctgttaaacacctctctatgtatctcaaaccacaagttggagggttggagaacttgatgaagtgtcccggatgattctcatggccttttgtaaatttctccaaagaacaggcagtcttacacttagactggcacagtgagaaacagagaaaagaaaatatctgaccacagtggcacattctgcccatggccaggaacccagaatggctgagtaggaaaatcacgagccttgtagggttgaaagccaaatctagtccaaggctcagacctccttttccagcaatctggccataagataggaggtttaaaatacacccagcactccactgatgggtgcagcaaacgaccattgcatgtgtatacctatgtaacaaacctgcacgttctgcacatgtatcccaaaacttaaagtataataaaaaaacagaataataataaataaaattacaataaaaaagtacacccagaggctgaggggtagggatataggtgatagatgagctgagatgctaatacagagctctcatgtattctctaagtccaaaggcacatgaacaccatcatggaaagacgtttcactccactccacccaaaactccatggaaatgagaaatataagtgaaaaaagtagcctacaattttgtgacaaattaaaaatgatgaacatattttgtttcgtaaagacaaatatattccctagatatgaaattccaaggtaataggtaataaagtagctactaacaatcaacttctcattgatatagaaagtatggacttatctgcatttataccaaatatatagctttatttcctttgtgaatactagtagtaattctactatacatttgtaataaattattaaattggcaggagacattgtatcggggaatgagaaaaaaggcaattatgattaataaaaaatatttcttaaaaaataatgggagttcttttcttcatttactttcaaatccattctgctactgagccacaaaagataataacacccagagtgccaatccaaaatcacagcattcgctcacacatatttccatctcattaatgaaaaacaaaagtttctatttgaagtacattttgtactatccaatataaacttccctgtagctcgaacatactattaatttatacagtaaataaatatctgaagcttccacatttgctgtgataggaaactttatgtgtctacttggctaaggtatcatgcccagctgtttggtcaagcacatgtttagatattgctgtgaaggtgtttgtgaatttgattaatagttacaatcagctaactttaagtaaagcagatcaccagccatcatgttgtgggcctcatccaatcagctaaagaacttaagagaaaagacggaggtcccccaaaatcagaattctcctcaagactacaacataaataccctgtttgcgttcccggcctactggcctgtcccacagatttcagactttatactgcagcatcacccctccttgaatttcctgcctgtcagctcaccccacaggttttggattttccagtccccatagctatatgagccaattccttaaaataatattcatattatctctctaatacatgcgtgtgtgtgcgtatgtgggtgtgagtgtatatgtgttctgtttccctagaatgaatttctcttattagaataacatttaaatgcccccaaaaagatcttggctgaaactctacctttcaggagaagaaaggtctttactctgcatgattgaaagaaatggtacagagcctgttttctcagccctagttatttcctagaggaatttgctgacttcactctgtggcctgaggggaactggtctcacccatgtccagtccacaggagcagctggctttatgcagctttgttcattaacacagggcctgtttggaaatcctacttttagtcattaaaccacgcctacccaggacttcttcacagaagtgctggattccgcctgtagtactgagtcacaggcaatcatgtttgtattttggggagtttgcttggcctgtgtgctgctgccaagtctccacattggcaatggccaattccatttgtgattttggtaaacacagtatgtttcataaggtactgatggtaaaagtaaatccaaaattctaagctttgattttcaaaatcctggccagaaccagctatttatattttaatcagcagttagggcagagggtagctaaatgcagtcgatgctttctagaaaaggcaaataaaagattttgaatataatttccagtcattcagtcatggtatacattctcctcctacctcaagtcagctacaagcttcccttcaccttctatctcctgtttcctgttacacatttacaattaacttacgtctcttaaccacgccacctctttagtggcacccaacggcattcattgttccttcccccttgttcctacctttcagactctacagcttccatctgatatttcccagcacccactgtaggccatggtatcacactcagccccaagaatgccacaggaatgtcacccagagactgacctcaaaatgctcaaagtaaagccattcattataaccaaaggtgattattcaaagtctgaaagagatttttttaagtgcgttcttaaatttagaaaaaaaaatccacaatccttgcttaattaattatagatgaaactcagtcagcacaatgccaaatcactatattcctaccttgaccctaagtgatggtctaatggcagtaaggaacaaatggcaagaatcaagagagaactgagaaaaatactgtgagaaaactggagtaaacataacatttgggggcacttgtatgtgcacagcatgatgtgaaggaaatgccaactgtgacagtatcactgaccaaagaaacaggtaccagtcagggtgatccaaacagtatccagttcagaaatacacatctcatgaaaagatactgtatacttacattgaaaacctctaagtttctgtttacatgcagtgggaaacagtctcctagatcctggaattacactgactgaccctttagaaacagaagtaagcagagaagaaatgtaatagagcaacaaaatatatgtatttgaattacttgttcatagaagacccaattaattattcagcaaaaagaaaagaggcagctggaaatgaacaataggaaaccaatttgataatgggtttgcccttatgtgtgcactttaccagctgaaaggtccaagtaatcactctttctctctcctttgactgtcttttacttgcctgtttctctgtgtctctcttttgatgtttttctctctttcttttcaaacctcttccaaataaaagaatcacattcaaacctcgggagattaatcaaagcctgtcaaaattggaaaacacataaatctctgggaagaatctacttagttggagattgctccccaacttctcaccaggtctcttgtgctagggaaaactcactctttttccctcatcactccaccaaaactgctttggtcaggctccccaaggaccatcctctttctaaagctgtggacaatttttaggccttctttcctttaccttcctgcagcatttgacaggtgcaggcacagccaagctcttcctgggtctttgtgtttggcttcatgaacagcattctctgcatgttttcttcctacttcactggccacttctccctcttctgttgtctccccctctccctggcatcccaatcatgctcacaccagggctcagtggtcttaccacctcctctttatttacattcactttcttggagatctcatccagtctggtgactttaaatatcacacctacattgatgaatctcaagtcactgcccacacctggaccttgactcctagatccacctgcctactgatccactgccacttagatccactgacagctgggtgccccataggccttggtgaacttgaaactcatctcaagttgatccacctctcagacctgccccactcactttcttctccttctcatttggtgccaattgcatccctacagtttctgaggccaaaaatcttggcagtcactcttaactcagccttttctctcccattgtacacctaatccaccaggtaactccgttgattctaccttctggataggtacagcgtttagtcactcttgccacctccattgttctctcctcctcgtctgagccgccatcatgagtcatttggattgacaacatcatctctgaactggtctctccgtgtccaccactgctgtcctgcagtctgttctctacaggttcatcagactgatccaagtctatgtcagatcacatcacttcttggctcaaaagcatctatgataaacaaggccctggaaaacctggctgagcattcgttctcctaagtatcctccctctattctccttccagccacaccgtcctccttgttgttcccaaagcacgttcagcacactgccacgggtggcccgttgtgctcactgctctctgggcctggacccgtcttttcaaagccagggtcatggctaactccctcacctcctttacttgtcagttctatataagtatccaacataaaagttcaactgcattacttttgcctggaatcctttctccccaccatttctccacttttattttgttttccatggcacttatcaacatctaacatacaatttactcatttctgtttgctgtttattgtcaccctcccaaacagctgggcaccgaatcctagccaagcagacacttaaaattacctaacacagtaaatgtggaagcttctgatatttatttactttataaattaatagtatgtttgaactacagggaagtttatatttgttctgtgatatattccaagaatctagaagagtgcctggctcaaagaaagagcacagtaaacacttgttgagtaagtgaatactcaaaactctaatttgaaaactgtatccaatatgtgcaaaatccttcctaaagcttacagaaggtatatattccatcttaacacaagtatcgaacgtacagtaaaatcaacactgaactaggaattcaaaccctggatctgaacctggatctcgttctaacgatttggccacgaagtagttcttcaaccttcctgagactcagttctttacctgtaaaatcaggataacgtttcacagtttttgttgttgttttggtttttaaaaccaaatatgatgatgcctgtaaaactataaattcagaaaagcaagatcatctgataagaggccccactattctcttctaaactgggccatttgtggtgcgctgtcatttttcataaagcaagtgataaaaatattctgtaactataatgtgcagctgcactcacagaccaaaataaatctgattaagacacagttccttaaagagcgacggttacttgggtttttgcaatcaagcataaaaaacctgtaatgccggagggcagccttaaaccagggattagctggagatgccaaaaggatttgtggaaaaggcttcaacccacaggttgaaacagggacagcagcatcttatgttacctagagataccaaaggtcggtggtgaggtgtgtgggctcctgagccagactccccaggtatgaatcctagttcccctacctttcctgtgtgtataaccttggaccagtgaactaacctcacctcactggaaaaacagagaccaattgtaggattagcatgaggattaactgagctaccagctaggatgcactatgatacgtgctcaacagaaattcctttgggcaaacaagggagtttagtgtgtacatccaacaggtaaaagcatttttccttccaattaaataaagaccagtggagaggagatctgtaagcaccttattaggtgaaaaacaaaatctaaagataaaaaggtatatgaaatacacacaactaaaagccacttttaactcatcttgagattattcagagattaagtgttcttgaactcagtcactttagaatagagacttctggtcaccctgcatagaggttccctaaatgaggttctgatgcagaggcattcacatcacctggcaacctctcagatatgtgcattcttaggcctcaccatagacctaataaatcagaaactctgggccccagacctagaattttaacaagctttctagatgatggggatggaggtcatagtctgcaaaccactgccctaagccatcaactccaagagagaataaaggatattgccggataattgaacttgactcttcactgctttatctaagctactcatttataaagtgtggttgcaagaaaaggctttgagaaagcactgaatgaatactatgtgcattaagaaattgtggttagtttggcaggacacaaaatcttcaactcacaaatatctattcagcattaattatctataagccaccatgccataaactgggagagacaaaaagaacaaaacatggaccttgccccctgggagtttataatattataaggtattcagatacagaaagaatgaacaaaaatacaaagcaaaatatattttctgctttcacaactaagaaactgagcaaagttctggaatattgactacacaaggcaagatcagaacaggagttcattcggcatggccagagggaacgaggtaagaagggatgctgtggaaggggaggctgatggaaagttgggagtgagtgtcatctgaaggagtgtggtctttatcactttttcagcacaaagttgctgaagccttttgcaaaaagctgtgtttctctgtatttgacaaactcggctcaggatgatagtttagtatcaatctgagtgtcgaaggtagaaagaggctagaaacaggaagaaaaggtaactgtccagaaaagagaggtgggagggaagaagcggaagtaaaaagtgcaaaacagaggatagaatatgaaagggcatcaggaactacagcggcagaatgaattaccagataagtcaaatagcaccccaggtttaaaactaaaaagaacaccagaaaatacatctcccttcgacatatatgtggtttgtgatatgattcacttactggtaacatggctgaatctgagctatctataatatttttaaaatatgtacttggaccagaataaatttgaaccttatgtgatgaattcctggcacaagaaataaaaacaaaatcacagcattttagagtgtgaaagcaatatgggtggttttggaaatccctttaataattatataagattatttattttcaaaattatcaaattcccaaacaacccacttaaatagttgaaattagtgcatgcagacatatgaatgtccaataagctgatataagaccatgcatttaaaaaatttcacgtacttcacattaaatatttgaacttaaaaaccattcttatactactgacatcaggattagattcctaaattatatagtccatactaaataatataaacattggttttcacagttcaatttcccctactcttacatggttaatttgaacccaatacaagatgagatagaggaatggtcctccctatggagcaaacgttggaaaagagtccgggatgatgaggatgtgccagccatatcaaggtacaaagctctggcagggggaatgtttgcagggggcatgtgtggcgatacaaaggcaccgaggcaggaacaagccttgtttgtacaagaaacaaaaatgacaatgaggctggagcacagcagtcaatgagggtgtgtcagcaggccgtggtaaagatgagctccctcctgcacgagagccggacagggtgcgagcaagaggacaatacgatctgatgaccctttgctgatgagtttatacctgtgtcctaatgaggcctgcaaatcttgtcatttggagccagaataatgcacaaggctcttgactcataagggttatctatgatctttggggtcaataagcagaagagctgatatatattaagtacgggttaacctagttagtgtcatatttaataaatttgagctgagctacaaatgtgcatattggatcagggactacctatgctattaacgaaaaaatatcttctctataagggaaatgatgcctctctgctctacaatgtgttttgtgatcgtgcatgagcatataagaaaaggaagaatacataacatgatatattatgatttcaacacgaaccttccagccaggatccacaagaggctgacaaggtctgcccatgatcaggatggctgtgaaatggaaaagagaacttttcagataggaagcacagaaactgtgggttccttaggggcctgtagctaatctggtactccttatggcatatgtttggaggttggacttactccctcaaaatgactgcaatcaaatgaaatcacaggtaatgtggcttcaacccagccatggaccattttttaaagtaactttatatggggattgcttgtgcttatttttcactcttgtttccctccagttttaatttgatgtttcttcttatcaatccctagacaccttcttaaagactttccacaacattggattccatttagttaataacaaaaataggtggcaaagttggttttatataatattgccttataaatgatgtcagtatacatgcacacaaagaaactcccagaattttacaggcaaatatccagttgataggaatggggtgagggggtggaaggtcagatgacagaaagaacttggaagtgttcataaggtaactaaacccaaaattgctgctgcaaatgtaaggttataatacaatcaatacaataccaatatctgtcctattccttgtacttttaccaactatattgctctacacgaaccctgcagataacttattgatatatgtatcatggatgcatattcttagctatgaagcattaatttttctgttactatccacgtttaatcaaataataaaacaacaataagaataagtaagaacaggctgggcacggtggctcacgcctgttaatcccagcactttgggagctgaggtgggtggatcacgaggtcaggagatggagaccatcctggctaacacggtgaaactccgtctctactaaaaatacaaaaaattagctgggcatggtggcgggtgcctgtagccccagctattcgggaggctgaggcaggagaatggcgtgaacctgggaggcggagcttgcagtgagctgagatcccaccactgcactccagcctgggcgacagagtgagactacgtctcaaaaaaagagtaagtaagaataaaacaacaataaaactagctaatatgtcacaaacttatatacgctgtccccaagttaaatgctttacatgtattatcttgttaattggaaaaacccaatgaagtagattctatgatggtcaagtcacaaggctaatggctggaatcaagcctgaactcagacacacactgaaccactgcaagagcatctccttcacgactgtctgctaagacacagctcatgctcctttcctgtatggagtcttcactctcctttaacactgacatctccttcctatgaatgactgaagcagttcatttctgtgccattatgtgttatgcttaacacatggtgccttgtttcataatttgcactatcaccacaggtgttaaattccacatgcagactttcatatggtcacagatctagaagaacaaaacaaaatacagtaaatgacaacgaaaatagaaattaaagtatcttcccatcaatcaccaaccctaatgattataaaattattgtaggaagaataaatatccagttcttgaacgaaaacaagttcatgtatcatctggaccccctatatgtctacacggctctgggggacctcttatcagtcattttcctgctgcccactacttgctttcaatacaggaaaggccctagagaccttgcacatgatttccacagaacaatctcctattcttacccttaataactgctgttcatctatgagagccacctacatgcctgtaactcacacaaacctcacacaacattagcctttgtctcaatactctctcttccagatcctgctttcttctcacttaacctttttctcagtagcaaaattcattcattaatggggtgaaatcagagtccccataaaactctgagcaccacaagggcaggtaccatacctattttgtattcagcactctttccttaacacctatacttaccacagtataagcacactctagggactaccagatatagactgaaagatccctccccatccctttatttgccatttatttaaggaactggcaaaataagggagaaaaaataatacagttgaattgttactgtactttttacaactgtcaatcatattcattcatcataacaactgtgatcaatcggattaaatatctaaaatatttaaggttcaattggtttatgctacaattaaacatgtgaaaacttgacaattttatcagattggccataaaatattttaatctcatgatgaattcatctattgagagttattacatcttttaagcaaaatagcacccacatttcccatacacaatgctttttacagatttactaatgtttcaaccactggacaattctgtaatcacatttgctggacaactccgttcttagtaaattgtagagctctgttgtaaatgctgttgttttaataatattttgtagcattttaaaagatacataatccctaatgtttaacacagaggtttataaccaattctctatgagagctaagtactgttaagctcatctgtaaatttcaccgttttagtatcttaattggatttcaggtaattatagctaagattctataatgcacataagaattgtttcagctacaaaaataggaaaaatttaaaatatacacatgcctttactgcttataaaaattacaagccagcggctatttgtttttataaaagtgctataatttaccttacaacagatatgtaaagaaactaaaccaggtaatttaggtaccaattagaacttttactttacttttattcaagcagtgacataatctaccacagttgtagcatttaaatacaataggtttttgaagaaggttggcacatctccgttactccagggtcttgcataaaacatgtcaaccccctaaatattgcaaatatagggcattgtaccaagtctgcctaaattgccatctacacattactataacagtagaggttttctctcaataaaacataattttcttttgttgctaaaaggtaaataatgttttcagaaatctttctatggtaagtattttgaagtgatcttgttctaaaaggtactggaatgctcttcctgttactgccctctaagatgtaaactatagaaaatgacttgaacagaaaacaacctctcccacatacatgttctgacatacataagtccattttttacgtctgtactgcatgatcaccagtgtatgtgatggtttcgagtctttgagttttatgtttcaaaaagtcttagagtcccattcagccttctctgctcaactctagactcgtatcatctactgcctattggacccctccactcagacatctgataaacctctgccacatgacacagcataataccacataacagaaccgcaaaataaaaacataacaaacatgatctactgaacctctcccacccaaacttcattttctcctctatcagtgaatagaatgccatccttccagttgctatgccaaaaactgggagtcatcttttatccagctatttcttatactccatccaatctgtcagcaaattctttgaccttcagaacataaccagaagatgatcacctctctcgccatctctcctctgaatgccattgtccaaaccgatgtcatcttttgttcaggccctctgcaagggcctgctatctgagctaccatccccaccccacaattgagcagagcagtcagaagaatccttgcaaaacatgaactcgatcacgtcccttctctgctcaaaactctgcagtgtgaaagccaaagggccctcacagtggcctacagagtccacttgatgtgttctcccatcatctctctgaagtgatgactacatttcctatgatttgtctttgtgcctgtgtgccagccatgattggactccttggcatttcttgagtatactcggcattctcacaccttagggacccaatttactgtatctacaaggctcccatccctatcttgttgaaatattagctcaaatgatgtcttctcaatgtaacctaccctgactaccctatttattaatagaacttccaacaatgcccctatcattttgtgcccaatccctctaaacttgctctgtggttttctatagcacttgttgcctcattagataatctatactcaaattgggtgaaatggaattaaatgggaaatagaaattaagacttctttcaactactgatttaaacaaatttccacatttatattatctaaatatggaccaattgttaggaaacttttctcaaagattgtcctgttttaaccaacttactactagaaattttccatttaaaatattccatttaaaatgaataatttatggaaaatagaaattttccattaaaatgaaggcacttgttatagtaattcatgtttactatagtattttcaggacagctggtcaaattttgggacggttccctctcaaatcttggaatttgttcaagtatgcactaacaacatgacattttcttactttgaaggcaccatggttttgaaaaaatttattccatctattcaaagacttcttcccaaaagtacattcatggagtatggttttaggaaactagaaaacttgatgcatttcttaccattagttctaaaacagacatttccatgccttgccctataatcctaaaaggttgatatttttgaagagttactcaaaaaataacaatcatattactaccatttcacctgctttctcattccctagcccttatttcaaaaaggagtcttcattttgccataattattagaacattgtttcttggctatacgacaatttatctcctttgagacattggccagctcttctgttttcagcctcctgagagttctcaaactgctttatatttgctgtcagtgcacagaagatgagaaaaacaagcactatattaaactgaatatgaataaaatagagtgaatatcatttgaatacacaagataaacagttttctgtatcccattcaagagaaaaattcgggctaacatgaaatataaagactagttagacttcaaaattcaacgtatacagctcagagttagatttggagtctctgtactgcttggctgtccctagtttagcaatgcaacctgagtacatctattttctcgtatttcatttaacctttgaacttacacgaaaatgtccacgtgtttaaattgtgttttcctaagaaagttaaaagctttttctttatgaaaagaaattatgtgttgatattcatctgtattctccacagtacagagcacactgttatgcaaatagatgttcaataataaaactgttgattgccaaacaattgttgtttcttagtgtaaatggtatatcccgaaaatattctctctcaggacttgagggctgtagttctcaaaggattttgctcaatgggaataaatcaaattatggggccagatatatcacaccaggacctcatgcacaatagcttccttagcttaggaaccaattatttttgattggtgtaagcattacatggacagctgctaccaggacaataaaaattattaataacttccggcagtaaattcaattattgtgattatagatgcttggatatgtgttacatgggcaaaccaggaagtgaaagaacctcctttttaatgctgattttcataaaaataatcaaatctgagcactggaaggccaacttaacaattgcttggcaaactcatgtgctacagtcagcataaaatgataatcaccatccacactttgcctcttctatcaaagtaccacttctgtccaaaccaaatttgagaataataaaatcgcatattggaagcaacatatttaacacaagataataggcaatttaacagtctgatgcagtgttgtctgacacaaagagatggttttacacctccaaattctacaattatcttcaacgttctctacaaaatagatataatagataactgaaatcagcagaagtacacctaggactaagagctcctgatgtcaggttttatttagggtacatctaaagcagaactccacgttcttttagcagttcgggcctgctctgctgattcaccactgctgcatcatgaattgatcaggatcacgaacgtcatgtttcactgctctgctcaggtcagtgtgtccacgtcctaattactgcttgacttgctttgtcttcctcagtcacaggaagccactccccacaacgaaaggcaggcttccaagaggtcactcgagggacgccaccagcaaaggccttgaccaacctccgctgcctgaaaaaaagggtcaggtcccagagacaaatcgttcttcaattttaacagcagacaaatgatgctgttcttcctagaaagttctattgccagtatttagtagaaatcattattgtactacttagaaatgtggatgccacaataagcagatgcgaaatgtgacattttgattatttacaaatcctctgaccatgattcttgcaaaacaaatatgatcatcttacaaccaaagggagttaaaattgtatctcaaagcctcacctttctcctctagaaaggccactcagcttactggtcccagcacctggctgactctccagcagacctaggattagcactcccgctgcctttcctggatccaccatctacctgtctggtgtaaggcaggctttctcagccacaggactgctaacatcacaggacagataactgtgttgtaggggggctctcctttgtattgtaagatgtgagtggcatccctggactttacagcctaacttaagagcagccctgccatgcctcctccaccagttgtgatgtgcaaaatgcctcccgtcagtgctcagtgtccctcaggtggcaaaactgtctccacttgagagctactagtctacagtgaatcacaaacctgtctgcctgtctgatctcaactgttcttcttcttccttttttttttttttttttttttttttttgcgatggagtttcactcttgttgcccaggctacagtgcaatggcacgatctcagctcactgcaacctctgcctcccgggttcaggcaatcctcctgccttcagcctctcaagtagctgggattacaggcatgtgccaccacgcctggctaattttgtatttttagtagagacaaggtgtctctatgttggtcaggctggtctcaaactcccgacctcaggtgatccgcgtgcctcggcctcccaaagtgttgggattacaggcatgagccaccgtgccagcctgttcttgtttttgaatgtgtaaaatgggctgatttaagaatatgagatggagaagagcatatttacaagcatattcacaaaagttcctttcagaactaggactatattgcttggaagttctctttttttgtttggcagcctatctgtcactgaaaggaagaaatttcaaagagcctgatatgggaagaactatgtgttttgagaaagggagagaatttatcaataacttcaaaaagaagggaaaagagaaaaaggaattactaaaggagaataactgtcaacctctttcggtgtcaattaactaaataaactcttgatataattcatttttattaatagagaccagcaaaggagacagattttcacttctaagttggatcagtgtgggaagcagaaaatacccgccaaatgcatacatgttctaattcctagaaccagtgaatatgttatgttcaacacaaaagagaactaaggttgcagatagaattaaggtctctaatcagctgaatttaaaattgggagattaccctggattattgaggtgggcttacaataatcataagggtcttgagaagtggacaaaggaagaagaggagaactatagacgtaatgtggaaagtactcagcctgttgacacggtctttgaacatggaggaaggagccacaagccaaggaatgtgggggcaacctttagaagctggaagagacaaaaaaaaaaaaacgagttctcctctagagcctccagaaaggaacacagccctagtgacaccttgattttagccaactgacacccacatagagcttcaaacataaagaacttcaagaggaacaggtgtagtggctcacacctgtaatcccaacactatgggaggccaaagtgggaggatctcttgaagccattagtttgagaccagcctgggcaacatagaaagacctcgtctctacaaaaaatttaaaagttagccaggtgcagtggcatatgcctataaacctagctactcgggaggctgaggtgggaggattgcttgagcccaggagtttaaagctgtagtgagctatgattttgccactgcactccagccaggatgataacgccagacgttgtctctaaaaaaacctttaagaaaatgcatttgtgatgttttaggccatgaaatttatggtgatttgttatagcagcatcagaaaatgaatgcagtcaggtataaccaatgcatcatgtgaggacacaggacttggttaagaggaagcctgagcaggatgttcaaatctcagttgccctataaatggaagtatgggccaaggttaaccatctacaaaaattaggaggtccccactgacagctctgacacaggaaatttaaaaacaaatacatttcagagactgggagaactgaaggagattttgtacctaaagtgtgcagcacagtgcctggcacatcctacgtgctaaatgtttttcgtggatctcctactgcatttttcctacaaacagaaaagcttttgccacaatgtaatcacctttcccatgttgtcctaataacaaactacactactgctcatgcaaaataacgcacagggagaaagagaaatcacatgccattaggcttctcttggaattcttcgcgtgatcaataatggcattctcttctgtgtggtcccaatcaatacatgattctagttatcatgaactcactccaagacactgcctccctgacaccttatcacgagcagtagataagctgtaacaatttttctagatatctgcaagcacatctatcactgtgacaaatgcatgatgtggcattatatcttctcttcttagccttgttttaatatcacaagtctgtatttaataccacaaggttctgatccaagctcacattttaacgctttctggactgccaatgcataatgacctttcttgactatccagctggttggctggtacaaaatactgtgaagccagggacagtttcaacaagccgagttattccagagaaggatgaacttgctagaggctgtggtactaattttattgcatgttaattctagccaggaaaattgccctttgctcagactttgcactgatttcagagaaaagtccaataattatttgaggcaagaaataatggctgtttttgtttttacttgggggaagaaaatacaaaatcacagaaaacattacaggcaaggaataacatctcagattattataatcagccaatcagaactttaacgagctgtttaagattttctctctcttccacatggagatgtcagttctgtttcattaacaggatactcagtcacattggcagaaaatcctgtggctactgtttgagaatgagtgatcattatttttagaattattgtgtattagaccagaaagtaactcaaaagacccaccagttttgccattagttatagatactgagaccattcattcattcattcattcattcaataatatctatgctctataaagcctgtgctggtctcaactagtcaaagacactgaccctaaatcacccagcaaatcagtgataaagctgtgattccaagccaagaactttggcagatcactgtaatcaatacacctagtaaaacaccaacttacactgtgacttcattaaaataatgtactatttataaattgtaagaatttatgaaaaacagaaacagtgtaagcagcgctggacatctagaatgcctcactgttttatgatctaaggcacatcagattgtttttcccaattatcatggagctagttccctacacttcacctcagtgctcttttgtcaaccaagataaacccctgatggcgaagcaggggcaggatagacagagtccccaggtggagtactagaactaacacttaccattatgtgtgacctctgacaggtcacttcacctgcaggcacagctagagcaagcagtgacgcatgcgcaggggtgtcccttgcctccaatgcagccaccatcccagctgtggtgctgaggatcacactagccccaactaagacctgcggctggactcctgcctctgctctgtcaggacagtctttgggtgctccagggtggtgattggggtgtgaattccaccatagggcagtctgatgtgggaaacactaatgacagacccaagctaccagtttgaacatcatcttaccttcaaaagaggtatgaaacccactgaaagtaaattaatcaaactaatgatctttggtgttaaatgactgaatattcagaatcaaggggatcatggagtttgcctgctctttaaaagtatccaactcaacaagaagaagaaaatgcaaaaggagcaaatgacttgaatagacattactcctaagaagattgctatcgtttcaatatttgtcccctccaaaatgcacgttgaaacttaatcctcaatgtggcagtactgagagatagggcctttaagaggtaattggatcatgagggatctaagttcatgaataaatttattcattaatagattaatgagttaccatgggagtgggactgatggctttgtaagaagaggaaaaaagacctgagctagcgtgctcagccctcttgccatgtgaggccctccacagccttgggaccatgcagagtctccagcagcaagaaggtattcacaagatacggcccctggaccttagacttctcagcctcaataaatgtaagaaatacattccctttatttataaattagccagttttacatttttggttataagcaaccgaacacagacaagacaaagacacccaaatggccaatatgcacaagaaaaaacacccaacatcaacagtcattagggaagcacaaatcaaaattagagtataccacttcatatccattagaatggccatactttaaaacatggaaaatacgtgttggtgaaaatgtggacaaactggaaccctcatgcattgctaacaggcatgtgaaatggtacagtctattcactcaaaacaggtaaacacagaattgccatatgatgcaccaaccccactcttaggtatatacccaaaagaactgaaaacaaagactcagatacttgcacaccaatgttcacagcagcattattcacaattgccaaaaggtgaaagcaactcgaatgtcaattgatggatgaatgggcaaacaacatgtggtttattcatacaatggaatattattctgacataagaaggtgccaacttctgacacatgccacaacatggattaaccttgaaagtatcatgctgagtgaaataagcctgatacaaaaggtcaaataatatgtgattccacctatatgaagtaccaagaatagccaaattcataaagacaggaagtagactgatgttggctatgggctgcaagaatggaaagatggagaattactgtttaattggtacagagctgctattcgaaataatgcaaaagttctggaaatgataatgacggttgcacagcatcatcagtgtatataatgccacttacttctatacttaaaaacggctaaggtggtaaattttatgtatgctttaatgcaataaaaacagatctatttttcaaaagtattttgtccaagaggtacactagaaggtgaggagacaagtcaatttagtccaaatatgtgtatttccttttcctgtgccagaagggggtcactaaggtgttaggaacaaaatgcaaaaaaataaggaagcaagaaatattctaattcccctgacacaaccgtaattggtagcaggatgaaaatctcaaaatgtctgcaccttgagaatattagagaggccttgaagaagcatgaaaccacccggcaaatacttacacatagactgatttagagtggaaaaatggtcatattgcatccactaccacaatgcctagcaaaagagcccaatggagaaaatcaaaagggagaatatagcactgcgataggggttgggtccacggaaagcctctgcaaatctacatcagtggttctcattcataggcaattctgtcccctaggaggcatttggcaatccctagagacattattggttgttacagctgggtggtggagttctgcaggcgtctagcagaggcttgcgatgctgctcaatagcctgtaatgcaaaggacagcccacaacaacagttatccagtccataatgccaatagtgctgaaatggagagctgtcagctacatgaaagctgagccttctatgtagttggtcaatcagttaagatggaatgacaggtacactcatgagcgagctgtacagtcagcaaacttggagatgaatttgcttacaaagaatatgcttctgcagaattccctgacttaagtaagctcgaggataaacagactctcccttggctcaattccctataaaaggaagtgaaaaaatgcatcaagtgcctagtcggcttttacagagcaaagcaagaaaacctgtcctttccacatctcctgaagagcagagaatggtttggtccttgctgttgctaccattctgctcactcagttcaggcatgaagaggtggccccagcatgtgctagtgcaagaactggcaggaaaatggaagttaatgcctggagggaaacttccacaaattcaaacagtcaggtgcagaggacaaacttattacctactgataagacataactctgtaatctcaatttatggaaaactaacctttggtggagacacaggggtaaggtttctgcaacagaatgaaggtttgtgtcccccaaaaattcaaatgttgaaatcctaattcccagtgtaatggtatttggagacaggggtctttggcaggtaattaggtttaggtaaggtcatgagggtagagcttccatgaatgggatttgccctcttgcaagaagaggccagagagttatctaggtctttccaccatataagaatataaccagaagtcagctaacccctgctcagaaggggggccctcattctcagactaccagccctcagaactatgtgaagtaaatttctgccatttgtaaatttccaagtctatggtaacttgttctagcaggcacaaactgacttaagacagcgttcctctaagccatctctcatgtttacatggcttagtctgtagatgataccacatagagacagagaagtctgttaatttccctatgccatagtttcctcatctgtaaaacaaggataaaaacagtccctgtctaacaggattattagggggattcagggagttaatattcgtaaaggacttggaataataaaaaagtgctacatatgtatttataaaataaagactgtaaagagctatcatattagaggcagcctatctgattagcatcatttctttaagaacgatcagacttaaaagaatttgtattttaaagaagaaaagataataaaatctttaggaatttaactgagagtttaccaagatttcatcagtataccaaagaaagactttctggcaccctctagagattttatttttgtctctaaataatcttcataatgttgttcatattttagtattttcaaatgaaacaactcttcacaacttattgtgagacttgagattggacaagcccgagacacaattatactagtaagagttttcactgtcaaatttcttattctaatattgggaagcagaaatgattacatagttttagggggaggcgtaaagatgtaggatatttcctacagaaaaatctattcattcttttttattattatcacaagttctgggacacatgtgcagaatacacgtgccatggtggtttgctgcatccatcaacctgtcatctacattaggtatttctcctaatgctatccctcccctagccccccacccctcaacatgccctggtgtgtgatgttcccctccctgtgtccatgtgttctcatggttcaactcccacttatgagtgagaacatggggtgtttggttttctgttcctgtgttagttttctgagaatgatggtttacggcttcatccgtgtccctgcaaaggacatgaattcatccttttttatggctgtatagtattccatggtgtatacgtgccacattttatttatccagtctatcactgatgggcatttgggttggttccaagtctttgttattgtgaatagcgctgcaataaacacatgtgtgcatgtgtctttatagtagtatgatttacaatcctttgaatagatacccagtaatgggatggctgcatcaaatggtatttctgcttctagatccttgaggaatcgccatactgtcttccacaatggttgaactaattgacactcctattaacagtgtaaaagcattcctatttctccacatcctctccagcatctgttgtttcctgactttttaatgattgccattttaactggcatgagatggtatgtcattatggttttgatttgcatttctcaaatgaccagtgatgatgagctttttttcatgtttgttggctgcataaatgtcttcttttgagaagtgtctgttcatatcctttgtccactttttgatggggttgttttttttcttgtaaatttgtttaagttccttgcagattctggatagttgttgggaaaactggctagccatatgcagaaaactgaaactggaccccttccttataccttatacaaaaattaagacagattaaagacttcaacataaatactaaaaccataaaaaccctagaagaaaacctaggcaataccattcaggacataggcattgacaaagacttcatgactaaaacaccaaaagcaatgccaacaaaagccaaaatcgacaaatgggatctaattaaactaaagagcttctgcgcagcaaaagaaactattgtcagagcgaacaggcaacctacagaatgggagaaaatttttgcaatctatccaacaaagggctattccttctaaaatctgtagaaaactaacatttgttggagacacagggattcaatagtgttatgcttatctgtccaaaacccgtatatagtaacaaaaaaagcaaaaggtagttccaagatgtttacagtgtttatggcagagcacatttatgcacaagaatttaaaatttaatataatgatatgactcaaaatgactcaaattgatactaaaagatgaaacagttatcccaaaacatagctgcattttgcacatcaaataaggcagcatgcagaggttaaagtacagcagatctgctcccaaacctagttagtggatatacagagacacattctggcagggctgaggttacttgccaccagcccctttatatttatctttcaaggtgaactggatcacaaagagattttattgaccgtctgtgagtttaccactttatcataatgttaaaatcaataaaaacatgttgtgtataagtcacctctccgttctgaaccaattaagaaatatcagatggaattataaagatagcatccactttactgctagtggagctgaattatcaccttgggctagataccaaagcagctaccctgctacttcactttctgcgtgggaatttcccaactggacaaggggctggaatggagtccacccctttgacacctgcccaaggtggaggcgacaaggaggaaatgtgcagcttcacagtagccttgcatcatgcactgaccttcaacacatccattccatcccaaagcgggaccagctggtgacacaagcccccactggtgacaaggaagtaaaagtaatacagagggagcctagaaaaggcaatctaatattactacctgcaggggaatggcagtgatggggaaatcaagtgccctcacaacacagacatccaagccctactattcagcagtgaatgaaatggtaggcatatttacagccttagtttgagagcaaagaaaaacaaacagaaacgctggaattgattaaacatgcattgaagtcccatcctagttttaagttaaaatagcaacttttaatgataaaattctctcactcttatgacctctttgtgagaaaaaattgtgagaaattttaaataacctctgcactgcaaaaaaccacagcagtaatatcaaatatcattgaactagtaaacataagatagcagtctgaggggaatatgtgccagaatccccaaaaccgcagaaagtaccaaatcctctatatacactaggttttttcctacacacacatacctatgataaagtgaaatttatagttaggcacagtgggagattaacaataactaataatacaataggacaagtatgatataccagcatcgctactcttgtgcactggagccattattaagtaaaataagggtgatgtgaacacaagcactgccatatcccaacaggggaccccatcaccaagacagttcataagtgactacagggttgcagggagcagagacagcatgcattccctggagaaaggggtaatttacatcctaggtgggaaggaatgggacagcgagatttcagcatactactcagaatgtcacctaagttaaaacttatgaattgcttatttgtgtaattttctatttaatagttttagaccacagttgactgtggataactgaaacctgaaaattgaggataagaggggactactgtaatgtttaactcacgaaattgataccacaatcccttacccagatagcctgtactattcccaggtaaacaccatcattaattttcaaaggaaaatataacccagacatcttttaagttacatatgaaagaatggaaatgtaccagtgatgaggtgattctttcaaacaattgtgaaaaaaatacataaataatctaatcacaaattggtttgcccatgtagaaaacaaagaagaattctgacctcatatagtaatcatgactacatcctttcacttaagtggataacttaaaaataattttcctatggaatcacaaaacctctgtcccttcagaagcaaaggtttctaaattgttcaatcattctggtagaaacctttgttgttcagggtttcaaactctaagtacaagctagctgttagacgattatacgtagttcttcaacttcaaaactacctccctcttcctacaacctcaatctttgcttcctaacccctaattcactattgaatttttgtaagaacactgctatttatggttgcttctctgaaaatacataattcaatttgaaatattcataccctgggaaagaaaactgctgcccaaagcattttacacatttgggattaatgaatataatggactgaatctttgtgcttctctcccacaaccaaatccatatgttgaagccctaactcccaatgtaacagtatttaaagccaggggcctttgagagaaaattatattcagatgaggtcgtgagggttgggccctcatgatgggattttaccgtccgtatagcaggggaagagatgtcacaactctgccatgtgagggcacagcaagaaagcaactgtctgcaagccatcaagaacccaaccctgctggcagtctgattttggacttcccggctttcagaactgtggggaataaatactgctgtttataagtcacccagactacggtattttgttatagcagcaccagcaaactaataaagtaatcttgaatagactcaagactatactaggaagattcaataactcatggagtttcccctccataaatcaagaccagaaagtaatcaaggttatcaagaccaaatgttggttcaccagcaagtttgcttttgcttccacacaatctcacaaggaatatccttgataaggaataaaacagatgaaattgtgaagaaagtgtataaattctctaattttgtaacagctatagcatgactaagtaacattactaaatgactcccatttataagatcttcaacctggtgctattcatacaaagaagtggaagacacgatcattccctatccatggtcccttagaatatgggcagaatctgtaatggtatgatttcagatagataggtagaaaaagaggagaggagggaggaggcaggagggaggaggcgggaggcagcagggaggaggtgggaggcaggagagggcaggaaaggcggggagaggggagagtggaaaggggagaggcgagaggggaggagaagagaagagaggagaagagaaaagaaaagagaaaagaacgaaaaaggaaaaaagattttatatataatctttcaacttgggtcaaaggtgacttgggtcaaaacacaattcacagagaagaattccatctaagagtcagcaagtctaacatttaatcatagggttaaaatcaatataatcatattcgcaacaaattgactgtgtatgtatacacatgcacatataattaaaaagcacataaatatttaaacaaaagagaaggattactttgcaagggaaataaagctgggagaaatagtccagtagcctgatctgggtaaaagactgcttttaaaacacaccacattattaaatgctcttaaaagcatttaataatgatgtagattgaaaaggtgttcaaagctagcattgtttaagtttatacattaggcgctttaattggcattgagttataaacaatttctaaatttcgttatctcaatgttaacttttaaaagtaattttaaattattattataaatcaaacatgaaagaaataagccacatttaacatcatgacatttagtccagcaaacttgctgaattcccttgttaattatgacagttaagaccttagagtcccttgaaatttgtaagtaaatattatctgcacatagttttaagcttttcttcttgttcctgcccatgcttcttatgtctattcttattttatagcaatgactgaggttaaagaagtgctgttagcagatattcttttatttttgtgtcagaaatgggattataagccttagatttcagtattatttagcctaagaatgttttaattcctggttcactaagagatactaattaagtctgatattgaaatgtatcgtttttaaatgtgaaatatgcatatttgtaataactgattttcatctttctttcattttactccattgccattattttcctaatttcttgagatgagtacttagttcactaattagcagttattcttttctaataaatttccctctgtgtactaaactagctatattctttgagttttgctatttgctgttttaattggcatccagttataaacagtttctgaaattcattatgatgtctcaaagttaacttttaagagtaaacttcttagaatcatcattataaatcaagcctataagaaataagcatatgtaatttttaaaagaaccatattttgaaatataagcacataatttttaagctgtgttaccaatatttgaatacgcttgaagattaactctgatatttaaagtatctaatattgagaagctttcatttcatattactgcctaattcacagcaagaaaatcaaggtttgcaaaaaaaatttcccaccttcaataatgatagttgtcgacagcaccatcaccatcatcatcatcatcatcatcatattctaccaagaggtatcatttctctttaagacaaaatataagactatcaaaatctgaaggacaaaaagacttttctttcatttgggaagaagtgctatagaacaaagagaggaaaaatacaatttcaaattattaacatcaagtttcattaaactatatataaatccatctaatatataaaaatatttaagtaccaaagagcagcatgcaaaattctgagactttgtatatggcagaaacaaataaatatatcttgtgtataagaaaagaaatgtagaaggcaattatcttctactcaagctttcttcttttgaaagtgtggtacagaatagcttaacaattttgtacacacacacagacacacaaaggaacagaaattgtaaaagcaatcagaaacactcaaaaatgtgattatatcctttctagtttttcattttatatttgaaaaactatagcggtatatattaacaaatgtggtatacaattttatatataaataactccattataaatattacacattttctggctctgatccctaaagaatttcttctacctcttctttactctctctcctcaccaagatgtgttatttcttacaaaagtttgctggcttgtctctgggatgagctcccaagagacaaggtcaggcccaagtaaggtagggttcacaggagcccaagaaacaatagcatttgtaccttcagtttacttcaaatcttcaggatagatcaatacatagagaaaacagatgcaaatgtttggcagtgttctataccccagatctcaaactgaatacaactgcaccagaaacctgttctaaggcttgaacagctgggaaagtgactagatgttatttccggaatcctgagctgaagtttgcagtgtaagatccactgaccgtgaaattcggtgtctacaccttttcaggttattatttgctaagagtccttgctgcttcatgcacgttagcagtcactcactgtggagactcactctagtccagcctcaaaccttcccacaccatatttcctgagacaccaacaaagaaaaagcatccaaagagagaaggaagcatgtggacattggggcaccatcatttgcaaggtggggaagggagatggggcctcatgggagtttcgctgctagcctggatgtctcaaattaataacatttttcatttctgtgtctgcaattgcactggaagcttttacagggttcttcaaggcctcctcgctctttgattgcctctgccagctccagccgccccacatggcagagctgcctgcagtgcagcctgtggttaccatggagacagtaccccacggaagagaaagggtgaggcagatgccaagtggcaccgcagaacatgattgcagcaccacggagccccaagtactcgggacagatgtgtctatgaaaggagaggaaggtggagggatgacagagcagcagagctgtggggcagacaggctacgggagacagagggagatacagttaaaattgtcaagtgtttctggatatgattcactgtttctaccaaaatgaaatataaaaatcagaatttcaagtgtattaaaaaattaaatgtgtgtatatatatatatatacatatacacacacacacaaacatatacatacatacacatatgcctgtgcatgggcatatacaaaatacaagaaaagtttgatttgccttttcttaacatctgggaacagcatttatagaaaggttagtttccatggaaatctcaaaaaccagcaagatggctctggagcatgctaccattttatttgagcacattattgtaataatatttccaatcacaattcacatcctattctgtaccattgataagcttttgacattctttttctcttatacaaaaatctcgtttctattttatgtacaagaattatgaaacaagacttttttactaataaaaactataggttcgcaaagagtagctctcaaaatgaaagtatatatatgctatccaattctcaaagtacacaaattctcaaaagtacacaaaatgctttttctatgatgtgggtagggctgttctccagtatttcatttcttcatcctctgggcatatggaaggactggacttccctctcccttcagagctgggcatggtcacatggcccactcggcctgacgaaatagggacatacgactcaattttccaggttatttccctatctccatggctatggaagattgtgctgagatggaggatccactgtcctgggttctggagtcaccacaactgtcaaactctccattcaactcttgccaatccatgccaaaaatgtaccaacttttactcttgtgggctgctgaaaccgggaattatttgttaaagcaacctaacttaattcatcctgatacacaaccccccttattcaattataaaatattttcatgaagacattatgctcatgtgtaagaggggcccagaaatttataacatattctcttttcagggtctgccaagttaggaaatgattactataaaaggtaatatgtgaaatattccataataaacggaaaacaaaagttctgtaagagttcactttgggcagaggttaagactagaatgattaacacaacaaagtgcatttaagatggtaattttaaagagttaataagtcaagaagaaggccttctatcacaagtcaggtgtgggggtctatgacatggaataaaggctcaactactactacaaccactactactgctactagtactactactactaccactactactactaccaccaccactactactaccactactactgctactagtactactactactaccactactcctactatcagcactactactaccactactactgctactagtactactactactaccactactactatcaccactactactactctaccactactactgctactagtactaccactactaccactactactaccaccactactactaccactactactgctactagtactactactactaccactactactatcaccactactactactctaccactactactgctactagtactaccactactaccactactactaccaccactactactaccactactactgctactagtactactactactaccattactactactaccaccactactactaccactactactgctactaatactactactactaccactactactactaccactaccactactactgctactagtactactaccaccactactactaccactactactgctactagtactactactactaccactactactactactattatcattattattaaagggaatgaattgtagatgcccttgtgcccaagaaactctgcatggataaattaacttgattttttcatttaatttttaattgccacctaagaattatacatatttatggcatacacgtgctatttcaatacatgtatacaatgtgtagtgatcaaattagagtaactggcatgtccatcacttcaaacatttattacttctttgtgttgtgaacattcaaaatcctctcatctagctattattgctaactatagtcaccctactgtgttacagaacactagaacttatccctcatagctaaatgtaatgttgtactcattaaccaacttctcagtatccctccctccccactatccttctcatcctctggtaaccactattctactctctacttccatgagatgaaattttttagctcccacatatgagtaagaacatgcggtgtttgtatttctatgcctggcttatttcatttaacataatgtcctctaggcttttccaccttgctgcaaaacacaagatttcattctttttttatttattcattcatccatcaatagacatttaggctgatatcatatattgtttattgtgaatagtgctgcaataaacatgagaacatagatacctcttgaacatactgatttcctttcctttgtatagatactcaaaagattgctggaccatatggtatttttatctgtagttttttgaagaactgccctactttcataatggctgtactaatttacatttccaccgacagtgtaaaagagtttcattgtctccacattcttgccagcatttgttatattttttctttttgattatatccattttaactgggttgaaacgataactcattgtggtttcaacttgaatttccctgatgattagagctgtagatcattttttcatgtacctgttagatatctctatgtctttttgattatttgcccatttttacttggattattattattatcattataactgctgttgagattcttatatattctggatatttactccttgccagatggatagtttgcaaatattttcttccattctgtatactgtctcttcactctattgattgtttcctttactatacagaagtttcttagtttaatattgatatgatcccatttatgtatttttgcttttatttcctatgcttttgaaatcctatccaaaaaatctttgcccagaccaaaatcatacagcatttcaccaatgttttcttttagtagtttcttagcttcaggtattacagttaagtctttaatcagtttttgagttgattcttctatatgctgagagacagggttctagttttattcttctgcagaataaaggataataaataataagggtctagtttataccgaagaatctctctcaacatatacaaatatatatatatagttttcccagcagcatttattaaaaagcatgtattaaaaagattgtcttttcccccactgtgtgtattcttggaacctttgtcaaaaatcggttaaccagaagtacatggatttattttggtgttctgtttcattggcctatgtgtctgtttttataacagtactatagcttactacagtactggttactatagatttatagtatattttagagtcaggtagtgtgatgcctccagctctgttcttcttgctcaggattgctttggctacttagagtcttttgtggttccataaaaatgatataattgttgtttctatttctgtgaagaatgttattggcattttcagcatgattgaattgaatctatagatttctttagtagtatggacatattaattttaacatattaattattccaatccatgaacatgggatatttttctatttttgtgtcctcttcagtttctttcatcaatattttatagttttaattgctgaactatttcacctgctttgtcaaatgtattcctaagattggggggtttggtagctattgcaaatgggattactttcttcatttctttttctgactgctcactgttgggcatataaaaatgctacgatttttttattggtcattttgtatcttgaaactttactgcatttatcacttattttattatacttcaagttctgggatacatgtgcagaatgtgcaggttagttacataggtatacacgtgacatggtggtttgctgcactcatcaacctgtcacctacattaggtatttctcctaatgctatccctcccctaccgccccacaccctgacaggcctcagcatgtaatgttcctctccttgtgtccacgtgttctccttattcagctctcacctatgaatgagaacatgtggtgtttggttttctgtttctgtgtcagtttgctgagaatgatggtttccagtttcatccatgtccctgcaaaggacatgaactcatcttttttatggctgcatagtattccacggtgtatatgtgccatattttatttatccagtctatcactgatgggcatttgggttggttccaagtctttgctgttgcaaacagtgctgcaataaacatacgtgtgcaagtgtctttatagtagaatgatttacaatccttcggttatatacccagtaatgggattgctggatcaaatggtatttctggttctagatccttgaggaatcgccacactgtcttccacaatggttgaactaatttacactcccaacaacagtgtaaaagcattcctatttctccacatcctctccagcatctgttgtttcctgactttttaatgatcgccatgctaactggcatgagatggtatctcattgtggttttgatttgcttttatctaatgaacagtgatgttgagcttttttcatatgtttgttggccacataaatgtcttcttttgagaagtgtctgttcatatccttcacacactttttgatggggttgtttttttcttgtacatttgtttaagttccctgtagattctggatattagccctttgtcagatgggtagattgcaaaaattttctcccattctgtaggatgcctgttcactctgatgatcgtttcttttgttgtacagaagctctttagtttaattagatcccatttgtcaattttggcttttgttggcattgcttttggtgttttagtcatgaagtctttgcccatgcctatctcctcaatggtattgcctaggttttcttctagggtttttatggttttaggtcctacgtttcagtctttaatccatcttgagttaatttttgtatgaggtacaaggaaggggtccagtttcagtttcctacatatggctggccagttttcccaacaccatttattaaatagggaatcctttcccctttgcttgtttttgtcaggtttgtcgaagatcagatggttgtagatttgtggcgttatttctgaggccactgttctgttccattgctctatatatctgttttggtacctttttggtggtgtctttaaatttttctaaatgtaagatcatgtcatctgccaacagtggataatacgacttcctcctttccaatttggatgcactttatttttttctcttgtctattcactctgggtagaagtatcagtactatcttgaaaaaaagtagaaaaagtgggtatccttctcttactccagatattaaataaagccttttaactttaacccattcactatgatgttagctgtgggtttgtcacatactgcctttattgttttgaggcacgttccttctataactaatttgttgaaagttttttatcatgaagtatgttgagttttatcaaaatgtttttcttcatctattgagataatcatatagtgttttgtccattccgttgatgtgatgtaccataattaatgatttgcatatgttaacccatctttgcattttgggataaatctcacttgatcatggcgtataaaagcacttttggatgtgcttctgaattcagtatgctagtattctgttgaggatttttacatctatgttcatcagagataatggcctgtagttttactttttgttgctgtttccttgtctggttttggtatccaagtaatgctgacttcatagaatgagattggaaaaattccttccccttcaattttttggactagcttaaaaagaattgatatttgttttttaaaagtttgaattcagccatgaagtcatccaatcctgaactcttctgttttgggagactttctattactgatttaatctcattatttgttattggtctgttcacgttttccatgcaaatagaaaccacaaaagagcagaagtagctacatttatatcaaagagaatacactttgagtcaaaaactataaaaaagagactaacaagatccttatataatgatctttgggtccattcagcaagaggatataataactgtaaatatatatgcactcaacaccaaagtgcccacttatataaagcaaatattaatagatctaaaaggagatataggctgcagtataattcaacagtctactttcagcaacggacagacagaaattcaacaaacaaacactggagttaaactaccctctgaaccaaacagacctaactgacatttattgaacatttcatccaacagcttcagaatacacattttttttcatcagcacatggaacattcttcagaacagaccgtatgttaggccacaaagcaggtatcaacaaatttttaaaaataaaatcatatcaagtacattttctgaccacaatggaataaagctagaaatcaataaaagaggaactttgaaaactacaaatatcatggaaattaagcaacacggttctgaacaaccaacgggtcgatacagattttaagaagaaaattttaaaatttattgaaacaaataaaaatggaaacacaacacaacataccaaaacctatggaatacaaaaaagcagtacagagaggaagtttacagcaataaatgcctacatcaaaaaagtagaaagatttcaaataacctaaaaatgcacctcaaggaaccagaaaagcaggaataaaccaacccaaaattagtagcagaaaaaaatgtcggagcagaaataaatgaaactgagacaaaaatataaaatatcaatgaaacaaaaagttgagttattttcaaaagataaataaaatgacaaatattttgctagactaaacaagataaaaagagagaagaaccaaatagtactttgtttatctggttatttaataaccaaataaaaccagaaatgaaaaaggagacattacaactgataccacagaaatacaaagggtcattcaagactactatgaataactgtatgccaaaaaaattggaaaacgtaaaagaaataaattcctagatgcatttaatctaccaagattgaaccatgaagaaatcaagttcaatttggttttctgaaaaacaacaaataattgtttagtataagtgtgtcccatgcaatatttggaacatacttagactgaaaaaaaaagtatggtttatataaaattcaaagtaaagtaggcatcttgtatttacatttgctaaatctagcaaccctaactatgtgtactttctaagaattacacgggttgtgtaaaagggctggtgagggggcattaaaagtttatcttcagattatcagtaagatgattcataaaataaagagtaattacacatttttggccttgtaaatggaaagaagatagcattcccactcatttgttaaaataatttccaaacatgatgaaaatgctctttgcttctataaaaagccattctctaaacaaaatacctgagcaattttacaaatttcaagttatgtttcttttgattccaagccactatcaaataagatgttttctatcctactgcttttttttttttttttttttttttttgagacagagtctcgctctgtcacccaggctggagtgcggtggcgcgatctcggctcactgcaagctctgcctcccgggttcactccattcttctgcctcagcctccccggcagctgggactacaggcgcataccgccacgcccagctaattttttgtatttttagaagagatggggtttaaccatgttagccagaatggtcttgatcttctgaccttgtgatccgcccgcctcagcctcccaaagtgctgggattacaggcaggagccaccacatccggcctattctactgctttttaaaaataattttgagtacttattctccttcccctcacctttgccaaaaatccatgacataactgataaaaatattttaggctgatttgctatttaattagaaatcaatttgaataataattctaaaatattaggacatagtctaaccccactaaaatcaaacaaaaacatcgttccctttacagagatctttaaaaactttgagcaagcaaaaaaaaaaacttctagtgttaaaaattaggttgtaaaaaataaataaattttatcttttaggacctaatttctcctattataagcatcttagattagtatggcacatttgttataattaatgaccagtattgatacattattattaactaaagttcatacttaattcagatttatgtaattttccctaaagttcttttactattccagggccccatccaaaatgccacaccacatttagtcctcatgtctccttggactcctcttggttcttagtttctcagactttccttgtttttgatgcctttgacagttctgaggcatactggtcaggcattctgcagaataaatgtcttccacatgattagactgaggttatgggctttggggaagaagccacaaaagtaaagtactattttcaacacattgtatcaagctatatataaagtagatttttttaattgacactttttatgaattgcttactcatatccttggatgctaaattatattttaatgctttcaacctggtattaccagcatattcaatctgaagtaaacatttggacaagacttgagggcttcaattttataaatgaatggcattcttaaattaattctaacctcatttagaataatcatatgacatttcaaagtgcaaaaacaaaatgttgttgaaacttagaaaatggaatattgtaaacattagaacattacatctgtcctttaattaagcctagtgtagcttaaaggccaaagttacaaccttacgactaggctaaaagacccaggaaaggtagaatggttgacgaagataagagtatttccctgtggcagagagtgactgcgtgcaccccattccccagggccaacgtactagcctgtgggctcagggacttaagctaattctttccagccttgccaaccttaatccaatcaatggtttcccccatgacctaagagttggcacatctcccttagtatttgaaaacacaagagaattccaatctcttatttgtcaagccaccaaatgaagaatttcagggggaagaaaggaatacatgttatttttcacttattaatcagctcctccattgaggagagtgaaaataattagaatagttatttttatagatcaaacatggttacctgttagaaatttcacatgatcctcctacctactacttgcaacacagcaatgtcggcctggttgtgtatttttcaagttctcagaatgactctttttttttttttttttagatggaatctcactctgtcacccaggctggagtgaggtggcacaatctcagctcactgcaacctccgcctcccagtcccagttcaagcaattctcctgcctcaatctcctgagtaactgggattacaggcacgtaccaccatgcccagctaatttttctatttttagtagagacagggtttcaccatgttggccaggctggtcctgaactcctgatctcatgatctgtccacctcagcttctcaaagtgctgtgattatagatgtgagtcaccacgcccagcccctagaatgactcttaaatagaaaccttttcacggcatgtaccaaccttggtaaataatcagatgaaggccccttttccttctttctgtaagactcaaagccaaaagctggagtaactagacagcatgcagaatgtcaaccatgcagctgaagatagggagaaggggccagaatgccaccttccactgagctctgagattatctacacccagacacaccacaggtaacacattttcagttacaaaccttcaaatgtctctctaagactaaactgagttaatgattttaagatacaatttagagcagattcaaacactaaagatgcacaactatgtagccaattcaatgctccaagagagaaacaactcattctaaattagtgtttgagtgggtagccacaattaaacaccaaagggcaactaccttaaaatactcgttaggccaaaggaacctccccagtctaatgacacatttgataacttcaagcatttctgtgtgcaggtttatatttcaaagacataattcactaaaggcacagctaatttaaataagcaggggatttcatgatagtggagtccaaacaggaaatattaaagtttataaaagcaatacttcattttatattaatataaattctcagatacagacatttcttatatgagatgaaataaaagtaaacacagaattactaaaatatcactcttgaagtcacaagaattcacttctaacattttattacattgcaacttttaaaactccatatcccaaacacattaaactttcttctttataaaggacatcacaatgttttcaacctttatcactcaaggtcttatgccaaaattagcatctgaatattttatagtcttttaaaatattctacttttcttttagttgacaatattccaagtcatagacagtaccttcaatttaaagataatgaaaaatataaattcactttgagaaaataaatctactttcataattatatatgttgtgtacttccaattttgccattattcatctatactttctcattataatatcttgaaaaagtagcctgaaaattcccatcagaatcaactttttcctgcagttcacagtccactactttttctgagatgctgattactggtccctgaaaacttaaacttggtacagttctatttcttggttctatattggttcatattaaatcatgaaccaaaagtatagtctcatatatttaacatatcctcctgccacaaaaacctgtcacagctgtatttatcatgagataacctgcctttgaaagacaacctgctctctctgaggatgccaggacatccatggcagctgaccagagaggcaaaaagcactatattacacctgtacatggaaaggcaggcagctcttacaaactcatcttcatattgatctctcacatcccttcagatagactatccgtcttctgtcttgtcttctcatttcaacatctatctatgatatgacttgatgaattaaaattttatccttcataaggcagctacttagatgccaggtatgcattaatgcttgtcagttcctatgtgtactatatcagtaaatgatcaattttaaagtcattttaatgatcaaccttcgaggaggttgcagtctaatggaaggagacatggaaacaaacctgtaaaccaacaaataaatgagatgatttctatcactcatatgttatgaaaaagataaaacagggtaactgttaggacagaaacacttgctttcgcaggatgatcagcagagacaggcggccaaagtggctagagcctaataaacccagggacagagaggggagataagataaaatagaaagaaactggaccttttgctggttgtcaccactagggttataagctaaggcaagatgtgggtgaactagaaggagccctaggacggctgtaggaatgatgagctcacagtgggttggccagccaggagcctgctgcagaaaccctggtgagcaatgagacagctggatcagcctcttaacactgaaggtgacaagaagtgggaggttcaaccaagatgaaaagcatccatgcaattttgaaaaatacacttaaaaaggaactctggaatgccatatgttaataaatacagacatgtgggtctaggtactctatataccatattgttctatgtatcacattctgaattttataaatcaaagcaaaacatttaaactgagctgaataatcacttattaataaaatagctcaaagagcttcatattatccatcaggaattatcattcatttagggagtaattcaataccaaagttccaaaatctgccaccagagattggccttccttgacactgggtaacttgctggtttcatcctgtggtctctgttatagattgaatgtttgcgtcttctcctcacccaccaacaaagtaatatgatgaagtcctagcccccgatgtgatggcatttggaaatgggacccccggaaggtaattagtgttagattaggtgatggggatggggccctcaagaagggatcagcagctttctaagaagacagatgagagatctacaaaaggccatgtgaggaaagagcaggaaggcggccatctgcaagtcaggaggagagccctcacctggaatcaaatctgccagcatcttcattttagacattccagcctctaaaactgtgagaaataaacgttgtttaagccacacaatttagggcagcctgagccaactatgacagtcttggaaaaaatttggtggaatccttccaaagccaggatgcactatcacttgacattggacaagtttttctgaacttctgagatgacagggaatatagtatgttattaaatttggaaatatttatgcccttaggaaatatttatgcccttcagtgtggtactcaattatccactcagtgctacagcacagtctgtgaatctgttgtcaaaacgtcctaccatcttctcttggtgattcatgaacagcttcacaaattcttctgacatcataatattctctataacatcacacatctgcacatcacaaaacctgacaccttacattgtgtctatatttttaagcccagaatgcacatgcagcttagcttgtcgatgatggtgaacttttccacatgcagcttagcttgttgatgatggtgaacttttccacatgccaatgatttcatgcaaagagtacatatagcaccagtgctgatactgggatgaatagcctaccttatttgtcttctcgatgccttctaatcaatgtacgaacagtcctacatttctccaaatgaccataaatatctatcttcaaagctatgctgacagtaaacatgaaagtaacaatgctctactaatatgaaaaccattcagcagacaaactgaaattacttctgtagtagaactaactatttaacataagtcctgggtacacatattgaaaattaataagctatagcaaagaagaaatattttccctcataatccacaaagcaatttgctctaaagaataaaaagaaaaaggaaaggcaatggacagttgtgtaagcatcaaagatcttgagagaaactgccaaaaaaaagacaaaatctcttcggagttagacagcaccttctttgggccagagctaaaaaaaaaaacctcacatagccaccaaatcccagcccaccacatctcaattagctaaaatgataaataactgtaaggaacagcatgtatatttaaaatcagatgaatatcacctaaggatattccaagaatcagtgaacacgacgaaatctactactggtccaaaaatctgttacattgctttcaaaattcttatcctccctttcaagagataaaatatgagaaagcacttgtaaagactaacatgctataaaattctacggaataactttgcttatatttcctcccacactctgttcaacttaagacagcactttacccagccctgtcaccagctctcccacttgcggctctgcaccgcctgccattctgtaggtctaactgcactactgtaaaatgcatgatttatcaggccacaaggaagccatataaactcatattattactctgtaaacatacagtatttatgtttactactgaaagatcttaaatcctagtagcaattaatgcattttaagagaatcggcacatggagaaagggaaggatttcagagatgtgatggaattaaggctgcacagccatctcagttggaaatccatgtttgaaaaggatagaaatagctacccttcaactagaaaaataaatgactaaaccattcagagggggacagattatctagcgctggaggtatatacatccagagcttgctgctaactactagttataacttcttgcctcatttaaaattaaatttgtccagtttgttgaatgaatgcataaatcaataaacagtggactcgcccattataatagttctgtttctaaaactagtttaagctaccttgcacctttccacttcttgaaattcctgcatttaccaggtattaccaaactcccagctcctagctcatgaaaacatcctcagcttccacatccatcgcctatatttgcaaaggaagaaggatgctttctgaacgttaatttcctccagccatcatcttggctctatcctctcacactccgcttctgtcctaggtccacaggctaagtacaagctaagtacaccccatggatcccctcaactgctgcaacaggaaatatggtgtcactatacaatttatcacacaacccatgctaaactgctgaaagaagacttttgatttataagatcatatctgaaattgctataggcagtcagcaaaacgaagattagcatcccctctcaagtacctaaaactttgtaactcactaagtaacatactcattgaggaatgtttaacttgacttctttacttccttcaaaagttttgggaatcgagaataaattagatttctgtaacttacacatgatttcttcctattggcagactacagttagagcgataagaattctgtgcaatttgttcaaagtatttaaggaaatatctcaaaaaatggaagccaactatggttcacacttctaaaactgttctgataaagcctcacaggtgccagacgcggcagcccaccaagagagaaaataatattctggagacatttctacagacttcactcttgaaggacaatagggcttcattccactcccatctttaagcagcaaatatctgcaccacaaggaaaaaatacaagaaactttttgggccaattttgtataacttacaatatttgaagtggtatgaagaaacaacaagaattacttctacggatggataaaggagaattcttcctttaggcaatagccaatagcatgaaatgtagcaatatctttacaaccactatggaagtgggcattttataaacacattagtaacaaaattcagagatttagttttataggcaagaaaatcttttgactctaactcttaccccccaccattactgtatttttgaagtgcatcaaaagttccagagaatatattttatacttaaatgtttattatgattaagcttcccaaagcattttcacctaaattatcacagcacattcaacaaagccctgtgagtttttatcccaaggaacaaatgacaaaataggcaaagatgcaaagtcacaagagaaggcaagtgccaagcacgatttagatcccagaacttggcatcctaaggcagtggtccctccagggtgctgcagtgtctgtacccaaaaccaacccaaagcaagcaaagaaaccttggttcagaaaccatttttgccccaaatgatgaactaagtgtttgttacatgcctactactatcctatgatttgtggatcaattattttaaaagatagattaccagtatggggtggggctggggagaagcatggtcctatgtgaccagagagaaggagtgtgtgcctgagagcagggggagaaggtagaaaatcatgtgtttgcctaaaaacagtgtcctggctcttcccaacgaacttgaacttgagaaatgagacatccctgaagaacacacagtcaagtgccagaaccacacacaaagcactgcacctgtgagccccggactgccacaaacaccttgccttttcacacagtgatcctggagtctgtgcaggtgcgtttatgcttcatgtgggaaaagcaaacgccagaattacagaaaagcatctggcatctgtattatttcgcagtagaaacagctaatgtgtgttgtaatagtgaatataccacatactctgctatgtattttaagtccatggtctcttaattcaccgtcgcaacaacctgaagacacaggaattattgtttcccctgtgttatgacacttagtagtaaaataaccgttcacttagaaaatgatgaagttgggatatgaactcagtcagttggggtacaactttgaagctattttctcaaccatttgctccactgctgtatttactactgggacacacgaaatcagcaagcagtaaaatgtttccttaaagaagaactcctgtaggacaagtgagtaagtttaacttcaagctttagaattatgctcccaaaataggaaccaataaaatgatatataaactgttaagacatgacagagtgacataattactatagacaaacaatataaatcaattttaaaaaaggaaaatagataaattgagaaatgtgtataagatataaaaagataattcacaaaaaaattagacgtagacaccaacaaattagaaaatatttaacctcaggaatattaatagagaagcaaatgaattagagaaaaacacaatatttctcctatgtaattagaagttttatttttctcattacaacacccagtgttgttgaaatcatgggaaaatttgtacactcctgccttgctgagagaaatataaattatataatcttcctggaagacaaatgaacaacatatatcaacaaccttgaaaacatccagttctaggaagtaatctagagtaaataacctgatgacaactatttagttattaggatcttaattacagcattaaatataactaccaaaaatgaaaatgtcatcaatctccaataacagagtgatgtaagtaaataatgttatataaaggtatggaaaacagacactaaaaataaatactaattacatgagatgttaataggtaactaaacagaatatgagcaatgttttctaaatttaaaaatgtgtatcgcttgatatctctgctaaaaatatggtcatttctggggcttgcaaccatgcatgaattttaacttcttttaatcatttctgtatttttgaattttcaatgagcatgcactacttttgaaaacaaacaaatctcaaatttaaaggcgagaaaatgtaagtatggctgatcaaaatctgtgtaatctacattccatgatgaatgacctttgttaactttaagtcatgcattcagctaattaatgaacttcaccccaaaataaatatatactattcttttcaagaatggaaaggcatgcttttcttctgcataatgtaatatatatattaaactatgatatatttagtggaaaagtaatatataaagaacaaaactcttgaaaccctgacataaacactgtgttctcagtgttctcacatttgggagtgggtatgtgtgctgggtatcacattcaatatagttatttgccttgattatcttcttagctttagtattatgaatagttctcatataattagctactctgaaactataattcataattgcatatttctttggctagaggtgccataatatatctatgcacctgctatgaatttaacattactctttttcaacctgagttaagcaacacaaataatctgatccagatgctacaagccccagccttcctgcatcaaccttccatgtcctgggttaatgagacaatttgtactatctctgagactttttatataacacctgtctgtctttctggaggattcttcttccttatttggtttccccatgaccccaagaacaatgctccacaccagtgaagactgtgttagagatgagagattgaactgtggctcttttacatttggagctaccaaagaggttgctctttctggaaattacattattgtatactgttgaaggtaatgactgctatattagtctaatatttgaaagtccaaataaaatatgtgacagaggataaaatttgttttaaaaagtgagcatttttagattgagtagtcatgcttagacttaaatacaacatcgtatctatttagaaaagcaatgtttatcttctttctttactgtgtccatgatttctcctattaattgcaaaacatcaaacagccaccaaaatctaattatttatactgaggcagaaaaagctgtggaaaatagctagcctagatcacttatatatggtttgggaagtcagattttaacatcatcttttttatgtctaattctcaccacttacaaagcgatccaattattggcagttaaagaataacatgaaaaataggggaagaacgccaagggtaagttattttaaagttggctatacataaatctgctgaatttcatggaccatagttgctacaaatcaaccagggcattagacgctaccttgataactcttgatgtagtgtcaaaataccatgaaatatttaaagagctcaactaccaagcaaagtactgtgaaagctactatatccagaattctatcaactagaattcttcataaaccatgccaatggggaacacttcttctctattctgatatttcctttcaggcaaagggaacttaattaatgtaacactgctggcctctctccagcttttcactttctctgcctctgaagaataaagaagcagcttgccttgctgcttctctcttcctctggagatcatcctccctgcagagagcaaggcttggctctgccagctcagaaaaagctctgtccctgtggggagggaggagggaaagaaggcagaggacctgggatgtaattcaactgccacaccaagctatgtctaatcaaaactgatatttttgcccatggcagccaattatttatctttttcccttccaatatcccaacatgctgagatggggagtggggaggaggagagcttgatatttatttgattccttaaagacaccaacaacccacattcctgcacattttgtaattcttaaagtaactatatacctttctgtggtttatgtaattgcatatttaaatgcaaagagataatacaataaagcatttgtacattataaggaggtttctaaaccaaaagaaagaactgcataaaacatgcacaaaatgcagttttcttaaaatttctaatgacagttgtgataatcacatctgttaaaccaaaaatgttactaatacacttctctggcctttacctaggcaagagaagtgtattttctaatatcaatgatccaattaattgttcccccatcatctagtgttataaagtaaacatcctatttagtaacatttctgtatcattcaaaacttgtagaaatgttacatatatttatttaaccaaatataattggctcacctgcttactttgatccaaaaaaacaaaaaaacccagtaaggccttttatcataacatgtattttgctctggtaacttataattggcagttcccacaacaacacataaatttgaatacaaataaccacatttattgtaaaaatgtttttctgactgaagataaatttgtcccccattatacagctcacattctgaaacaaattccaagatacatcgaatcgtaattatcctaaaaattatgttgctgaagatcacagttctaaatgaagcccctctgggtttgatcatcccaaggagctggacatcttccaacctggaagagctgggcacttttttgtcttcactgaagctcttaagagtgaaacaaagcaaaaatgaccatctattttcaaagaggtaccaattcacacactttttagttctcttcaaggacttgattttaattggggagggggtcttccctttatgtaatacatttagctgtttaaggtttcttttttctctatcataatgacatgatgatgagattcatgctcggtggttctaaacagagcggatgtgtaatatctgacctcacagagagtgatgcttattaaactgtctatgatagtctttgtacaacattaatctttgtagaaaatttgatcttaatcaggtgactaatataacactaataaagaatatcaaagttttgtaatttctactgggttagaatcttttataataatggtgttgggagatataatttacttctcctttagcttaactgctatatactttaatatataaagggctggtatgtttcagaatagaaagtttagcatattttataagcaaatctgcataatgaagcaatattacaataggggttggggtagggaaattacagccatttaatatcctttgttagagaggatggtaacctagataacctatttaattagatatgtataaaacattagtacctgtcttaatatgtatatattgatttcttgtgttcacataaattttgtaatttacaagccacttatccatgctcttactcactttatcctcaaagaaatcttttaagatattgtgtcttattctacccattttacagctgaagaaactgagttaacaactgaggatcacataaatggtgagggatacacagctaagaagagacagggctggaatccaccaaaagccagtgctctctccacatctctgtacccaccagaagcagaatgcaaaacagcattacactagggaaacttatttttccaataattgtcatttcagatcacaaacatatttctagagaaatagttgggctctgacatataacgtgtttgtgtgtgtgtgtatgtgtaactttattacaaaatattgtaatatataatatataagaacccaataaaatgtttcaatatatgtaattcattttgcacgtaatgtgccaagagagacaggtgaatatttatctaagatagaaaggttctaggaagcattgtttcacttatttagtcattatttccaatttgtcaaaaactaattgatacaggtacttcaatatcctgacatagctaagacacttcctacaaatcaattaaccatgattcagagcttggaattgcacttaactgctatgtgatcaaaagataaacaactggaggtgtcataactgcagatttttgttatgagtcttaatatttaatggactaaaaagcacagtatgataaaatatttctgtgagttccctgtgttggaggtactgtttgtgactataactgagtttattaaacccaaccaggcagtttgttaatcagtaggctggattggcagacaatgtgatagaaactatttattgatgacatgtttaatattttatattaatataaaaagctgttgctttggcatataatcagataacttgaagctagcaacaagtatcatgaactgttcctactcaaattaacttttcacacaccagaaggctatcaaagtactgtggacaggagaacaccttcagaagatgaatgaggaaaaccatcatggaagccaacaatgaatttggcttggcagtgtatttccaacttgcaaatcagccagcaaagaaccacaccttcagctgaagtactggacttgaaaatgactagcagtccatgcttagtttttgttcattgtctgaattatgacatccaagtttaagtactcccaactatgttaagtcttttaaaaataaaaactctgttaggaaaagtgagactagcatcaaggatttccctctaagaagtgaaaataatgttcgcacagagaaaaaacaaaaatgggtgttcccattttctgtggctaatcataaagaagaaaacattggaagttcaaaatgtaacagtttctattttaattcaattggcttgttacagctgtatacactggtccatacatagtgtactgaccctatggacaaattacaataaattatttcaaatgtaatgttaatgttttcttaaagacaacctgatgaaattactctgaaaaccccttcgacaagtccacacaaattcataccacacaagaaagaagtctgataaggcaaaacagaaaagagcaagttctgtaacattttctgcaaatacactgcatattcaactaaatgccaaagtaatattatatttgagattataacttcatttttaattttagaaactattatgaaagcaatattatccttagaaattatttaacaaaactataaattgcatttgcaaactagtatttgaatttcatttttgtctctgatgaacaatttcactgggagaaagaattggcttatattctattgtgaaagatgtaaagtggatagaaatactgtaatttgacagtgtatgacttttattacgaacaatgaaaacattagtgacatctataatgactgggttatacaactacacaaacgtacaccaaattaaataactcctttccgcaagactatgacaattttattagggcaacaacctcacgtacttaccacaattgccattcaatcagataatatcattttcaatccacaatataacataaaacccacatatacagtatatgtagtttttcacatgcccatcggccgctctgggtacacacacaggcacagagcagtatcaactagtcctttaaaaatcatgtttaagaatgaaacactaggctcaaaaggaaaaaagaaaaggaaacgagacatgtatgctacttcatctattgcttttgaaagaaattttatattaaaacaatgcagtgggcataacggtgtgttcaaagtgctctcggaaagttccctgaatgtgaataaggtgaaactaaagcaatattgctaaagactaatcacagtattcaatcaacttgagccgtatagaccttgccagtcctcctgcaacactgacttgtgattagtgtaatcaaaggcctcccaaatttcaacacttaactccgaatgtaatcgtcttccttcaagccctgagcccttggaacccacagatcagtaatgatgccacttaacatttttccccaacaacagtaggaacattctccgtatggcaaccatatgctaataaaagacatttgagggcagtttaaagcatctagttcgtatttgaggatactcgcccctatatatcacacgtctcgtagcagaaatccccaaaataatgacaggttcaccgccataacttgatatgagtcacagcaaacacttctccatgggattttagaagtggtgcagccccgaagccttgtcattatgtaggtgaatgaccagcagcagagaccagctggactgccctcggtagcttcagcccctgatgaagtatgcacaatgagataactcctagggagtttcagcacctccttgttttcatggaagtcactgcagaaaatcccaagactcttaaatattggtcacatagttcttaaaagtgaaaatttacacctgtcaggcctaatactatgctgacaacattctctgttttctaaatcaacatatttgcttgagcacagtaaaaatacatcttaataacacctgccagagctaaggcgaatcagatcagctcaaatgaggcacacaagaaaagaaaagaaaaaaaaacaccttggaaacacaacctgcccctctatctctcatctcccacacccttcatacccccacggttacagcaaaatacaactttgggcattttggaagtaactgttatttgtgacacacacacacacaccccaaaaattcccaagtctgttttcctaccacaaacaccagggaggctgcatcacctttctagtgacttaattctgaaagcagaggctcaacctgccgagtggcaatcgaagaaaacacactacacaccagaataagatgagggtcgggaaaaaaagaaaaaagcagcttcgctttcagccattaattacggatcaccccaattttgcatcgctcatctcccatacacacgcacagccttccaaacctggctttcaggcggcgctttctggagcctggctgtctattgtcagcacgcagaagcccccgaaacctgtgaagccggctgcaaaggcttgctgggaagccgctaaatatagaccaagggggctcagggtctggcaagccgcgggagcctgaagacacggccatggacgcatatgactaagtctttccattttgttctagccaaacatcgtaatgacattgaacataagggcaaaagactggagggaagtcctccccacccccaccccgtctcctcccgtatattagggacgtcatgaatgcaccgagtatgttctcagggtggcggggagcagcattgtcggtgttgccctaaatacgcttcctcccggggagatgggtggcagggagggggagcacgcagggcagccacttggtaaccgctccaagaaaggcactaaccccggacccccttccaggcacagcggcttccgagggggacctggcgcgatcgcggtcctccccgaggcaggcagaaaccccgcagcagccgccgccgccgcctgccggccgggagcccaggaccacccccaccagcggcaagaggaggaggacggcgccgggaggaggctgcgcccggccccggccgcccagccccgcaactcacccaaaggcgcggcgcccggcggcttcctcgcaaacatgcaccctccgccggcgacagctcctcagtccgggaagaggcgtgcgcggcgccgcccggcttcagggcaaggtcctgaccttgcccaactgcagcatcttccgcttttgttgtctgagcgcggccgcgggacaagggatgctggcgggcggcaggggcgagcgccgcgggcgagaggcggctcccgacgcgagtgcgcagcgcccggcccggcggcccctccgagctcggcgagcgcagcgccccctgcccggctccgcgggctccacgggctcctgcgggctcctcggggctccgggcgccgccgccagccggccgggctgagagagcagccgccgcgcccgcagctccgctcagccggctgtcgccgcgggcgcgagcctggggccgccgcggcgcccggcgccgagcgctcccgagctgcgccccgcgcgcggcccgcgccacctgtgccgccgccgcctcagccgccgagggcgaggctcctcccgcggcgcgcggcagcctcagcctccacctaaacctcggcggccggcccgggcgcccggctagtgagggagcgtccgccccgccgccgaaaccggccccgggtgcggagcatgcccagtgccgccgcgagagcggcgcttcgccgcgcgcgttccacttctcctggttttcgcggcagcagcggcagccgcgggagagaggggaggaggccgcgggttgggagagggccgagcatccttgggaacgcacgccctggacctgagatgggtggatgctccggagctaggcgaaagctggaagggacccgggaagggatggaaccccaggttactccgcttccctaattcacgtgcaaggcgctgacagttgactctggtggggcagatgtcagcctgcaacaaaggaccagggtgcgaggggtcctagagtggccaggtgggttgggggagggaggctggcggaacgtgctggtgagcgcaggtagatgctcttgcagatcctgtgattccagagctaaggaggcacgaagtccagcagaggtcttctccacagcacctgcccaatcttgccatcaccttccctgttcagatggcatgtttttggcgggtagtgagggtttctccttaggcaaaatcacttcagatttgaaactggaatgtctgtaaacttcctgcaagaaagacccttgcccagtctggaacttgagcagattaagttctctctcctccccttcttgtgccaccttgtcctcctctcttggtatcttctgctgcatctctgccaccttctcttcctccttttcttccttatttcaaagtgaaccactcccctgatccttccccacagtcttccagtgcatctcgcattgccttcttcacgttcaaatcagttttccatatcacctcctggcttgactgctccttgaccccatcgggacttccccatgcgtagcctgctgtgaaatacagcaagtggaatcaccgtattcaaagtcttgttgaaaaacgaaacccaaaacatgtgccaaggaaggcctctgggccttcgcccctgtccctctgattcagcagcagtcaggacggggctcacgtctgctgcattcacaagccaagccaagcagggcacagcctgcccaggggccaggtcgaatgttcctcctaattatgccacgggcatgaccctgaacaccgcagactgtctgaggttgtgatctcctccaccccccccaccccccccacccccgcagagcttgtttctgaaacacaaataagcatgacagaatgcaggaaattgtaataaaagggatttggtgcttacgattctcagtaacattgtgcttctattttgtgttgaaagagattatccaacaaacttaaatgatttgaatattcaagtctattctttattatacttgggagtaagttgaaatataaatggaagtaagagtgaaggagaaaagcggtacagaggttaaataggtaacaaataattgctaggaggagcagattaagcagactattgacaacagtacaaatgttcgcttttattcctcctaccccaggtgtggacatgcacacacaggctttgtctcacctgcaaaaaacagttctccaagctaactccaagtgtcttaaagccagtttgatattaaaatatcctgagtcctgtgagggaagacatgcaagaccatttttttcatcacacgtttaattgtaatttttatcttagttctcagaaaggcagttcaattacactgagtacgtggtacaagacaaattagcagcaccatatccattaggccacattatatttcaagagatgttcttagttcccacctgagcttctgtcagtctgctatcgtttggttttctctttgcatcttctaactcaagaagtcagtggggaggtggaaagggagatgaggggacatcagttactctttagattaaaatggaggtagatgtgtagatgctatccacaggtaatatatgtgtcttttatgcctgatatagatctaagtaaagaaaataattttctaacgttttttagttactatcgagatgagcaatgacaaattctatcaactaattgtgtgtctgggaaatgagctggaggcagtccctacagatactgttggggctggggctggtgtgatatggttatttaggaagcagagtggtaaagtccaatgtcctggactgctttgatttcatttgctcagtgccccatttcattgaaacatttatgacttttattattctagaataatttgtaacttaagatattattcaattcacaattagataatattgaaaaataaagcaaaatgaacatgtataatgttagatcttggaacgactcactgctgccatcttttgcctcctgcttccgatagttcctatataaaggaatattctgaatcctcaaattcactatgagactagaacattattagtttattattttcaaattacagtactcaatgctcagtgaaaaaccttcattgtatttcttctgtttatgcattaatagagttatctgatacagaaatcacatataaatactaaatgctatatctcttgatttttcaaatcacttttcaaaatttgaagcaaacgtttttatatggaagtgtaacttaactttagaaataaaatctaacaattccaaatattttttataaatgtatgtgtcttattttgtaattcaaagtatgtcgattttaggagaatggcattcttatttaagtcacagctgtttcaatatggcattgtttgttgctattgagattcaaatagaagataatatttttgtaattttttaagtgaattacccattgataaacaattgagaaattttcaaattgggaaatgaaatcaggtgagtgattattgttgctgttcagcatttaaatagggagagtaatgatacttctttcaattcacaatttaaattttaaagcaaattacctgaaatagtaacccaatagtgtcatcataagtacatgtgtgtatatatttgggaggctaacacacactgtttgctcttgatcataaaagttatgatatttgttacctgaaagtatctctaagtttttgaagactgtaaagtagttaactaatttaaactaaccattttagttaagatcaacgtgtgggtcatttcactatttgattgcaaacttcacattttcactcaaattgccttttattattgctgcaactcctatgatggtatcattcattcattcagcaaatgtttattgagcatccatccgctgtggttcagtattggccaaaatttggagaattagtagcaaacaatagagaagacaacaaattccttatcctcccagagtttaattatgaattggggttatgggggaagcagaaattgaagcactgcagagaggtaatcaccaccagaagctgaaatgaggaacacaaatgtcctcatttcttcctaattgtctgtgtgcctcagtgtattggcttcctgttatgggaggaaagttcatctatattggattaagccgtggtggttggattctgttacctgcatcaaattcaagctcaaattgaaatatatgttatctgtaatgtctcccctctgctcactatagctgttattactgtatttcccccacaatgtatttccaaaaattaaaacattttttcaacaaagtgagtaaatgaatatggtctaaatcatatgtattagaagataaattaaggaataatataagaccagttttttattgtcactgaccaataaattcatgttcaaagcattgcacaatgagtccacctcaacgatttttatactgtctcccaaaatgaaatacctcattttcagtctttgttctccttaatgttctctacccactccagtgtcactctcaagtttgtacagaatacacgttctgaaattgatttactcattaaaatgaaatccttgaagctctcattttattacccataaataagccaaatcttgcctcttgctttgttgtgaaaattaaatgaatgaatcagtctatgataagcaaatggctctatgcctggcaaatagggagcaattagtaaatgatggtgaacatgagtcatgacattagaatatctctttcacctctgctgttttcgtcggcttgctatatcaaaacacacttattatctgattgcgcatatcttattcagtcatcaagacacctagaagataccattttgccagtgagctttttcatattcatttctttcaaataatcattaactaaatttctcctacatgcaggtaattatatcatgcagactaatcatgagaatttacagggatctccatttggtaaactggttgtgtttcatgctttcactgaatttttaggaatttgaaaatacatcacattcagattacagagtcaggtagcttacctttttgtcatatttcatcatgtctatatatttatatgctttgtctactccatacaatgtgttgctttagtttatatgttgataaagttatctaacattattttccatattctctgagattgtgtctatgtacatagaatatgtatgtgagcagtttgattttctatttgtgaagtatattatacttctataataagcaaaaatcaatgtttcacaaaatctttacacaaatgtactctaacatgaaatgttcaattatttgaaaaaatcattttcgttatgattctgcaaagattaaacatatattttgttaggaataggaacttaatgaatttttcaaatcattgagcatttcgtgttagagtatgtttgtataaatattttgttaaacatttatttttgcttattagagaagtaacaagttctcatttaaaaaactttaaaaatcagaaagttatgaaaaacataattctaccacccagaaaaagtatagtgtacaaatgcctatcctcttatttacttaaaattacattcctacactttcccattccatttctcaaacttttctaaggttagattattctttatataatgagttttctgttttatacattttgactgttatcacatgacctctcccgtggtaaataaaggttcaatgaaggttgttttctcaaattgtttgaaaagaaaaacaccccaattatatctatttctgagtaggatgaaatagcttatgggacctccatgcctctggtaagaataattagaatttttgaatgaaaaacaaaaatatttatcttatgcatcagaaacctgctgaagcaaaaaggactggaggagccaagattccagacaggcaagaatgtggatgccgagctaatgtggtatgtctgctttttccctgataacttcggccagttctggatacagtgagagaggctgggttttgaggcttttcctgggtagaggccactgtctgagacagagatatcagcagaatctttgttagcctcatagggctttagactgaagcccaagggatcaagatcccagtaagaagaaaggagcagagaactgggacagaaacatagctggcattcccttcaaagcttttgataacttataaagcttcacaggactaaacagctaaacaaaaagcctctgaaaatcagatataattttaacagtcctgctgtgcagagaagaaaagcattcacatccaggaccagccccaccttgggagatatttcaagttatcagttaaaactcctggagtgttgcaccctgagagctagagaaaacagaggtggaataaaatgtaacaatactgtaattgtctccaattcagtgatgttgctgattggaatagaggttaccaggtgatttatctgcctagcagaggaaagggtgaaaccttttaggcaaacctctgcaatttttaaatattcattgtccagcattcagtaaaatctgttcttcagagttaggagcaaatgaccaaaaaacaactaacaaatgtagaattggaaaagacccatgggtgatctatatactagaattagcagacaaaatatctaaaatgataatgaccaatatgtccaacagaatataggactgtagaaaaagatgaaaaagaaaaaacatgaaaaggaaaagacggagaaattcaccaaataattgaaaactgtgagaagaatgaatccactgggaatcctagaacttaaaaatgtggcaaattaatttagtaacaaattttatttgatccatcaaatataaaattgtatcaatccacatgtaacatttgacaaaatcagccatgtgctggattgtaaagcaagtcacaagcatgaaatgattgtattcattcagagaatattctcagagaacagtgtcattaagccagaaatcaataactaaaaaaaaagaaaatcttcctatacataatttaatctgcactacttcaaaataaatctacttgagaaacttgaattattttaacataaatgataaataacatgtgtacaataaaaattgcaagatgcaacaaaaacagtctttatgatatctataaaatatattatattatgtacaaaatatataaaaacaagttgcagacacttgacagcagccaatgtaaggctgctattcttgagctattctggagagacaaagtatttaaaagtcactccacttttgcactgcctttttccctaggtacattttctggggtgtggtacaagcaagatcttgcttccactgaacagagaaggcaaggattaaatctgggtttattaaagtgtctccaatgtggaagagacagtgctggaaaagaaagagtcatagagagggaaatccagaagtttacatagaaatgccccttgaggccgggtgcagtggctcacacctgaaatcccaacactttgggaggaaaagttgggtggatcacctgaggttaagagttcgagaccagcctggccaacatggcaaaaccccgtctctactaaaaatacaaaaattagctgagtgtggtggtgtgcacctgtaatcccagctactagggaggctgaggcaggagaactgcttgaacccaggaggcggaggttgcagtgaggcaaggtcattccactgcactccagcttgggtgacacagtaagacttcatctcaaaaataaataaataaataaataaataaataaataaaataaatcccccttgagccttgagtaacttgaagaaattgtggattcatgagagtagaacaagactccaagaagctagatagagaactgctgggaagcaaagaactgaggaaagatttcgcagcttcttcagtggtatggattttggtggtcaggcccaactaaagtgaagaatgtttagaacaagtcaaagatggagttgagatgtcagacatgccatcagatacaggtgttataaattgaatcatgttcccctcctaattcatatgttgaaaccctaactcccagtgcgcctgtatttggagatggggcctttaaagacataattaaggttaaatgaggtcataaatatgggccctaggccaggtgtggtggctcacacctgtaatcctagcagtttgggaggccaaggtgggtggatcacctgagatcaggagtttgagaccagcctggccaatgtggtgaaaccccatctctactaaaaatataaaaattagcctggcatggtggcgggcgcctgtaatcccaactactcgggaggctgaggcaggagaatcgcttgaaccaggaggtggatgttgcagtgagccaagatcacgccattgcactccagcctgggcgacagagtgagactccatctcaaaaaaaaaaaaaaaaaaaaaaaaaggaaagaaaaagaaaagaaagaaaaagggccgtaatccagtacaacttgtgtccttataagaaaggaagacaccagggatgcctgtgcacagaggaaaggccacatgaagatgcaagaaggtggtcctctgcaagccaaggggagagacctaagagaaacctaccctgccagcatcttgatcttggacttctagcctcaagaacagtgagacaataattctctgctgtttaagcactcactctgtgtcgttttgttatggcaaccctagcaaactaatgaaaagagtaaagataagtgcactttaggattgaggtctacaacctagaaatatgcgggggcggggggcgggaaatgtgatagatctctttgaagagagtgtaaaaccagggcttaacagctcaatttattccattagtactttgttgccaacataaaactcaatactttttgatggataataaatgaaatccagtgccttttcaagatattatcagaaaattgacaaatataattttaaaaaggaagaaaaaataaccaggttgtacaaagaaaaaaaaatctatcacaatgaagttgttgacaaccaaagattgaaaaagtaattcttgaaagcagctagagaaaaaagacacattacacacagaaatacaattgttacatacattggtaactcaaaagaatttatggaggccaggaaacagtgaaacaaaatcttttaaatacaggaaaaaagaatataagtgaaagaaaaaggaattcattgctagccgtcttgttctaacagaaatgtaaaaggaagttcatcaggctgataggaagagagcagaggaaaacttggaactttagaaattaaaaaagagcaacagaaatagcaaatatctgggtcaatataaaagactatgtttccctcttcaagtcagttacatatatataactgttaaatgttaaaattttaacattttccaatgtggcttttgatattcattgaaataacacatttagaaactgtaacaaaatgtcagttggtgatagttggtggtagggtagggtaaagggacttatatggttgcaagggttctgtataataattgaagtggtacattattaactctactaaccaataataaaaataatacaaagacatgtagccagaaaaccaacagacaaattgaaatagaatattaaatatactcgagtaatccataacaaggcagacaagagaacacagaggaagaaatgcagaagggacaaacagaaaaatgaaataaaatggtagacataaattcatttatattaataattatattaaacattaatggcttaactacttcaattaaagggcagatattgacagagtgaatgaaaagcaagatcctaccagaggccaaaaacaaaagcacagttattgaaagtaaaggatagaaaaagatctaccctacaaaactaagccaaagaaagcgagggcgtttatattaacgtcagataaaataaacttcgagacgcagataatgtaattagataaagaggaacatgtcgtaacgataaaagggttaaattatcaagaagaaataacaatttaaaatgcacatcccagagcctcaaaatacatgaagcaaaagttaatagaattaaagggagacccagacaatcatgcattgtaagagattttaacagccttcttgcagtaattcatatagtaaccagacaaaaagtctgattataaacaccatgttctttacctcctgattatacacaccattgtgtgagtccctcttcttgagtttaggctggacctagcaacttacttttactgaatagcattcatatatctgcagaaattataaatatccatagaaaactggattgatattttaaacctgaaattcatttatgaaagactgtagcatctattgcttcaattatttctttctggttcgtctagcttgatcgttctgatgaaacatcctgccatgttgtgagctgctccatggagagacccacatggcaaggaattgagggtggcgtctgaccaacagccagtgagcaactgaggctctcatcaaagagcccatgtggaactgcatcttgccacaccacacacacacacacacacacacacacacacacacacacacacacacgtaaacccggaagtgaatccttccaaaaccaagacatagttgactgcagccctggccagcaacttgactgaaacttgtgagagaccttgaatcagtggtcaagctaagccacactggaatccctgaaccacagaaactgtaaaataacaggtgtttttattttgttttgttttttgagttggaatcttgccttgttatccaggatggagtgcagtggcgcgatatgagctcactgcaaactccacctggcggattcaagcgattctcctacctcagcttcctgagtagctgggattataggcacgcaccaccatgccaggctaatttttgtatttttagtagagacggggtttccctatgttggccaggctggtctcgaactcctggcttctggtgatccacccacctcggcctcccaaagtgctgggattacagtcatgagccaccacacccagccaataataggtgttttaagtaacaaagttcaggtgaaatttgttacaaagcaatagatgataaatacaaaccctatcttgacaaagactacttcagtacttcaattgtaaattaatatttaaattaaaatataaattgtgtttgttgtttagttgattgatttaattttgaaattaaatttaagcactcattccaaaagcagtagaaaatatgaggcatatatatatataaaatataaatatatatatatataacataaattggatccataattcaaaatctttttacaaagaaactcaagacaaagtagttttaatagtaaattatctttcaaatacttaaggaagaaaattattctgatcttatacaaatttaccagaaaagagaaaaaaaaggagagcacttttgcactcatagtatgaggccaccataaacttgacaccaaagtctaacgtggactttacagaaaagcaaaaatatgagttttatctcataaatgtaaatacaaactcctaaaggaaataattaacttccaattgagttaacagatacattttaaaaatacattataaacaagtgaagtttatcttaggaaagtaaagcttttttaaacatctgaatgtcaactgccatattcaccacattaacagaataaaggagaaaaatcacagattcagagaaaagcttttaataacatccaatacccatctaaggtaaagaaagaaaaagcaatttagcaaactaggattagaaggaaacaccactaatctgatggttaactggaaaaaaaacacctgtagattttcctctgagttcttgaaaataagacaaagatgtctactatcaccacttcttttcaacattttactgtacatgctggccagtgaaatgaggcaataaagagaaataaagattataaaaatagaaaacatggagagcaggatgattctcccccaaagatctctacatccgaattgttgtaacataaaaatatgttccttatatggcaaaagggacttttcagatgtgattaaattaaggattttgagatggggggtttatcatggattgtccaggtgggccagtgtgaccacaagggtcactgtaagtggagagggaggcagaagagcgagagcgagaaagaggtggaagttcttatggtgctggctttgaagatgagaggaggaacggacctcagccaacgaatgaaagtggcccccagatgctggaaaggcaaggaaaataaattttccactagagtctccacaaagaagcagcgtcctgccaacatcttggctttagcccagtgcaaaccatctcgtatttctgatcttccaaattgtaagataatgaatatgtgttgtttgaagccactaagttagggagttatgggtaatttatcatagcaataataagaaatagatacagaagagattgtatgtgtacaaaatctaagagtctgctatcaaattcaatatgtgaattctcaagaacactggattcatattcaagacgtgtccattgtatttcgataaactcgcagcaaaatattggaaaacaaaacacaatttttaacgaacaccattcacaaaaaatattaaatacctatattgcatctaacaaggataggcaagatcttaacaatgaaaagtataaaatttgctgagaatgaccaaagaatttctacataaatgtaaagatattcatagttgtgaattagaagactcaaaattgttcagataaaattcttcataaatgtatctatacattcagtgcaacactcataaaaatccatggtgtttttaaacattgatatgttgattctaatatttgtacaggagtgaaacatgcccaggataaccaagtcaatcttggatttgaagaataaatttctaggatacacactactggatgcaaaacttattatataaatctacagtaattaagacaatgtgatatttgcacaaggatagaaaaaagacaaaggagtaagatagagttcagaaattaacatacatggattgtcacttgactcatgccagaaccatcagtgaacagcagtgaacaatcccaacagcaagatgaagactgtatgagtgaaatgcctttcctttgtgaagttggaaaagggggaaattttgagaggggagtagggaaggaaattatgctcttatatcacaatatgttgctgagaaaataaactttacagaaaaaaacatatttgatgttgatcatttgaaaagtgacttctttaaactgaatggtacccttgaaaattcagtgtgtgccaccacggtgatctcacacggggactgctggtttgtaatggagattcaggaacctttgtcagatctcaatcactaagttgattggtgagtaaatggatgttcttattttactctttttaacttatgaatagctgtacttcgatttaattttaaaattatcacgcatgtggttctggaagatttataatacataaatataaacataaactatataaagataaaatatgcaaaatataattatggaaataaataatagtaatgatcgatgtaattaaaatagctttgaaatatcaatattcctctatcaaatttgcaaagtcttcttcacttgtaatattcagtgttggttagaagggagagatgccaatgaaattcacatcatcaccacagttttaggggagagtttgcaatacacgttgagatcctgaagaacttaatctactttatggaaagtgatttttgaaggtctcattatgaagcagagcatgggaaactgaagtaaacctttcattgataactcagaccaataatatagatgttaatgtactgtgacaccatgatagcctcaggtgtcattgcagtgtctcttgacctgtattaaatgaccctagtctttgaacatttagctatcaccaagcaagcatctatctgtacaggccatttgagtgcttctgctttcaggattcccttccctgcatgcacacacatgtgtagtgtgatgggtcccctaccaggttacttaggatgtatacccactgcttgaacccaaaggccaggcattgagacaagaccctgatgcccagcagaggagcaagtgttcctgagaacttaaacatccctggagtatatgagaacctaccaagaaaaccagtctcatcacttaacacagtaggcaaagagccagaaaatcagcttaaaagtactttacagacaagaggcagcatagatctctagcgttgccctgctgttatccaggagcaccctgtatgtaagtcctaataaactttatgtaattgtcaagttggactttcccaagtaattatttggtctctcaacaccttcctcgttgcagaggtagaggggggtgtgggtgttatagccccaagtttctctcttaacaatatgcaacatcaagattcccatctgcttttgtaacagagtccctgctgtagtagagatcaagatacttttctgggacatttctagctttatttttgcaggatgtataaatacaatattttgcaaaacacttgaagacaaaaaagaatgtaaaataagaaagcaggatgattttgcagtgcaatggataggcaggttgtttaatggataagtatcaacctgaaaagaggactcagtaatttgtaagtagcctttcctggctttgtattttaagcctctacatttaaaaggaggcacatgatatcagtttgggaaaagaaagttgaagaattgaaagacagcataaagtctcagaacgtatttcaggagatagcgcagtggtctaaaattaacaagatgaaattcaatggagagaaatgcaaagtccttccttaggttaaaacaatggtataataaatccaggttaggaggctgtggattctgaactgggatccatgtaccagagctgcactggccgcgcccaggccttgggaacgtgggtgttcctggaatcagttgcttcccacttggttcaatctgttcagggaaatttccttcagtgcctacaagagaagattggcctttctaactactgcaagctgctgctaattttattcaaaggcgagtatcggagacaccagcagattccccacctgcctggaaagctgccttcatcttagtatcatggaacgagaagctgaagcaccaattacggtctgctgtgccaataatacctctgacaccacctggaacttcatttggagtcttccttattgtgactcagcactgccatcctcagctgcacagaaaattcaagccctctggtcactttgcttttcattatttgttaccatcttgcagctctgtgttcttctctggaaattttggctgaacataattaaatacccctaaattactttttgaacaaattagttttaattttattcttaaaaattcatgactttgtacaaattattaagagacctctgttcaggttgacatctattcattaaacccaagtttcatagttcttactctttttatatgacttagtgttgtttttcattaagcataaatcactcttatttacctatattgtttattcctcagtatactaaagacatggaaatgaacttaaatttcaactttaataaatgaatttacaataattgttgctctaaatcatgaatagtcaatcacaaccaaattgtgtttatttaattcagttccctttatttaaagctaaaaccttgagcctgggagttcaagatcagcctgggcaacctagtgagaccccatatctacaaaaatatacaaaaaattagctgggcatggtggcatgtgcctgtagtcccagctacccaggaggctgaggtgggagaattgcttgagcctatgaatttgagactgcagtgagccaagatcacaccactacactccagcctggctgacagggtgagaccctgtgtttaaaaaaaaaaaaaaaaaaaagttaaactctattctacctcccaacaaaaattgaacaacaggtaattcataggcctcttacttgaaacttatattacatgtatttcctgataaaattttatcagaactttgtttctctaatttacgagatggttttttcacctagattttagatttcaggtcattcagcttactatgcagaaaactcattcctgcatctgcttttactgtgttcacctctgtatttctagactaggttcttgtctaattcttggtttatccaatgtagctaccaggttagtttctagggctgccacaacaaaacaccacagactgggtggcttaaacaacagaaatgtgtttctcacagttctggaggctagaagtccaagatcaagatgttggcaggtctgattctcttgaggcctcgctccttggtttgcagaggagccttctccacgtgtccttccatggtcttccttctaggcatgtgcatccctggtgtctctgtgcatccaagctgtctttttctagaacaccagtcttattggattagggcccatactcacagctttattttaatataattatctacgtaaaggctttatctccaaacacaatcacattctgaggtaccagtgcttaggattttaacctatgaatttggcaggacacatctcagccccagacagctaccatctattttttgtagtggtatttgagaatttcattctcctttagtcagccaccctgcagttttactccccttgccggcgccggctgattgactgttcattccttcattcacttgctcatcaaatgccttctcaggggcaggccatgctccagggtctgagggtgaggaagtgtcactgcccttgtagcactgacattctggaggaggacaacaacagtaaacacagaaaccgacttttccgtattgtggtgtcagattgtaagtggtaaggtctctgaggaaaaataaagaaggaaatggggctagagatgtaagagtgctatttttgatggattgttcaggagacacttctctaagtagatgtcatttgaatagcgactggaataaagtgagagagaacactttatgaatatcttggagatgtgtctttgaggcagagggcacagcaactgcaaaagcctggagtaagattattcttagcaaatttaaagaatggaaaaaggaaagccaatgtgacagtcaagggatggataatgtagagcatttgagttacagaaaggtctctttgtattataagtcgcggggaagacttcggagagttttgaccaggggcaagttgtgacctaacttacccaacttagagcctcaatggagagttctggatgccgtgtggaggacaggtcacaagtcacagaaaggcaagaatggcagtgtgctgctaccctgtcagaccaggacaaagatcatagcaacacaggtgaaattgttacctgatatggttttgctgtgtccccacccaaatctcatcttgaattgcagctcccatgattcccacgtgttgtgggagggagctagtgggagataattgaatcatgggagtagtttcccccatactgttctcgtggtagtgaataagtctcacaagatctgatgatttcataaggggtctcccctttggcttggctctcattctctcttccccaccatcatgtaagatgtgcctttcaccttctgccatgatggtgaggcctccccagccacgtggaactttgagtccatgaagcctctttttctttatgatatacccagtcttggatttgtctttatcagcagcgtgcaaaggactaatacgctggtggtggagggaggagaagcaagaagtgtgaagtccaggaatctctagtaaaagcaaactgagtttgatggactcctctcacctgtgctaggaatgcaagccagcagagtgactttgttagtcctcatctttgtggtgtagccgaagattgagctcaaaactcttcctcctgccaggcaacagtataaactaaactggataaatgtgggcaaaagtgaaggaggtggcacaggagccagacctccctccctcaaggttgagtaaaatgatgctatttcagcaccttacaatgttgccaattgtccacagctggaggtaatatgagatgacatttctgctgggaaaaaaattctccatgaatctttacacatttccgcacagtcagagcatgttatattctgagcaaaagtgactctcaacctgggttaaagaatggtttaatggtaggcatgcctggcaagttagaaactccacgttgctccagggacagttgcttactttgtagcataacaaactcctttcttgactcccctggaaccgctggtttatattccagattagagaccttctcctcctctccttagagatgatttcttcgtattccagagacatattttatctctgtctctgtctccatttatctgtctctctgaaaaagaagagggacagatatgacagccacactaaatatgatctgagtttcataacactgaggctctcctcttctgcgtgtgcagggaagatcaggcaatcattgccttgcccctggagaaattaaggaatagggaccagcactaagatctctctgttttctgacccagagagcttgtatttcctatcaggatgaataaatagacattaaaatgtgacaaattccactgtgattcatccgaattaaaatgtccctgaattatcaaactttgaaacttgatacatccaatttaatgaatctggatagaaagtcatgaatggtcatggagggtgcaaaatcttcagaatacattattcgtacttacacaggccatatgtttggtatgagtgagatcatgagtaaaatatgttgggacacatcctgcaaactggaaagtgaagctgtgtagaattccatcaacataatgactatgtagacaagttcatgtactatgcaaaacattcgggagatactggtctttggtgtatgttatgggctgaagttggtctcattccttcccatccaatttcatatgttggagtcctaaccctcagttcctcagaatgtgactgtatctgaagataagaaagtggcaattaaagttagaacaaggtaatgaaggtgggaaactactaataggagtgatcatatggtttgactctgtgtccccactcaattctcatctccaattgtaatccctacatgttgagggaagacctggatgggaggtgattggatcatgggggcggtttcccccatgctgttcttgtgatagtgagttctctgactagtatttgattttacaggctcataggcggaagggacttgccttgtctcagatgaaacttcagacttggactttttagttaaggctggaatgagttatgactttttagttaaggctggaatgagttatgacttttagagactgttgggaaggcatgattggttttaaaatgtgaaaaggatatgagatttgggaggggccaggggcgaaatgatatgatttgactctgtgtccccacccaaatctcatctcaaattgtaatccccatgtgttgtgggagggacctgatgggaggtgattgggtcatgggggtggtttccccatgcggttctcatgacagtaaaagagttctcatgagatctgatggtttcaaagtgtagcacttcctacttcacactctgtctcctcctgccatgtaagatgtgccttgcttccccttctaccatgattgtaagtttcctgaggttttcccagccatgcagaatggtgagtcaattaaaccttccttttttttttttataaattactcagtatcaggtagtaatatgaaaatggactaatacaaatggtgtccttataagaacattagattaggacacagccacacacagaagaaagaccaaggaaaagacagccatctgcaagccaaggagggagggctcagaagaaacctgctcttgttctcagacatctagcctccagaatggttagagaataaatgactgttttttaaaccacacagtctctggtactttgttatagcagccccagcaaactaatacaatgtatatagtgtgtgtgtgtgtgtgtgtgtgtgtctgtgtgtgtgtgtacatatatatattatatatttgagagtatattatacatgcatttaattatgttatctctgttgttggtcactaaccctaaagagagggccaaagattcttaacctcatgcccaagtagcttgggactcctgatacaaggcagggcaactctggatggtttttttgttttgttttgttttgtttggagatcattcttgtattgactattcttaagcccagatcattatttgtctaatttgaacattctgataagcccatgtgattagaactgctggtgggagtggaagagtgctgcatagaggcatagaggtctaattcagttctttcaagttgaatcttgactcaggtgttttcttccacttgtgaaatgcagaatttgcagaacagtgatcactagtgagaacatcagtaagagctgctacctagcacaaaagacaaggtggaaactgttgagaaggtcaagtaagtaacacacatatctttataagttggggcattataatttcactttcatataagagaaaaatgggttcataaatcctacaaatgtttttctgacatatagaaagttatagtaatggagaaatccaaaacgaaatctatgttggaaaatagagcattagctagcggataatgtgataaggagggaaaatagtaaattgagaaaagattagaattagaagagggaatattgccaacaaccacgaatcacactttaacagcatgaatcagcaaccttgctaaattctctaattaggtctaatagttgagaccaggcgcggtggctcacacctgtaaccccagcactttgggaggccgaggtgggcagatgacctgaggtcaggagtttgagaccagcctggccaacatggtgaaaccccgtttctacttaaaatacaaaaattagccaggtgtggtggcaggtgcctgtaatcccagctactcgggaggctgaggcaggagaattgtttgaacccgggaggggttggttgcagtgagccaagatcgcaccattgcactctagcctgggggacagagcgagactttgtctaaaaaaagaaaaaaaaagttgttggtggaattttttgtttgcactttcttggtagacaattgttaacatagaagcacaggttggtgcctttctctttgaaatcttaaactttttgtttattattattatcatttttaatctcattgctctggctaagaattctggagcaacgttggaaaaaaaaaatagtgacagtggacaatttaccctgtccttgattgtaatatctctaaaattttaccaaaaattgtttccgtatatgattttcctatcagattttgcattatgaggtcacaatttttggtgtcttttttgttttcataatttccctctgtagaataaccttggtcaacttattcattcttctacctgatttggttgcctgagccaacatttgaacttcttatagaagttttatttttttacttttggcaaaatgtttcttgatgccttctggaaagtcctgcattgtaacatttgatgacactgatttgcttttttacatttaagatacttagcaatgtgccccatgtgcttaatgtttgtagtcccggcatcttgaaaagtcccaaaatacaatacactgcctacctttacttgctgagcgaaagtaaaaaggaattcatgcacagccttgagcatgaggaaagagtgtaatacttgggaaaattaggtacataggtaacacagtttcaactttttggtgaggaggactttgaaacttgaccttgtatgttcttttacgtttcttttgcatttagacttgaaaaatagaattctggatttgtcagagtaggcagaggaaaaacaagcccaatgaattctccagtaatccctaatccttcttacactgttttctacaaaactgttttaaaaacactgcactcttcaaattacagtcacctcctgaccctagtaagaatcacagatgaggtaatctgctacagaggaatagacttcttgcaagagtgattgctcaggagactgacttgtaggggagttggtttccagtgctttgccctgcaaagatttgtttaaaggccacattgggcaggaatacttgtgaggcctatgagtacatcactaaaatatgaccagtgccagagcatatcaacagtattttgaaaataggtttcactgaatggggtcagacaacttgataacgaaactattgtttgtgagcaaagggtattgtatttatggcatccaaactcatagtgagttaatgtatgggaagaggttgtaatgctatcctttatcttagtagaaatattattgggaagctcaaccccatgtgtggatgcagtttttaataccaattctgtataatttggggaatgactttttcagattccaccaatatgaaatatgagcctcctgccttgaaatattatgtgccaatatagtaaacactatatgggttaccaagatgatttagaagtacaaagtcatgtttctcttacataaccatggaaattaaattttcctttgagcaaaccaaattttttatcaaatttgtcaaaactcatagacctgtaccccccaaattaactttaatgcatgtacgtataccccaacagaaaaaaatacagatttaaatatatctgagaaaatgtcaatattgacaatgcattaataaaattatagcttatatatgtaggtacttcttaaattttattacatttttctctatcctcaatgtagaacacaattcctaactcccatcttgggactcaaaaactgatgccccaaaatatggtgtcttgacatgctcaactgaagacaaagcctcaaggtctctctgacctcttcgctgccaccatctcttccaaagaagttgaagttcctttatctgcccaagatccgacccagcaaggagagcaattttttttttcttcccactcctgtaagaccaagaatgtaaccacacctgagcagacattttcactgtcaaagagaactatttacaagttaattactgttcctgcatccattcattctccctagtatcccctcaatagaactcctcttctcccctctcccacagcctgtttagcaaggatgatatataagttcccgaaccccactggggtgttgggtcttcattctgaaagcttccatgtataatcattaaataattgtgtgagcctttctcctactaatctacctcatgtcagtgatttttcagcgacccttcagaaggcaaaagggaagattcctcttggtttctctacattcctattggccaaattcaattaccactaccaggatagtgactctttgtactaaatttaataggattcttccccactccctgtatctgtcagagttctccagacaaatagaatcaagaggagatacatacatatatattatacatattatatatatatgcaatttatatttattatgaggaactcgcgtacatgattatggaggctgagatgtcccatgatctgctatttgcaacctgtaggcccaggaaagctggtggtgtaattcaatcagagtgatggcataaattccagtccgaggaatttccctaaaaataatgtttgatcattaactacacctagaaaaaaatgtttaatctgggcatccccagaatcatcacgattccccaattcatgtccacctggagcctcagaaagtgaccttatttggaaataaggtctgtgcagatataagtgaggaagttaggataaggtcctactggatgatggtgtccttctaagaaaaggagacaacacacaaacacaggcaaggatgcagacaaaggccatgtgaaagtgaagcaaggctgaagtgatgcagatggaagcccaggagcaccagggattgtatggagccattgaagctggggaaggggcaagaacagattcttcgctaaagccttcagagagagcaaggccctgccagtaacttgatttcagacttctaggccccacaactgtgggagacaaaatttttgtttttttaaatgaccagtttatagtaattatgtgttatggttgccttaggaaactattacaattcccttcttgcccaaaggaactgggggacagtagcaacttgctgtgtcccctgttggaagtgtttccgttttggggaccaggactcctgaacctgcagaacccagcattacaaggacagaaggcacaaattcaaaacacaaaacaacgacaataacaacaaaaacccaaaacagcaaaaaagctgatgtttttcacctttgactcctgaacacgtgtattcttccccagggcaaagcaatgtatctaaagtcctttaactcaaaatctatactgggtcctgggagaagatcatccatccttggggcataccagctctgagcaggcactgcgaactgtgcctttgcccagactaccatcaactctctgaccatccacttctgggtggtggagaacatgataaaactagctgatgtgggcctattcttgtgcttcttttctgtaaaaaggatcctctggtcataccttaggttatgtgagatccccagttgccagagaggttctggctgaggcaagtacatggaagaaatgaagtatttgtattaaagtattattttgcctcaataataatttaataaaataatgacctgacttttacaaaatgtttttccacacatatgagaatgacaaatataaaatatatgctgtctttagctgtcttattatattgtgcctgtctttactagactctcctctttctggtcccctgttagaactattatttcttcattacagtaatcatcattcaggagttttatgtgatgataatgggttcagtacatgctagtctatgcctctgatctaaaatttgcctgaattcaattcagtcaacatttattaactaacaacataacaacggtgttgggaagggagtgtccatttcaaagttgttccacttaagaaaatgaaacaagttatactatttatctttttctgtataaccagtggtcacaatattttatgacttaagacaacaataatcatgtattagtctgtcctagtttctgcaggtgagggtttaaacaggatatagtgagaacagcccatctgctccagttttggagcctcagtggacgatgtggaggcagggtggcaggggattcgaggcttattcacccgtggggtgggggttgacactggctattggctgaagccttggctggcactgtcagctgggccacctcactgtggtctccccatgtgcactgggcttcctcataccacagtggctgcttctctgacagaaggagagcaagagcacacaagccaaacaggaagaaactgtgttctgtaagtgacctggtttcagaaggtaggtggcttcattttgatgtactccagtcatcttgggagtcagaagtaccgagcagtttcagcaggaaaacacatagactttgttatggtttgactgtgtcctcatccaaatctcaccttgaattgtagttcttataatccccacatgtcatgggagggacccagtgggaggtaattgaatcgtggaggtggttacctccatgctgttctcatgatagtgagaaagttctcaggatatctgacggttttataaggggctctccccgctctttgctctgcacttcttgcttccaccatctgaagaaggatgtgtttgtttctccttctaccatgactgtaagtttcctgaggcctccccagccctgcagaactgtgagtcaactaaacctctttcctttatacattaaccagtcttgggtatttcttcatagcagtatgaaaatggactgacatagacttcctgttctgtgagatgagtgtcaatttcactgtaaggacagatgtgagatgggataatgtattagcgtagccatcattgaaaatggccacaggaatgaatgaacccacattcaatatacatttgctctgtgtctgacactgcgctgagtgttgtaagcatatttcttattgaatctttatagtacctctatgagacaagtactaagagaccttttctcatctgcatgatgtcacatgtaaatacttgacttatataaaaatatctgaggttgccaaatagtttgcattccaagcctcctacccaaggctaatagtgaggggagctataggagtcttgccctttttaaaatttctgttcacaacataagaaaggcaagacacaaacatggcaagtacatctctgattaattcttactttttatttcagacttatttttattagattcaatataagtgtatgtggtgagggtttataattaattttgaaaagggagatgagttgaattaaaaattacatttttgtcagagatgccattaagtggaagactttttttatgactctgactaaaatgttagtttttagtatcacaagattatgatagcatgttttatctaaaaaaagctagacatcatttgggtagactcccttgtttagtatctgaagcataaagaagagaaattatttgtccgaggtcataagaggtaggatgagacctcagactcaaaggtatgctttacttctaatttattttcaattaaatattttttagataaatgaagtattctgtaaggatattatgtggatattgaccacctcctattatttgctagattcactattaaataacagaggaaacttgttgaataacattatctgccttcagtaaaaaaaatttagaaattaaaatgttgtgatagaagcagaatgctatgggaaaataattattttcatataatgatattgaaatgatttcatataattcatataatgattttcataataatgaaatgcagttaatattatagatttcagtatgtaactcaacagagtatttaaaaaccagagtaacactggatcctctgttagtacacggtttaaatctttggaaaaaaactttttttaatgtatgtgcagatatttctgaattttgggagcagcttcatcagaaccagtttatcttgactattaagcagcaattgagtagaaaatttctccatatcagaaatgttttatctttgcaaacatattgttttcccaaagacacagaaaacacttatggccatttttattgcttgtagtgaaaaaaaaaggaaaataagtaaacaccacaattctgaaaaacaagcagtatataaaacaatcaagtacatatatacttcacacatgagaaaaattatggataaccatgggatatttttgaaaactttataaaatagcagtcttataagactgacatattatttatttaaaaaattcaaaattaacattagccatagaaatactttctctcttaaacctacacagatttctctgatataaaacataaagcaggcaggagatagattttttttcgtatttcttgcacatgatctgttagaattcagtttattttattttaattgaactatgaagaaaatactggttttaaaaatttgaatagattaccaggaaatgctaatattcatttatgaatattaatgtgtcggcatgcatgaaagtctcattaatcagacaactggcacatggttgaaatgtgtagattgctactgtgtgtatccctgatgttatatgatcaaaaaagttgaaaactcacaacttgagctcatgtataattacccaaacttcttgagttttgttatggactgaaatatgcccccctaaaattcatattgaaaatcaaagccccccccgaggctgctagacgtaggcgttaggcatgtcccacccacccgccgcctcccaccgcacctcggggacaccagagctgccgacttggagattcctggtctgtgaagagtcggtggtgccagcaggaaccgggctgggcctcgtgcgtccgtggggtctgcgcttggtctttctgtgcttggatttgcatatttattgcattgctggtagagacccccaggcctgtccaccctgctaagactcctcaggcagcgtttgggtcccgcactctgtccacatttccccgatgtcccctgcgggcgcgggcagccacccaggcctgcttgctgcggccccctctcggccaggcattggctcagccccctgagtgggaggtcatgggccagtccccgaggagttgggcccctgcacagtgcctggccacacccatgatgcagggctggcctccaaccctgcggaccgcgccaggcaccaactccgtgtttggtgtctgtctgtgtttgttttcaagaaatgattcaaattgctgcttggattttgaaatttactgtaactgtcagtgtacacatctggaccccgtttcatttttacaccaatatggtaaaaatgctgctctcagcctcccacaattaaaccgcatgtgatctcaaaaaaaaaaaaaagaaaaagaaaagaaaagaaagaaaatctaagtcccaatccccaatgtaatggtatttggagaaaggacctttaggaaggtaatcaaagttaaatgagataataagggtggggctctgatctaatgggattggtgtctgtataagaggaggaccagactctggggagtgctctgtttctctgcttctctctctctctctctgcctctatctcatgtggacagaagaaaagtcatgtgagtacacagtgagaaggttaccatctgcaagccagaaagagaacccttaccagaaactgaccttgctgaaccttgaccttggatttctagtgtccagaagtgtgagaaaataacagtctgttgtttatgccactaagcttgtggtattttgtcatagcagggtaagtagactaatacaggttttctcttcagttattcagaataactgggaaattggaaaataaattctcattttcaggaaaaatacatctttttttacaagtgtgattttctcatagttagaattcatgaattgcattcatatattatataacagtaactagaagaatatgaactggtgtttaaagggaaaaataagttaaagtaaatggtgcacagaaataggattcttcagcacaacattggaaagaggagactaagctaaaaacatcaatgagggtgatgtcagcaagatggcagaataagaagtctcaactctctttcccacatggaaacaccaatttaacaatgatatatggaccaaatatcatcagtctatgtacctttatgagagggtcagaatccagttgagaaactgcaggcttctagataagcacagagctgagaatggctatattgaaccaggtaagagcaattttactttactagtgtcagctctttctccaagccagcatagctcagcaccaagagaaatgggctcagcctacaacttctccctcatggatgcagagagaatggactgtgcttacaacaaccctggctttttagttcactgcctaaagaaacagattctgtcttgcctcacatggagttctgagagaactggcatacttcagatgtccagagatggtcaaggacagagaaaaagcggtgggggcttactgctgctggcatggctctgtgagatagggagaaggagcttcttcacagagaatgatggatagaaatgtagtatgcctccaatgttccagcctgtggtacaggggtcagataccagaaggagtaagagattgaagcctcctggaaagaaaagaaaaaaggaaaggaaagaaaaaagaaagaaggaaagaaagaaagaaagaaagaaagaaagaaagaaagaaagaaagaaactagtaaatctgtctacttacctatgcattcgttcagaaaatacacatccatggaagggtttgagaagctcccagaatctctcccaaggctgactgatgaaggtctccctctgtctgagtcagtctataaggactggaaaaagcagctatttctgcaaatgcacaaacaccaacacaaagctacaaggaccatgaagaatcaggaaacaacgatacagccaaagcagcagaacaaacctccattaaatgaccctaaagaaattgagatctattaattggctgacaaataatttaatacaattatcttgaagctcaatgaattataagaaaacagacaactaaacaaaatcagaaaaataatacatgaataagatagaaatattaacaagggggtagaagctatcaaaaagaaccacgcagaaattctggagctcaagaatataataacaaaaccaaaaactttaatacagagcttcagcagcagattttatcaagcagaagaaagaatcagtgaactcagagagtgatcatttgatattgtttagtcaaaggagcaaaaagaaaaaagaatgaaaaagagtgaacacttaagggaattattagacctaatgaagtttttattgttcaaatttttattttaatgcattataaaagtttcagaaaggagaaagagggaaaaaatcttatttaaagaactaatggcaaaaaacttcccaagtttgggaagaaaaacggacatccagattgctgaagctcaaaaggccccaaaagtatgaacacaaagaaatatacaccaagacacattataatcatattgttaaaagtcaaaaacagtgggagaattttgaaagatgcaagagagcaataacttggcatgaacaaaggggccccaaagactactaggagatttctcagcagaaaccttgtaggcaagaagaaagtgtaaccatatattcaaagtgatgaaaaaatttgtcaacaaaaaatactatacctggcaaaattctttttcaaaagtgaagagaaaataaagacttccagaaaaaaacagaagttgaagaagttcattactactagacctgccttacaggaaatgctaaagggagttcaagttgaaacaaaaaggacaaatatgaaagcatatgaatgtataaaactccctggtaaaggtaaacatgtagacaaacacagactactgtaatacttcaatagtgatgtgtaaatacttttggttttaatataaaatttaaaagaaaaaagtagtagaattactacaactacaataatttacaacatgaaaagctgtaaattgtcacatcaataacaaagtgtattggaggaagaattaaatgtgtagcatttttgtatgcaattgaagttaacagcataaatgtaagcctaatggtaatcacaaagaaaatacctatggaagatacactaaaggaaaagagaaaggaatcaaaatatagcctgaaaattcttcaaatcactaaggaagatagcaagagaggaaaagaggagcaaaagtactccaagacagacaaaaaagaattaacaaaatgacaataagtacttgcttatcaatgattaccttaaacataaatagattaaatttatcaaaatcaaaatacatagagtggataattttttaaaaaacaaaccattttcaactatatgcagtctataagagacttattttaaatttaaaaaatatatagaatggaagtgaaggggtggaaaaggatattgcatgctaatgacaaaagaaagcaggggtcatgtatttggccattcttgcattgccataaagaaataactgagactgggtaatttatgaaaagaaaagagatttaattggctcatagttcttcatgctgtacaggaagcatcctggaatatgcttctggggagaactcagaaagctttcagtcatggtggaaggcaaagtggaaacaggcatatcacataagaaagcaggagtgagagagagagagagtgggggtttggcgatgtcacacacttttatgtgaccagatcttatgtgtactcggagcaagagctcactgatcactaagaggatggcccaagctgtttatgagggatctactcccatgatccaaacaactcccaccaggtccctcctccaacatcgaggattacatttcagcatgagatttggacaggggcaaatatccaaactataccaggaggctatacttatatataatggactttaaataaaaaaccgtctcaagagacaaagaaagttgttatataatgataaaagtgtcctgttgtcaggaagatataacaattataaatatatataatatatatatatacatatacatatatccaatattgagcatatgtatatatagcaaacattgataagtctaaaggaaaaaaatgaatggcaatataatatttgtaggataatttaatatcctattttcagaaataaggaaacagtggagttgaacagatccgtagacaaaatggatctgatatatattgtattggtttgtttgggctgctctaataaaatatcatagattgcatagtttataaactatagacatttatttcccagcctccttctggaggataagaagtcccccatcaaggcactggtagattcagtgtttggcaagcgcggatttcctggtttatagaaggcagcatttcactgtgtcctcccatgacagaaggggcgaaagtctctctggggtctccttcataagggtactaatctcattcatgaggacttcacccttatgacataatctctttccaaagaccccacctcctaatcattttgggggctagaattttagtgtgtaaatttgggggttaccaacagtcagaccatagcaagacatataagaaacattctacttcacatccgcagaacatatacttctcaagagcacttagagcattctccaggatatatcacaggctggttcacaaaggaaatcttaacacatttaggaagatttaaatcatgccaagtatgtttcctgactaccataaaataaaaccaaaaatcagtaagagaaggaaaatgaaaaaaaaaacccacaaatatgtggaaaacgaacaatatactcttgaacaatgagaaataaaaatgaaatcttaaggcctccagctgactgaatggacctcctcttggcctaggggaccctagcaaaaccttgaaaacagactttgtggccatgacagtatgggaggtcattatacccccttcctcactaaccacctttaccctttcttccctaagggttaacctgaaaccagccctttggaaaggctcactacactactatatcaaccagctgcctgattctgcccctcccatttgtgatttcaataaactgtccagtattccttcccaataagagaccactggccacagagtggttctgccagtctatgggggatgtgcagtgagggtttcatgtcctctgctttaccttttgatgtcaaagggctgaaaactccatcccagaatcatgctaatgccaccattttttgaacatgggtcccatggtgaagcatgaagctcggctgaacatctgcattgttctcctatcataaatactcatgacttctcctatagcttattgaatatggatatttggccaccacattcagcataaatccctgtcttattctttctaccctgaaagggtctgtttctggcttctgggtggagattacctttcctagcctgtcagaatggccaccttgcaggctgcaatcatttttgagaaataaagctctcctctccaagtttttgaacctcatcattcctcagtggacacaacctatgggtcagagaagaaataagcagggaaattagaaggaatctcaagacaaaaacaaaaacaaaacacaatatgccaaaacttaggtgatgcagcaaaaatagtactgagaagtttgtagtaatgaatgcctacattaacaaagaagaaagatctcaaataaatgatctaaatttatgcctcacagaattagaaaaagagcaaattaaacacaaagttagcagagggtaaaaataaccaatattagaacagaaataaagcagattaaaaatcaataaaaaaactgcagttaggagttgactttttgaaaagatatgaaaattcgacaaaccttcatctagactaagaaaaaggagagaagagtcaaacaaataaaatcagaagaggagacattataactaatgcaacagaaattaagatcataagagatttctatttaagaaagtgtatgctaacacattggaaatcctggaagaaattaatgatttcctagaaacatacaacctaccagactgaatcatgaagaattacaaaatcttaaacaccatgtcttggtcaatttgggctgctataaaaagggccttagactgggtaatttacaagcaaaataaaggtaccgctcacagatctggaagctgggaagttcaaggtgcaagcattattggtgtccggtgagggttagctctcagcctcatagatggcaccttcttgttgcatcctcacacagtgaaaggggcaaacaggctcccataggcctctttaatatgaatactaattcaccattcataagggtgaagcccttgtgatctaatcacttcctaaagcaccacttttaataaaattgcattagggattaggttgcaacaaatgaattccaggggagccaaacattcagaccatggcagagcaataatgaataatgagattgagcctgtaatcaaaatcttccaacaaagaaaagctcaagactgtatgcctccataggttaatgctgctgaacactcaagaaagaatgaacaccaatcttccttaacttatttcaaaaaatctaagaagaggaaagatttccaaactcattttatgaggctagcagcaccctgatactaaagccagataaagtcactacaggaaaagaaaactaaaggatgataaccctgataaacatagttgcaaacaccctcaacaaaatactatcaaactgagttcatcagcatagttaaaagggtcatacaccatgaccaagaggtatttatccccgggctttaagggtggttcaatatatgcaaattgattaatgtggcacactgtaacagaataatgtaatgcaacaaaatgaaggataaaaatcatctgatcatctgattatctccatagactgcagaaaagcatttgataaaattcaatatcctccttgataaaaactctcaacaaactaagtatacaattaacgttaacataataaagccccaatgtgaaacacctaccaccagtataatacaatattcaatgtaaaaaactgaaatcatttcttctaagatcagaaagaaggcaaagatggctattttagtcacctgtatgcaagatagtattggcagtcttagccagtgtaattgctaagaaaaagaaatggcatccaaatagaaaaggaagaagtaaaatgatttatgtgtgcatatgacatgatcttatatgtggaaaaccctgaggacgaaacacacacacacacacacacacatcccacacacagacacacacacacacacacgcacaaactgttagaactaacaaatgaattcagtaacatttcaggattacaaactcaacataaaagccatgttactattaatgactatctgaaaaggaaacttagaaaacaatcatatttagaatgacatgaaagatactcagaaataaatcagggaggtgaaagactttgccttggtccgttcaggcttttataacaaaatgccttagactgagtaatttataaacaacataaacttattgctcacagttgtggagtttgggaagcccaacatcaaagcagcagcagattcgttgtctggtaaggacctctttctcagagatggtatcttcttgctgcatcctcacatggcagaaatggcaaaaagtccctctcactcctcttttgtaaaggcactaatcccattcatgagggcagagcccctatgacctaattacctctcaactgtcccacctcttaatttcatcacattagggattagactttaacacataaagtttggaggaacacaaatattcgaaccatacataacaggcttgtacactgaaaactgtaatgcatagatgaaagaaattaaagaagatacagaagacagaaataaatacaaagacgtgtgatcatggactggaagacttaatattgttaaaatgttcatactgtctaaagcaatctacaaattcagtgcaatcactatcaatatcccaatggcattttgcacagaaatagaaaaaaaaatctatcctgaaatttacatgaaaataacaaactaaaaaccccaattaggcaaagcgatcttgagaaagaaggacaaaactggaggcatcacacttactgatttcaaaatatatttaaaaacaaaacaatgtggtgtgagcattagaaacagacaaatataccagtggaagaaagtcacaatcccagaaataaacccacatataatgtcaaccgatcttcaacaacgatgccagaaatatacaatggggaaaggatagtctcttcaattaatggtgctgggaaaactgtacatccacagccaaaataatgacactggatccttgttttacatcatacacaaaaatcaacccaaaatagattaaaaatttaaatgtaatacctaaaattgtaagacttttagataaaagcataaaggaagagctccttgagattggtctttgcaatgatttcttggctatgacaccaaaaacacagtacaaaagcaaaaataggtaagtggcattttatcaaagtaaaaaagttactgcaaagcaatggaaacaataaacagagtgaaaaggcagcctatggagtgagaggaaatattagaaaaccatatatctgataaggggttgataccaaaaatatgtaaggaaatcctacaactcaagagcaaaaaaacaaatatctagattaataaatgagcaaaatacttgaatagacatttctccaaagaaggcataaaaatggtcaacaagtagataaaaagatgctcaacatcacaaaccatcaatgcaattcaaaagtgaaaaatacaatgagctatcacttcagacttgttaggatggccattatcaaaaaatgacagatcacaggggttgccaaggatgtggagaaatgggaagccttctataccgctggtaggaatataaaatggttcagctactattgagaaaagtattgaagttcctcggcatattaaaaatagaactaccgtatgattcagcagtgtcacttctgggtatatatatgaaagaaatgaaatcaggatctagaagagatatctgcactcccatggtcactgcagcattattcacaataggtaagacatggaaaccacctgagtgtttacttacagatcaatggataaagaaaatgtggtgtgtacatacaatggaatattatttagccttaacagagaaggaaatcctgacatttgcaacagcatggatgaacctggaggacattatgttaagggaaacaagccagttacagaaggacaaatgctacgtgattccaatgatatgagctacctaaaatagttaaactcacagaaacagagtagattcatggtagtaggggttacacggagggagaaatgggaagtgttagtcaatgaatctaaagttatataagatgaataagttctagaaatttgctgtacagcactgtacctgtaggtaagaatactgtatagtactgttaaaattttctttacaaaaaggaaaacaatcaggtaaagagcctatagtcattgtaaaataaaaatcagtctcttggttttgcatttttaactagcaggtaacacaatgaagagatttttaaaagaagcttataatttaaaaacctgcctattgttgctggaaattcacattgaatggcattgtcatatatgttatttataggtctgcttcactcctattaacatgttagctcaccttactaacttgcctcacccatgatcaattaaattttcagtctccaggtaaatcttgttctcagcagacaacatactctcagtgaggctcagcaaccaatgatggataagctctgactcagatgtgttctcctccctcaagctttgctgcaccaagcctgcccacagctaaaggaatctgatgttactctagttcactctacacagtcacttagcaggctggtcattctcagcccactgaagcatgtgagtggaaaggggttgtgagcagcctaaagaaaacagtggcattattgttgcttaataacagaaacacataaaagagaatgaggaaaacttcaatgtcacaaagttattttcattagaataagcaatatatggaatttagagttgggatactatttaggtgataaaagtaggaatggtgctttcaacttcatatatttttaaaatatcacaggctattaataccaggtctatatgcctcttttatgtgtaaaagacataaatacatttgttgttaaaatataagaatctacttacatataatttctattgaatgattttttcctactctttttgtttcataaaaaaaccgtcacctttttatcatacacacacacacacacacacacacacttttcatgatataggcacacacaaacatttcttgtagccaatatgtgctaacagagtcatcaaatgatccctaggtatatactcaagagaaatgaaaaccacatgaaaacaaaatgttcatagcagcattatcattattcatagccaaaaagtagaaacaacccaaacatccatcaactaatgaacagataaacaaatgcagtatagtcatgcactaaataatgacttttaggttaaggagactgcatatacaaaagtggttccataagattataacggagctgaaaaattcctactgcctagtgacatcgtagctgtcataaagtcgtagcacagttattttaaaaatggaatgtagcataagtgtgcagtgttcattaaatcttcactagtgtacagtgatgtcctagaccttcatattcactcaccactcactcactgactcattcagaggagcttccagtcctgcaagctctgttcatagtaagtgtcctatgtaagtataccatttttcatctttcgtttctcttttctttttgtttgttttcatttctttttgtttctttctgtttgtatgttttttgacagagtcttgctctgtcgcccaggctagagtgcagtggcatgatctcggctcactgcaacctccgcctcccaggctcaagggattctcatgcctcagcgtcccgagtaactggatttacaggcgtgcaccaccatacccggctaatttttgtatttttagtagagacagggtttcgccatggtggcctggctggttttgaactcctgatctcaggtgatctgcccgcctcggcttccttaaagtcctgggattacaagcataagccaccgtgcccggcccttatctttcatattgtatttttacggtacctttcatgtgtttagatacataaatacttaccattgtgttgcagttgcacacagtatattccctacagtaacaacacgctgtacagatctgtagcctaggagcagcaataaggctaagccatatagcttaggtgtgtaataggccacaccatctaggtttgggtatgtacactctatgatgtttgcacaacgatgaaatctaatgatgcatttctcagaatgcatcctcctcatcaagtgatgcatgaccgtatcctcccgatggaatattattcagcaataaaaaggaatgaagtacagatacatgctgcaacatgaaaatgaaagtgttatgcgaaggaagccagatacaaaagaaaaaagtattgtatggtcccatttatatgaaatggggagaacaggcaaatttataaagatagagagtagattgttggttgcctatggcagggagttggaggtatggagggcaatgggtaggactgcaaaaagttatgggggcttgtagggggtactgataaaaatactttaggtttaggttgtggtcgacggttgcaacaatatatgaatatgctgaaaaccatcgaattgtgtgcttgaaatgggtaaacttatggttagtgaattatatctcaataaagctgtttaacaaaatagaaaacaccaggattgcaaaaggacatttcatcaggcctgtattaaagcaggattggtaactgctatgatttgtttgtcccctcggaaactcatgttgaagtgtgatctccaatctggtgatgtctggaggtgggatagtgggaagtgtttggttcatgggggtggatttctcatgaatagattaatgctttcccacaagagtgagtgagttctctttctggctggactgaattagttgctgaagaaatgagttgttataaaagtgagtccagcttcctagactctgtcttgcttcctctcttgccatgtgatctctttgcacatgaccacttgcttttctgcttctttgccatgttttgactcagcacacagctcttaccagaagccaaccagatgccacgctatgctcttgaacttcccagtatgcagaactgtgagctaaataaaccacttttctttatatattacccagtctcaggtattctcttatagcaacacaaaacaaatacagtatctatggcctagataccagtgacttccttaaatttccccttcccttccgtatatctgtatttcccaatgagcatcttcttcacagtgaacattaacaaaatacaagtccagactctttcatgtgaaaccttgatctgtgctggagctgcttccccacaggcaactccatctcctacatgagaggcaggtgaaacttttaataggggtccctgagaagtaaaatgaaaaatggtacataaaaagcttttgacaaaattggagataattatggctttatgtctactattccaattacagagtggcaaacctgcattttaaaattgttcctttatatattatttcactatgaccaatgattctcctggacaatggaagatcaaatgcatgatttataattaaaacgtttctgttcttatgccaggagatgtatatattgaaattcaaaagtattgcagcacacttacagtgattcaatattacaggtaaaatatatttcatgtttcacttatgacaggtgctaattaaagcaagttacatgcattagttcaaagaaaattttttttcatttttttcattggctggagcataatcagaaattatcctatgcctttgttgacatttaagaaggtgtcttagagattttaatacaaatacaaagtgtttgcaactgggaagtaactttagaaattatccatttcggtgttttcatttaaaaatgaggaaaccgagagaggtgaaagccctaaggtcgttagaactaagtggtaaaaagaatataaatgccagtgttcccagtcccatcccatcaggatactttctttcaaaactcacataaactaaaataaacatgtctacaaagagacgacacgatattctagttctgtattagcctcttaatacttgtgggtgacgaacttactcaaactgaatctaaccttcctgatttttacaatatctcacctaaattctatgaattttgtgatgctcagattaaattacacagacaacatgtgcttcgcaataggtataccaagaattaccattaaatctactattgcccacgttgaaatctgggatctagcaaaaaatcagctgtatgataacaggcaactttcttaaaaaaaaaaaatcccttgccatccctcagtttcttcattttttcacctaaggatagcaactgtatctacctgacagcattgttccatgaggattaaaatgacagtgggttttgaaaagtgctttggaaagcatttcatactaagggccctttaagttgtttgaaaagttatcaatatcatcatcatcaatcattatcatgataatcattattataatcaaggaattatttaccaggtgctaatgtgtttattggcctatatgtcttttccacataaatgattcagaaataagaatttcaagatggtcagaactttgtgaaatctgaaagatcataatttatattcaaatatttggatgtaaccttgatatacaatgaaaattaggtcagctcacatttagtaatttaaaaaatcactgtgtgagaggaatgttttaaatatgcttttgggaaagatgaaaaaattcaatcagtaaagtaaaactgttgaatttcagtattgtttttattagtataattaccacaaaaaacaacataatcaaaaggaacacttggaacaaattgtaaatgagttagtattgtacattttctctcaattccagagcaaatatgattactaaaagcaaaggatatttttgacacatactcttgttgttaacatggacactaaaccaaggtttatgtaacaattacagtttttaaatgaaattaatttcagcttttattcagtttcagttccaatatacattggtaaaagtagtcatcgtgactgaaaatgagtaataagtgacacagtatctttcataaaagatttttacaatctttaaaaccagtgagcaacaaatgataaaaatttatattatctctactggataattatcaagccataagtttattttaataaataaatataaacatgacaattataagtgcatatttaaagttaacttgctagtaaaaattcagtagtattccaaagtcattatatgccagatttatttggcagaaatgtgtctgactccagcttaccttttatatctcatcaggaaatatgcacctgagagtcatttttcccttacaggagcctcctgtgatgactgaagaagccctagcccttttgaaattggtgatgtagagcttcatcatttcctgtttaaaccaagaaaattgtgtgagttgcaaaactctaaataatggatcaccagtgagaataatatcatttgccagtgacataaagttgataagaaaatgtgctggcaaagtggggtggtaggaatggcaattggtttagacatctttcctgtgttgtcttttggcccatctatcccagtttcttaattttacagattaagaaaaataaaaaatagagaagcaggaaaggaagatatttgctcagagactctcaggtagttaatgaaaggactttggcgtcctgtataggttcaagaacctgtagggttctttctgctaccccatcttaagatcacacaagatgtatgattagaataaattttggaaaagtacacagctgtaaagccactagccattttatttcctaataggagaaagattggagcttagggaattagtgtgatatgtataacataaaatgtaaggaatcagagtaaaggaaaccttttttagtagcacatgccatggtgcatataaccaagaaataaacatctacattgattaacatggaaataagtaaaattggattgctaaaccaagtaatttaattttaaaattgtaggattttcacattgctaaaatgttaaaagtattttgaaaagggaatcattcgttacttataccctaaattctttcaaagagaagtaaagcaaaatgagagatacctgaatttatatagaagcataaactataagaataaagaatgctgtgatttggagcttagacgccgtaacactaaatgtaatgccacattgttaaaagtaccctgggtccagaccagtcagatgcaaatcttgaccttaccacttgcttgcagtgtgaacttgtacaaacttaagctacgcttgcctcaaagaatggggataataatgaatctacatacatacacacatagatcagaaaagtgcttatagcaatgctgaaagtataccttgtgttagtctgctagcactgccataccaaaataccacagtctgggtggcttaagcaaaagacatttatttcccacagctctggaggctgaaagttcaatatgaagatgttggtaagttcggtttctcttgaggccactctccttggcttgcagacagccacattctccctgtgtcctcacatggcctttcctctttctgcatgcatcctgggtgtctcttcttcttcttataaagacgcaatcacattggattacagtcccaccctaatgccctcatcctaacctaatgtccctcaggaacattatctctaaagatggccacattctgacatactaggggttgggatctcaacacataaatttgggggaacataattcggcccatcacatacatcttggatcttctaccttgtggaacataactggcggaaaggccaagctgcatctgaaatgtacaatgcacttattctgaggctacacttcccacaggccagtggctgagcatcacaggatcactcaggaaggcccctttgtataagcttaagaactccctctggctttgcaggaattttctttaaaatgcactgcactctttctccttctttctctgtttccttccttcctccctcccttccttccttccttccttccttcgttccttccttctctctttccttcctttcttttttccctccttccttccttcgttccttcatggttccactctccatggaatttgaacatgctttaattaccataaatctatttttaagatgtgttgaagcatttttgctgaagaactatcagtaattacagttgctaaaaagcagcttgattttgttttcagcctggcgcatatctacttttatgtcaagtgaccaaggcgtgtactttacaagaacaattttataaaagaattctgtaaggtgtcatcatttactgaaaaactacatgacttttagcacctacattcttctggaaaggttgattggttcagcagaagtcttgaaaagtggtaagaattcatctaaagtgttcacaggtacctagaagctttggttcctggccctgtgttatgttgataggtggtacatgccatgaacacatgccagactcagtagtctttgtaaagtttcttcaccaatgttgatggagatagtgaacagtttgtatcatgatgagtagtttcatagagaaatttatggaatacctatttgaattcatctggtgccaccatcagactatcttgggagtgtcagagattacctgagcgaagggttagaccaggtagcttcaattctttctttataaaatctcaaactaaacaattattattgtatagtggcttatttggaatccacctatagatttatcttttggtactttagataggattataaccttggtaaagactcgtttggcataatgatctactagataatttcttttaacttccatattgccccttcttgcatggacctaaaccattatcatagtcatctgtctaagaagtaggagtgcctctaaaagttccttaactatagtctattttttttggtcggtgttgtcagctacctagaaacccctttgtttccaaagcatctcctaatcatgtattactccagaagcgtgtttgttatcagtatatatccctctctgaacttcggtgaatggaaaagctctagcaagtgcagtaagttctcccatctgggctgattttctctcaggtataagattgtattctaaaggagagcttaaattagtgagagtgtatcctgtttaatcccctccagtttcagttttgaggtatgatattagatgaagttgctcaatgtaagcctctaatacatctgggtgagatagtgaaggttacctaaccatggtaaggtgatcttgaggtcctctttattatgacgaaggcaggaaagcagaaggactcagggtgttgtaggactcagtagtttaactgagacctaggtcaagcatggagcctagaactagttcagcagaaatattgacatgtaatagcaactggcctaagaccaagtgaacaagtcaaatgaggctatagtaagcatttgggttttttgtttcccatgaaccacagaggacaaaaaggcttgttcaaaccacttatgcacaaatagacaaaaaaggctgtttgcagttaacgaagcctagggaagaaagctttgaaaaaccttccttaggtaatagaaggcttgttcatgttttgaatcctaaaagagagagtctcttatttaggacttagtcagttaataaaattgacgcaatttcagaaaaaaaaaattggcacatgttgtctgcaatatccagttaaacccagaaatcctctcaattattgtattgtaagaggtttaggaacagttcagtagtgtttattctatctgaagagaggccttttttttttctccttagatagatcatggcctataatggactgtgttttggtaaaattgtaatttagcttttgaaactttatgttctttcccactaaagttgagagcaagtaaatggattccttttttatgggtttcctttttctctcaacaaaataggtcatctacatattgtgtcaaagctgaatcaaaagaaaatttagaccttctgtcttgattgaaggtctggaaaaaatatgagggtgctttagttaacttctagagcataacagtgcaggcatattttcattctccccaagtaggaccagaagatatttgttgtctgctctaggggcatgctgaaaaagagcacagatctgccacaaggacttaagtaattttaggaattgacaacaaggtgatatttggattaggtactactgggaagtgagaagtgagaagtgggggctaacaattttattgatggccttgaggttttgaacaaatacatatccttggccatttgttttgcaggtggtggtgtttttcttctttcttttccttgtagaatggaagtgttacaatgttacaaaggctagttcagagtaagagaaggcctttggatataaggcctttgccaatgggtctgagactttctcttgcttctggcttcaagggatattggtgaagattgggtaacagtttggtgaggtaaaagattaataagatctgttccaattattttcccatgttagtgtgtgtcccatagtgtgtcaggtatgatgtcaagatcgctaatggaggtatgcatcaaatgtaatggagaggacaaaggtatatcaaagtataatctacaacttgatcatgaacagagaaatcctctgaaatttcaaaacatacctggaacttctggtgtgcatttaatattatgatctcatttgaaaagtaaatctctccctgtcaaatttgcagctgtgttattagagaggctgaaagaatgtttttaagtcaaatgcccaagtgttaaaaactgggagatagtaaaaacctgtgggttattgaaatacctcctacctgtgtggtaagtttattctgaggaagaggaaggatttcacatggaacaaatagtacctgtgtccaccaggaattgatgaggttgactagttttatatatatagtcaattcaacttgattatttaagggtaagataggcatgtttttcccttgaagtacaattattaatctggatggaggaagttttttttggcttgaattttcttttgtaaaataaaaccattattattccacttttgttacaatgttaacaagcatccttgtcaatacaagatcagttttaaaatgggctattttactgtttgatctgcagggtaataattttattttgggtcttgtctcaattttgttgtaaatctctttcaatgtgttctgagttaggtgcaaaatttaggaatgtaatgagagaaaaaaaagttttcctggaaaagaagataacttagacttagctgaccccataggagctggcaatggttggtcactagtgatacttgtgtacattgtgtgtttgaccccaaatttgataattgtctgccactaaatgcagatgtgactatctgtgcttcttgataagtggaaatgagagagaatgctttctctagaacaaagccacactcttagaacaaaacaaaacaaaacaaaacaaaacatgagttgaaatggacttcattcggctttattggtgacccactgaaatgtctggatgtatgccaatctggtgagaactgcaaactcactatggtatgaagcaagctaaacaagtttatagggactatgcctaggttatattgtgtgattttgcttattatgaaaaacaacacttttagacagtacaacataacataggagcacaagaaatagtaaacatgaatgaatagcaatggctcaattccaccagggtgccgaacaaatggaaatcaaggacaacacctgggggtaccaaactaaaaatagttgaggaacccatcacaaagggacctgtaatagtccgttctcattattaatataaataactacctgagactgagtgatttataaagacaagaggtttatttgacttacagttccacaggctgtacaggaggcatggctgaggaggcctcaggaaacttacaatcatggtagaagggtgaaggggaagcaagcacatcttcacatggcagtaggacagagagagaagcaggaagtgccacacacttttaaaccacccgatctcatgagaactcactcactgtcatgagaacagaaagggggaagtccaccccaagatccaatcaccccccaccaggtccctccgccaacattagggattgcaattcaaaatgagatttgggtggggatgcagagccaaaccatatcagagtcagacttcagacctgttctgtgttaacacgttggcacagagtcaacaagtctgatatggtttggctgtgtccccacccaaatcacatcttgaactgtagctcccataactcctacatgtgggagggacctggtcaggaataaatcaatcatgggagcagtttcccccatactgttctcatggtagtgaataagtgtcatgaggtctgatgattttataagaagtttcccctttcactttgctctcattctgtcttgcctgccactatgtaagatgtgtctttcatcttgtcatgattgtgaggcctccccagccacgtggaaccatgagtccattaaacctctttttctttataaattactcagtcttgggtatgtctttatcggcagcatgaaaatggacgaatacaaagccccagcagcaaggcacaaggggcttgcttgtgtcctatgcctgtttgaaggctggggtttgcagtgatgtgcagtgtagatcatttcttcatggggcttccaggaaaactctggaaataagtgaagcccactcaagtgaggaaaaaacccagaaacttatctattcagagcttgctaaagtaagggtgtcagccaccattactggtgctagatagagattcaaaggcaggcagaggagtggggaggcttcatattgacaaaaataaaaagggaagctttcagataggctctgattggatgttgttggcatgaggaagctgaagacaggctacctagaagtgagacatctcatatgataggttttggaagcatatttggctttctctagttagtctcgagttggaagcagcggcaacaaataagaaagctgactgtctttgaccaagccatgatttttctgggcttattgtggttcaagttgttgtttgacttaccgagatggttgctgcagaggttgtgagtcccagctttattgtcatacgtggtcatgtgacctggcctttgtccatttgtatgtggagtttctccacttctattgtcattattagtgatatcatccacaggacatcatagcccccagtttgttacaaagaaagaagcaaacatcaaagcagaaacttctggagcacagagttgactcctcttaatttgattataacaccatatataaaacctctggcccaggttttgagatgattaaataccatacatatgtttggaaagtctgcctataaaatctctcaaaagtcaacactctgtgttgccctccaggagttcagcacaggggacgcagaccttacagtaatctcccttgcaagaattcccttcaaaaggaaggacatctttgccccactttgtcattccttctacacatttcacttagaagttcattttttcatggttttacatctctatatgaattttaaatcctggatggaaatatatccatgtctcttaaatttggatgcacgtcttactaacttttattcttgtgtgtcccatctgaaattgctatcttttccacactaggtttcttttcttgtatttccaattcttttgtccacaaaatgcccattcgttcagtttccaaaacttgagacaagttcctagcccttgaagcacatagtcttagcccacctttgatatcagcctcatcattcctgggtctgggtggtgccaactttacctttaaactatatttggaagctgtattttcctctttagttccactgacacttccctaatttggtttctcattaaattcagataggctgatgctctcctacactccagccattctcagtctgattcaatgaaaccattgatgtcagactaaattctttagagccatacctgaccatttcacttttctgttgaaaaacttcacttattcctttggttatataaagtaaagcctgtatatcctagcttgtggtgcaatgcactcttcatcaccatcttctcgcccttcctttccctatttataagcccataccatccttaatctgagcctctcatatgactttgcatgctcagctccacatcagaggcatccaagtccatgtccaatctttcgtattgaacagaaagctttatgagcagcatatctatatttaattcatcttatttttaataacatttagaataattaatgacatttattaaacaataaaaattaaattcttgagtcaaaacaaatatatatatgaaatatatatgaaaatcatttaaaaatgcaatgacaatggcaaaatgcaaactttgataaaaggtatgattatggcaaaaattatgtgctctagtacgatagcggtcaatttctacagtgaaaatgttgaatggagtttggatttgatgtaaatatttaatgaattataggattttttttttttacataggaataacacaaaaccccatgctaagaagaggagataatttcaggaaagtttttgatgtgcagttacaatgagcatctttatctagttagataacagggaatcttgagtatcattggaattcatccctatttctcctctcttctctccctttcttctagtgtcgaaacaggtacaagaaaaatcaatgctgtggagaatagaccataaattaagtgtcccaataatttgaacatatgatttaaatttaaatattttgtactacagttgataaaatgtagtactaaagttctaaaaaataactgtagctctgcagctatgaaaagagaataaagcaggatagaagtatgttttccctgcacttaagttcaacaaaagagtaaaagcttgtttactgtggaaagtattgtgaaaaagagatttcacattataacttcagagtttttctgattagatccacattttactttggcataagtgaaatatttatgaaagattggccccatctttctttttttcatttagtaacagcaaagtattccaaagggattcttcaactaaaccttgattaaccagaacattcttttgtaaaacaaatggaaaatcttgatattaccataaaaacaagagaatttttagccttcctacaaccctggctttctcttgtatgctgaaaaccattactctgccctctaatgattttgaacattgctggctcaggggagagatgagaagccaattggatcaatatctggagaggaagctcttgggtaaaacaaaatgcatagctgtgataaccaggattgttttatcatcttgggaattcataaccagtagaatcatgttccaggaaatgtggaaatggctatgactcacaagaacccagccagcatttactaagcttattccatgtattttatgagaatgtggtcacttttcctagaggtaagaattgtttgtaagccatggaacttcaaatcattaagagtaattttctctattgtcccaagaaaggtcaagtattagagggcttatcagggggacagaacaatcttttggcctctgtcaattaaaggataccatgtgtggttatttgccactatacatctattgaattgggaattgtagctatgcttccttcctaagattaatatctcaatacttttgcataatagtctggaacacggaattgtacaggtattaggaatgctttcccactctaacctgaattagaaaatgcattggcctaaatttaacttgtctaggtatctttgagatttcacccagaaagaataaaattcagatgaaatgcttcctctttcagtagatgctccctggctattccagcaatgcaaggaacaatttaaataaccataacaatctagcatggtttgcccatttctagaacattaatcacatctcaacttaaagtcattccctatctgacctcctcactaaatctcttggcatatagacttctgcttttaactttgaggcagcacccacatgcaactgtgctttgcacacaataggcactacctatgtttcctatgcataaatttccaagtgttaattcttgagatttctctcacaactctccaaaatgccatttatatcgatataatcagtataggtttgctcatatatttatggtgtgcattttcagatattgttttattaattttacacatcgtatttacttgactattccaaggcaaactgtcttgaatgtcctatctttatttcacaaatggccattattaaactattttttctttatatattgtgatggctggtcccttaaggcagatgtgtcaggagctcatgtgtttaaggaggtctaagattatgaacaatcctcagagggaaaatgggataatggaccaataattgctgctgattgcaaaaatagattttcaccctttcatgagataaaaagaagcgttgtgtaattgctgtaaatgtgtcctatgccttcaggaattggattcagaagatattgcgacgttacacctgggagtctaaatatggttttgtactgattgctgattattatttttaggtatttgcaatctcttgtcttaatgtgctactatatgaatactctgataataccttgaaacaatcccattaactccattaatgtttggccagttttcatgagaggggtcagtatgtttcatgaactcaaaattttattttaaagaaaggttactagtgtggtatgcataggaaaaaaatgagttatcaaacaaatgaatgaggcagaagccatatttgttttaatggactttgtatctattactgtatgaaaccttgacaaaatgatgggagaatccgttaaaagcaaatctggaaaatgagatacttgcacagttggaaatgttgaacaaaagttatttattttatagacagtgacattatcttataggtagcttacaattgaatttttttcaagaaatttaagttgtaatttttacttgaatctttattgttggttctttcctgcaattttggctatatttttttcaatctctgccattagacaaatctatattttcatttcaagatcatttgtgaagtactttgaagcaaaacaaacacaaacctaaatagcctgaaacgaattattatgactgttctcaatacttatcaactcataccaaaatagcaagtattttgctggtagcatacattgtatcattgaacaataaagtgaaattgtaatagaaatgtattatattttagtctctctgggtagaaattcaagtcattttacctttctatgcttcaggattcctgtcaataaaataaagttttttaaaaaattattttgagggcaacattcatacccactaatctataagtataatgagtatattttagaaaaaaaatctgataacaaatagctgagttacaccatgagctgagagtatatttcttagaaaacttcaatctgcttttgaaataaataaaaactatgcctgtagtcccagctactcaggaggctgaggcaggagaatcgcttgaacccaggaggcagaggttgcagtgagccaagatcgcgccactgcactctagcttgggtgacagagtgagactccgtctcaaaaaaatatatattttttaaaaaataggagacacatttttatttttggagataaagaaaatttgaagaagatatttaaaatgtcagaatcgtttcagttaagtcatttctgaaacaacatttaggtatttcatgtatgactgagtcaatttcctttacattaagtccatttaacagagacggtaggattttaattgttttctgcaaatatttttaaagggggaattttagtactgttagtgttcatatgtttttataaatgacaatatcagaatttagaatatttacagaaaactaaccaatcccaatccatgatttgtgtgaatggcgttaattttatgaaatatgggagttcaaataacacaaaatttacataccctgtcttgagtgctctatttatttcatgaagggccgttattaaactcttttttcttacattgtgatggctgctcccttaaggcagatgcgcttggagctcatgtgtttaaatttacatatgaaatgttacataattttttcctacaaagaagtcagaattagccttattttggtgatttcacctttggcatctaattaggtgagaaatggctttgatttacctctgtcgctttgtcaaagggagcatgtagacctggatgtcaaattccattgacaggaaaaagggacaagactggaaaacagcctggaggcagaaatatcaggcacttgcaagcctgatgctatctgctactcagattaaattctctcacatcaaattctgcacaacgaatttttttttatagctttccttctattactactgctgaaagcaaggaaacaaatatataaatctcacacccaagctcacaatagaaaaacagcacttcaccaacttaattgcatttctttctacaaaagaatcacaagggaaaacaccaaaaatctgagttttgtactcttgtgggtaatattttttaaatttccccaattctttctttgaagcttcactttaaaataccttatgagaataatatttctaaggtttggatttgaataaaattattgagaaaattaaccatatacttgaaatgatagaggcttttacatttaattttttttttcaggatattggtttaaaatatgtactgccaaggagagaacacttctcattacagcatccttagagaaaaccacgaatttaggctggtttttcacagaggagaaaagatcaattaacttgtaatcactgaagcgcatatgttttagaagactaaagtaggcactactttctgtgtttcaaaaaattgattcctgtttttgagttgtaacaaaggaactcttgattgttcctagacacctgccggtcacttagagactgcccacccagaacaatcaggcagtacagaaatgaatttgaagtctggtcgcaggagtatgaatgtcgtatcatgtgttaggacatgttgcattgtctccaatagctaatccaaataaaattgtagttattggagcacgtttcacaggtattccgtttaataattttttagtaataatattctagagaggtcaaagtgttaaaaccaccattctctgtaatatcctttaaacacaatatgccattagtccaagttttaaaagatgtgaattacctcctctccacagagcttgtatttctttttactttaaaatttctcaatttttatcacagctcatccatcagaatcatatgtacctttatttttatactggtttctatactgttgttgtaaataatgtttcccttattaaaataataatacctgttcttaggtttattatagcattttaatttgaccaactaacagaatatcatgtgctataattagagtttttaatgtctttgtagacagtgccactgctttagtattttatttttcaaaaaatccaggctgattttaatgtaagtgtccacagccttgagaagattaataaatgatccatacaattacatattattgaaataaaccatcatttttaagacagtgtgaataagacttccataattttccttcagaatcacctataatattccattaccttttaatatatcttccatctgattgtaattttttaattaatattctggaaacctgtaagtttccatctgaataaattccatgtcattttgatgtttccacatcatgaccaactctactcaattgttgctacacttggccaggggacaccatttttagattcctgggcaagtaatatattttttaagattcatagctcataaatctgaaaatagtttctttctcatataataaaatgaccacaaatagcatatagaatagaatgtatcataggcatcttctcatctcatgacaatattgttcatttatttgttttcttgagaaaataaaaaatatatataaattaaaaatcaaaccagtagattaaaaatgcagtagagtaattataaattggccagagctatttttaaagtatgagtcttttatgtacacttagccctattatttcaggttatctgtgggaaaaaaagttagctatttaaagggaagtgcttttttgttgttgttttcctaatcatgagttttatttttcacaaataatttaaaaatttaaaattatattgaaaaataatttttcaaaagtaatattcacatggttaggaaaactgaacattaaaaaatgccattatattatttgtaaatttctgaaaaagagcatttgaaactaatgatttccttcacaaattggcatcaatatactatttagagtagaaataattaagacaccaggggaatatgacacaggattcttgaaaggtaatttatataaacataaaagtcgatcgtccaaactcaattttgaatattcaccattgcaaacatttttgaaagaggtggtatttgagagacctctttattcaaaaaatttagatacaacaatggtgaagagggaattttttctcttttagaaacagcaggaaaagtgactctaactataaatgaccattcaaaggggttcaaaatcggtttgaaataatttgaaaagagcctgccttaccacacattaagttttcatgatcccttattgtaaagagctgcattagttttcatgtgtgttaatcaacgtacaaattttgttttctaatttatagtacacgttagtctaaaatgcttaattttgtatttgatagaattgcaaatatgtaaaccagtaaaacgctcatttttgatgagcgactacttggatttttattaaaatgtttagtttggactattaaaaactgaagacattactggtctaaaagcacatgcttattatggctattttgtctttatagtttacttgtttccagggattttcttgtgtgttctttattatttatgattagccaatcaaccagactatttctgtttagttaatttggataagaaatttttcagaggatagcaggaatagtagttgacgaaaaattttgttaggaacgaccccctagctgaatggattgcagatctcagcaagtcctgttacttagggagcctcatgagattttatctgtcctttgttgccttcaaagctttctgttaactgatctcattgcttacaatatctattacccagagaaaacggtttaatataaatggcaaacctgggatggactttatactagatattttcactctgaaataaattattttagttgaagttgacttttgactgaagactatcacagttctgtatataagtgcatgagctctttctgcagcaaaatatcattttacaaataaccttacctcaatttcaataatatgtaaacaaataaatatttatgtgaataaataaaaagtcagtgctcattctgaaataatggatttttaaaaaatacactcagggccgggcgcggtggctcatgcctgtaatcccagcactttgggaggctgaggtgggcggatgaggaggtcaggagatccaggctatcctggccaacatggtgaaaccctggctctactaaaaacagaaaaaaaaaatagctgggtgtggtggcgcgcgcctatagtcccagctactccgtaggtgaggcaggagaatcgcttgaatccgggaggcggaggttgcagtgaatcgagttcgcgccacctcactccagcctggtgacagcgcaagactgcatctcaaaaaaaaaaaaaaaaaaaaatacgctcagtagacatggagaaattcttatttgtttacaataggaagcactccagatatctccagatatatttgttgatctggagtgatgttaccagtacaaagtattgtcccctttgaagaagccacctttgaaacatgtgtttttaatccaatgattaaaacctctatttatgtgtcctttgtgaaaattgtctctaaagcccgggtacttagaggtggtgcagttcttcagagagaagtttataaagccccagggaacagtagccaggctgccaacaggacgtgctcaaaggtcaaataacttcagccggcgggtaatccatggttgtggagctttataaaaaaaaaaaaaaaaaaggaacagaattgtggacactctagttgtatttgagagataaacacaactgcaagagagatgtcagtttgatctgggaatattcaggaatcagagcctggagggcaacttttaaaaatgagggctggtaggtttgccttcagcagaaaacgttttccagaacctttggctgcttttaaagtcctttagtcatgccacctgtgaattaaataaggtgtttgatatttaaatctatatacgaaatgtatattgttagacaatatattatctaatttgttacttctgaagtaccactattttcagccttagaatatagttgatattcaaagagcaatcaacacacttaaaatgtttggattttatcaccaagagctacttaaaaattagctcaatgtgtgcagtgggatttttaaatagaaattttctaattccaattatagcaataaaatagtataaattttgatgttctagtctcctttatttatcttgccttttaattttttccatgaaagctttatacattattgttgtttttattattattattattattgtcatttgagatggagtctcactttgttgcccaggttggagtgcagtggtgtgatctctgcccactgcaacctccacctcccaggttcaagagattctcctgcctcagcctcctgagtagctgagactacaggcacgtgccatcatgcccagctaattttttgtatttttagtagagacagggtttcaccgtgttagccaggatgcgctcaatctcctgacctcatgagccacccgcctcagcctcccaaagtgctaggattacaggcatgagccaccgcagccggccaactttacacattatttatgaaagtttatacttacgtaccttcatatggtactctaatatgggatattttattgaatatattttctaactgttatagttctttcaccaaagctattgatttttacatacctaccttgtaactagcaacactgatgaaattcatgatcagttcaatttgtccctatttctgctaaatagacatatttatcatagcaatgatgggtttttcccatttcaaatattttacttcttttgttttattgtatagaatagtcttttttatctttttatgttgatactatttgccgaacaggtcagccttttcttgttcctgactttaaagaagatgcttcaaaggtttcttcattaagtatggtgttggctgtaggcttttaatggatagactgatatcattgtaaggaagtattgatttctttgttttcaacttatcgtaaatgtgtatcaaatatttccaagtaatttctccacttctcatgagggttttattattattattttcatgaattttttctatttaatatattaatataataaattgcattcatagattcctaagtgtttaggtacctctgccttcttggaataaacttcaacttgttcatatgaattatttaatacactgcctgattttaacttacattttttagatgtgtatttgtatatacatattggactataatttttctgtgactttatgcttatttttctttgaaaaattctcagttatattgttttcttttttattgtttgatttcaaggaaatagctattagatttttctcttgttttcagttttataaggtatgactgacaaataaatcttatgtatttaaactgtgcaacgtgatgtcttgatagatgtaaacatggagaaatgttaccactaacaagctaaattaacatatccatcacctcacacagttaccaatattttgtgtgtggtgagaacatttaaggtctactctttttgtatatttgaaataagcaatacactatcattaactacagacaccgtgttgcctcttagatctccagaaattattcatcctgcataactgaaacttagtattctttaaagaaatagccactggatttttgttattctttctaatattttatatttttctattattttctgttttaatctttactaatttgttccttctgcttttctcaggcttagtttttggttctgtttctaacttttaaaattaaatgcctaattaattcattttaatttatttttgctaagacatgaatacatattttgccgggaagatttctctaagccctaccttgtagttattccctaatttctaaaaggtaaggttttcatcattgtaattttctatatattgtgaaaatgtagtttgattttctttggccttacagatccttaattaaagaatttctaagtagaacagtaattcatttttcacatttttgctaatttcctgctttactgaagtatccaatgacgttttgtgtgttgatacatggtaacctttaaaaacacttaaaaataggtacttgctacaaagttatcaatgagtataaatagagtagttaataaaaatacatcaattatatttgcctaattaattattttacatgtctatgcaccgcactttttcctactttttccactgggctaacggaaatcatacaaagtttcttaggtctttatgttgccttctccttgtacttcctgaagtttccaattcatgaatattaatgttatataatttaataaatagtactcgttatggttagatttttcaatgtagattatcgtatttatcatggtaaagtttatttctgtattttgttttccgtctttgtcttgcacttaacctcagtaaatattgctattcacactgctgtgtttttaggaaaagaagggattattccgacaatattgtacccagccacccttccttatcttcagacactttcaccaacgtatcactcgggagcatatgaatgtaatccagaaacatgggacgtcttctcggcccactgtggaatacctaagcctgcttctgtgtgtgtgtgtgtgtgtgtgcgcgcgcgcgtgtgtgtgtgcctgtgtgcaaacacgaatggaaccttatatctgtttggcgaacccaaatcatcaaagaatcctacctctccaaatctccacctccaacatttctccatcaataatctttttgagtgcactgttttctcattcaactccacattctccagctcctgcttagagtcagtgagctgttacagagacccctttgtttgtcccatccagttgttcctaagctttttccccatattatttatttattttatttattttattttgagatggagtctcgctctgtcccccaggctggagtgcagtggcgagatctcggctcactgcgagctccacctcccgggttcacgccattctcctgcctcagcctcccgagtagctgggactacaggcgcccgccaccacgcccggctcgtttttttgtatttttagtagagacggggtttcactgtgttagccaggatggtctcgatctcctgacctcgtgatccacccacctcagcctcccaaggtgctgggattacaggctggagccaccgcgcctggcctttccccatatgtttaaggaacacagaattggaaacattgttagttctgcacaggaagtgaagagcccagcattatattttggtatgcctgcttaccctactccctcccattgggcactgggaaaacttcttcaaaattaaaaattaatagtgttccttagttacattgactacaggcttcccttttctattctgcaattatctttgctgctttcctttgtttcagagaggagtggaaatgcctttacctaccaatttaatctgaaattctcaacagttttgaagtggtcacagttgtatactggaaatgaacaggtctgaaaaattaacggtctacaaaataatttacacaataagattttttccatatatcaaaacgatataacatgcttttagtaaatatttaattatgagggaacattctgtaggatattatttgccccaagttttaacaatgattaaaaatatttgagttaataaactattttaaaacaggatactgcaaattgttacatgagtaaatttgagtaatgaatattttattgcaaaagatgaaaactaaacataaaatcgaaattatttaaagtactgtacagtaaaaattacttgaaattgaaaataaaatacaataaaaacaggaaaacagtaaatctataccagttaataataacttatactgtaagttatcatattttttctctactaagaaaatctaacgtgtttaaaaactgaagtaaattatttactaatttgcatactatcttagcatgttgttgaattattaaatataaatatatctcatcgtttaatggtgttttatttatttcagagagacaaatttgtatttaccatgtctggctaaacaatcataaatgcactctcagctgaaaatgatatcatttaattaatatccttcaaacttttctctcacatgttactctaaccttcaaaatagccagtgtgtaatcaacatttatataaatcaaagatgttataataatatcgatttaatgaaaattatacctagtgataatattttgcacatgaaaatggcacttaaaaatttataatcatttatttccactaatgtgtagcttcttatttcacacttgtgaaaatcatgctgcattttatttagtttccaggtagctggagtagagtctgattttaatagtattcaatactctttgcaatgacattattttgctattttaatacttaaatatccacaggaaaaggatgaaagattattgcttctcattagaagaaaagataataataagcaatattatgaagactgaaagatttttatatctgaggataaagcaacaactcagggttatctattttaaataattttaatggttgcatgtattttaaatattcagaaggaggggtttaattttatgtagactgtgttgtatttatatgtattgagttaaagtttaaaatacttcaggcccaacttgagaattaaaccttaaatcagtcaaagcccttctctcttcctaaagataaccagttcctatatttggtgttaatttttcatgtgtacaatatataatttttttgtgttttaaagccttataaaatatgttgctgtattctatcttttcttcctctcaaattcattaacgtcagtacatgggctgtaatgtattaattttcagtgtttattatatttaagaagatcatatcacaatttattacctatttgcttactgataagcattaatattgtttttgatattttccaaagaccaccagtgttgtcttctatacatgttgcttgttcacataatattccttaggatataccaacgtctggaatttcccagtcattattgtgtatgggtattttcaaatttctagatatagcatcaaattagtgttcaaacatcttatcccagttaacaattcccatagtaggatataaccaacatgattgcttatattctaaacatcttatcccggttaacaattcccacagtagaatataaccaacatgattgcttatattctcacaaacacatggtgtcttcagacttgatctttgccagtctgtttagggttacattgtaagttttctagttttaatttgtttgtcttttgttactaaggagtggaagaacaacttttcaaatgtttatttgtcatttggatttcctcctctgtgaatctcctaattttgtctattggaaaaccaaaagacaaaattgagtattgtttcagtttttgttgttttttgtttctgagacaaggtctcgctttgtcacccaggctggagtgccgcagccttgacctcccaggcccaagcaatccttggtagctggcactacaggtgtccgccactacgcctggctactttttgtagagatggagttttgccatgttgtccaggctggtctcgaactcctgggctcaagtgatctgcccgccttggcctcccaaagtgctgggattacagggaggagcctccgtgcctggcctagtactatttctcttttaagaattcttcaaggttttgaaaattaaattatttgttgaagtaaatattacaaataagttagtctgaaagttccttttttacatgtttaaaaacttttttgacagagtttttttttttttttttttttacctttaagttcaggagtacaagagcaggtttgttacatcggtaaaaacaaatgcaagtctgttacataggtacacttctgtcatggaggttggttttacagattatttcatcacgcagagattaagcctagtatccattggttatttttcctgatcctctctctcctcccatcctctgctcttcaaaaggccccagtatatgttgtttccctctctgtgtccatgtgttctcatcatttagctcccacttataagtgagaacatggggtatttggctttttcttcctgtgttagtttgctaaggatagtggcctccagcttcatccatgtccctgcaaatgacatgatctcattttttttttaatgtctacatagtattccatggtgcatgtgtaccacattttctttatccagtctatcatcgataggcatttaggttgattctatgtctttgctattgtgaatagtgctgcaatgaacatatgtgtgcatgtgtctttataatagaatgatttatattcctttgggtatataaccagtaatgatattcctgggtcaaatggtatttctgtctttaggtatgtgagagatcaccacactgttttccacaatggtggaactaatttacactcccaacaacagtgtataagcattcctttttctccacatatatgaaaaaaaagatgcttttaattatattgttattgttcatactttgcttgtatactttaaaaagtcatttcttaactaaaggttataaagataatttctgtgttctagtttttttcagaagtctgtttataattgtgaatccatttgcgggtaactgatatcttaacaaatgttagtattacaatctatgcatatggatatcttaagacttaaaatttaaaaaaagtatgacttagctccataaaatttataaaaaaactttctttagcttttttgtagatattttatgctttaatgctattgtaaatggcattccaaaaattatctttatacttcagagtttttcttgcaagttatgaatctgttattacttttagtgtatctttcatccaagaaccttgatcaattatttttaaattttaattgttttttaaaatcttggcatttgttgtttagacaattttatagtcattatttgaaaataatagtaatttgttgctttgctttcattttttccacttttatttgattactttttccctctaactttactgcttagaatcttaagagcagtgctgtattgaagtaataatgggtatctgtcaactttcaatttttaaaatgaattgtttctaaaccttgatgcctccttatttatttacttatttttcagacggggtttcagtatgttgcccagactggccttgaactcctgagctcaagtgatgctcctgcctcagccatgtaaatagctgggactacaggcatgcactgctgctccctgcttctccttatttctgttagttttgccatatgtttagctatccatgcatatatatatatgtatacatgtgtgtatatatacacatatgtgtacacatatatgtacacatatatatgtacacacatatatgtacatatgtgtacatatatgtacacatatatacatatacacatatatacacatatgtgtgtgtatatatatatacacacacacatatacagtcacattcatctttttttggctacctttcttcttgcctattaaatcttccttctggaatcgttctccttgtcaaaacataaaattgagaaattgagaatttcctgtgttaagtttctgttgattaataagttctgtcttaggtttcctgatagtgccatcatttcaactcggtaattgaatgacacattgaccaaatataaaactctaagttgacttattttcagcattttgtagtcctcattccactgtcttctggattcaattgctcctcttgaaaagtgtatgaatgccctattttccttttgtaggcattctctctttctggtttttctctttgtctatgttttaaaaatgcctcccccaattttttttttagttttattacaatcagatggacgtacaataaaattattcaagctaaagtcgtgctataggctgaatgtttgtgtctcccaaaaatctgtaagttgaaacccaatcaatgatatgatggtatttagaatgagtgttttagtaggtgatttgtcatgaggatggaaccctaatgaataagattatttttcttctataagtgactgcagagacttctcttccttttttcatcatgtgaagacatggctagaaggcagccatctatgaagcaggaagtgggtccttaccagacagcaaatctgcaagtgccttcattttggaattcctagcccctataactgtgaaaaatacatttctgttgtttacgagtcacccagtatatggtatttttttttatagcagcccaaacaggctaagacagaaaattggttctaacaggtagagtgctgctgtaaaaaatacctaaaaatgtgtaagcagctttggaactgggtaatgagaagaggctggaagagttttgaggtgtatgctagaaagaaactacattgccatgaaaagactataaagggtgattttggtgagagcccaaaaaagaaagaggagtgctgtagagaatgcccaatcttctcagagaacacttaatgcattagtcccttcaaactgcaaactaggaaaactggcctccagaactgtgagaatatacatttttatttaagccaccagtttatggtattttgtatggaagaccgagcagattaatacaagctcctttcacaactctaaggtaaccaagcattttgtttttgtaacatgtgcaaaactaatatattttcacgttcgattgtttaagggtgctctatgttcatttttagtctgacttctttttgtgagtgccttgaaggggtcatgagcattttgagcatcaggcaaatggaacaataaattgggcagtcatttaaatttgtgcatagtcacttgtgttacgtctttggcagtctctagtttgtataattatgtaattgctagctgtcctgatgtaggctggctccgggtgagtgtctaccacttactagtctgcctcattcaaaattaactttgcagaggtataggttggaagctcatattgtgatacaaaagtgttgttacctggtgttaaaaagatatggggaatgaagaacaggttgaaataaatggggtcagaagccattctgtggcaaattttcaaaaaatcgaatggataaaattgtaaacagataatatgattttcaacaatactagtgaaagcagaatttacctcctaatacaataatacttgataattcacttctataacagtatatttttaacaatgggaatccatgaaatagaatttatcgaaactcttatgtttgtattgtacaaacatgtaacagtattaaattaagtatgtctatagtggcgtgtttattcatcctaaaatcaatgataaatgattataaaccagggtcaattatcctagaagagtaattttcaacagagtgtaactttatccccatgtccacctagggatgattggcaaagtgtggatataatttttgttgttacaactatcatctaggggttagaatccaggggtgctgctaaccaacctacaatctataggacagcccccacaataaagaattatcaggcaggagaatggcgtgaacccgggaagcggagcttgcagtgagccgagattgcgccactgcagtccgcagtccggcctgggcgacagagcaagactccgtctcaaaaaaaaaaaaaaaaaaaaaaaaaaaagaattatccagccctaaatgtcaatagtgttgaggttgagggagtccatcttagaggaaagactaaattatctcttttgcattataattaaaactgtcaccaaatcattgtcatataaaaagataatctatgaataactagccaaatattaatatgtgtatgtgattgttaattgttaaatatgttatttccgcactgtgtgattttgcaatatttatcacaaaccttttaaaatttgtgatttttttctcagtctaaatgcattttgacttttacatttaattgtgtagttataagtttgtattctttcttttttaaaagaaaaccccccaaagtttcaggcccaataaaaccttggtggtacttctggagatcattctggaatatgataaatgtattagttatctgttgccgagtaacaaatcaccccaaacctttttggtttttgaacaacaaccatttattagctaatgattctgcagttagcagttggtctggaatcagcttctcctggggccactcatgtaattgcagtcatttgacaggctacatggggctgaatggattaggtggtctcacagatgtgtttggccaatggcactggcagtcaatcgggcactttagtttttctactttcctttgtggcttcctgagcacaagggcccagatgaagttctttatattgaaatctcaggacagcaaatcaatgggtcaagagtggaagctactctggaattcagtgtcacctctgccacattctactagttaaagcaaattaggaggccagccgcagtcaaggaatgtggaaatggacttgccttttgatggtgggcagccaagtaacattacaaagtcatatgactgcaagggggctaggcttttattggagacattgttttgcacagagtgccacagccaacatttactcaattttccacactgtaattagatatgatgaatgtttttattttattctccatttttcaaaaccattctttcatattttccatctgtcaggtcccagcccatgctgaggtccgaggggtgtgggtggataaatggcagatagctgaaaaaaaacactcagggggccataggtaggtgaaatacggctttatccagcagctctctcatcagcagctctcttacactgtctgctctgtctcggctgcttggtttggccgctcccatgaacacctgcacagttggctctctcttggcttcagggtcagctacttaactctttctctctctgggcacgagcacctgtaccacgtcagcagggcaattataccttttaaagacaatagtggcttagagccaaatgatgagccttcctatattatggctacatggctgtgataacaagctgagttatacgcctgtgttctaaactcactgagtcacgtaggatgtttaccttggccatgttccttacaccatctatggctttctaaggtgcatcctggataatttctgcagttatagccttgaatctacatattcttttaattagtcttccaattagatatctaacattgttaccaaattttcaatttgctgatattattcacttctagtcatattggttatttttcaagcattcctattctttttatggtatttatttagttcatatttttatttgtattttgaaaaactattccatacttattttacatttcatacctgaatatttcattatctgaagtttgtaaggaggtgtcatattttattctttattatttttagtgattcttaataatggtttatttccttttgcttttataatttctttttctaaattgtgaccttatattcagtggggttttatctatgagaatcctgtgtgtctggatatgaaaatgtccctccaagaaagccctgctgggctctccagacactgagggatattgctaacctgaatcaggcactcaaactcatgtgagagtgcgtgtgatgaggaagttttagagaagaacctacagatagaaaagtatcttgtctccctttctgaagggttcacttcctcccttcctaaaacccatcctttaccaaaggtgcagttcctcaagagaaccacctttgtgggattccattgccaagccctccttttgcatgcctgtattagtctgttcttatgctgctaataaggacataccaagactgggtaatttataaaggaaagaggtttaatggacttacagttccacatggctgggaggcctcacaatcatggcagaaggcaaatgaggagcaaagttaccgcttacatgatggcaggcaagggagcttgtgcaggggagctcccatttataaaaccatgagatctcatgaggcttactcactaccacgagaacagtatggggaaaaccgtccccatgacagaattatctccacccggcactacccccgacacttggagattattacaattcaaggtgagatttttgtggggacacagcccagccatatcaatgcctaatcatatgtcatctatgttacgaggcaattcacactgcagtcttttaattatgaagtcagaatggccacactagcatcactcacaagtttctacctcttgtttccagctccccatgcattttggtacctgatattttcttctatttccctagctttgcacttaaaatcatgggtgaatattttattcagcatttcaggaaacgattttctggatatttcgcctgccacattgctagaaatagcagttctacattacattatataggaggcattgttacattaaagcattacagcctgttcaaagttcaattaaaaagttaaaagttttaaattaatatcaacaccatatgaggagaatactttgaagtggcttcaccgttttcatctagtaatattttttcttaaatgtgcttgtgtattggttttgttcctacctcattattccttatatattagctatgaaataaatctttgaaaatattatccttagaataaagggtaacacacgttagggtgtgtatttttgtgctgttaaattcaatcagcccttggttactgagcatattctataaattcacattttaagaatgtaattcagaattcttactcagtcttttgttgagtagccaggtgaacacgcacaatctatcaaagggtcgatgtctaggctgggattgctcagaagaaaggaagagtctcagacacattttttttgtttgttattgcagtgtggctgagaatagatttttttaaacatataccatcccatgcttcattctgtagttatattcattagataccagatgatgccagatttcagtgcttgacattacaaaaaatacttatgtgtgtgtgtgcttttttaacaagattttttcaaatgtgatatattaaaaaataaatttatatagagcatggtgtttattaatttaaaaagcaaaacctgtgttttagaattaatatgtttatagttaaaatcacagtatttcttcagtttttttacccacatcgattattactccaagtatctgaattacagctgccaaaaatcgttaaaattgttatatttgacaattgttttatgatactgagtccaaaagaagaaagataaaatagaagaagtttaccaaataggattctatgtagttcagtagcacacatcaaatcatatcacatttaatgttagattgttttagtgcctgggtaaactttttattcttgcactttactctgaatataaatatttgattttttttttttgagtcttgctctgttgcctaggctgaagtgcagaggaatgatcatacctcaatgcagcctccaactcctggactcaaggcatcctcttgcctcagcctcatgaataaataggctcaaaggcctgtgctaagatgcccagctattttttttttgttgtttacttttgtagagacagcgtctcccaggctgttctcgaactcctgggctcaagcagtccttcctcctctgcctcccaaagtgctggaattacaggtatgagccactgtgacagacctgaagatttaattatatttgtcctctcattagtctgttttctttgatgaagtgagtaattggcccttttggaccccaggtggcggtgggaagtgtgagaagttgtttctgggtgggaggatgggagtaggcctctgaggtcacctgagagaagccatttactccagggcaggagtggccaaggaagtgtctacacactcaatcacatgtgaactcattctggggctggcctggggctcctccatagctctatgagaacagcctggaaggactttcccacatgaggcttgagacccagacctgcagaaggtgaggggaagctggtaccaggcaatgtccagtctgagcacaagagagcctcccaagaagacaagagagaacaaaatcaccatgggatattagccacatccagaggtcaccaccaggcttgcatctgtgtctggccctcagccccttccctcctcctgtcccccttctcatggagaaaactcagagccactatagggaagggagtagcaaagaagaagggcaaggatgcctactcttcccggctcccagagttcctcctccaacccacactcccagaagcaggcctcagctgggagtgagagggagtctcaaatgggaaaactatggaattgactccataggacttttaattcaaaaacaagaaggttgcttgtctgaaaatgaccctaagtctttttgtcatctgtctctgactggaaaagttatgaaacctcggcaaatttcatccaaagtttatggaataaatggcccacattatgggttcaagggacaataaaaaggaaaccaaaaaatgatactgatttattgagtaaagctttgtcaatagatagttaagagctggctttgtattaaacttgaatatctagaaaatcagatacacagatctttcttatttaaaaagacatctaaactactatatattatatagtacatgaggtatcatagattatttaatgggcatgtgtatgtagtttgtgctgtgcaaacaatgctacaattgattgattgattgattcatttattgactcatacattcactgattcaacaagcatgtagtgagcactgagtatgtgccacattctcctaagaacttggcaggggataaacaatttgtttgctcatggagtttctactatcaggaaatagacatccttaggatactgttgagaatagacaagtactgtaaattcctagcagaggaactgttgaataaaagagcatgtgtttttgaaattctgctagatactgttaaattgccatgcaaaatgttatccccgttgacaaacgcatcaaccatataagggattgcctgtttcccaacccttcacctacatgctattcatatattgtttttaaattttgcaaatttgatttgtaaagcttgctctcaatatcattttatatttcattcctttacctgtgagtgaatttggacatcattttataactttatttgccatgttaattcttccataacatatctattcatagcctttggtgtcatatgtactaggaaattataccaggaaattaacattgatacaatgccattgactaatctacagccttcactcatgttttgaccatctattcaagttactggtccagattgccatccaggatccctgttgcattgatttgttctgtctccttagtcctcccaaatgtcagctgtttctttgtcttttgtgacattgactgacacctttgtgaagtattggttatttaactggatgtctctgaattcagatttgtcagctatctccttacgattaaattcagattatctatttttagcacaaataccacaaagggatgtctacccttctgagtgtaggatattgggaagaacacgtcaccttctccatcttattactggttaccttttatcacttgctggtgtcttccaagcataaccactgtaatgtggtttctaattaatatcttgtggggcaatactttgaggctatgcaaatatcctgattcttacaattttttaactcactaattttagcatcctatttatgattctttgcaataattattactgtggcatttgtcaaatggcagtttttttttttaaatcaggattgtgttttcatattttgatttcacacaacaacaacaatgaagcaaaaaacaggctttggtaacattgtgtattgtgtaatttggtttgctgggcaaagccatgtcagcagaagccatattttaggttgtatgaataaacatctaggaaaactcaaatacctgtgaccttcaaaagactatttttgtaataactcttccttgataagcatagttgatatgaaagatgatttgagaatctagacttattttttggtggagtcataatatttttgtgatatatataaatgtgattgatgggttactttcagatttaagcatgtaactcatgttaacaactcttatgaaaaacattgctggtatctgtcttctacctaaaaagtggaattttagattgaaaaaataattgaaaatctcatgttttaaaaaacttaccactgttcaaaaatgtcacctactttttcttccatcaacaatagactgttggataaaaagttgtgaacttttagacctgtcatctgtacaatttacttgtgctttattggcttaaaatatctgctaggcagcaattgccagtctaaaacttaaatacacatttcaaatctaattatttgtcaaagcaactttgcaaaaatgttatttttttgaacatgatccaaaatttcctgtctaaaacacatttcctttaaaactcaactgatataaaagacaagtatgggtacattttgcagaatattattcaaagggaaagaaaatgagatatttaggttgatgaaataagagaataagcaactgacaataatgtagacctccacttcagattgtatttttttaaaaaatcaaatacttttctatgacttctctctaacctcttccacataagtagttgagttttatcacaacattagtatagtatatttgaatattgtgctaacataacaaatgtgtcagtgacttagtttttgcataatggagctcatatatttatagctaaactaatattctgaatagttgttattttttccttggtctctgggtgggtccttgtagcagagtaccctcagtttcattgtggacatacagtgtgagcgagatttaaacctttcatttgttaaatcatcaatattttgaatttctttcttataagaatataagcttaaccttccctgattaatacagttactaagatttcccccctctctcctataacaacttagtttccttagactaaatactcagatgtgggactgctggatcaaaggtatgcctattttaagttctgcatttttctagagtactttcaaataaaaggtataggaattcacagtcacaaaatcaaccagtagtacagtataaaatctattttattcattcagtgaactatgaatgcatctagtaagaggaaggatttagatgagaaactctcaaatgttttggtctcaaaattactttatactcttaaacaatatcgagaactcaaaaaaaaacttgcttaatgggttgcatctgttgatatttcccatgtaagcaattaatattgagaaattataaatatcattatgtacaattaagtattttaaaaagagcggtagaacatctattgcatgctaagataaataacatttctatagaaaacaatcatgtttgccaaaatgagaaataactgtgggaagagtggcattgttttaatttaaaaaacgtctgcctcgctagaagatacctagatctctcagctgcctctgcattaaatctgttgtgataattgcacacaatatggcctccgaaaaagtctactgtatatttgtgagagaataagtgaagcaaaaaactaaggtcttagtattatcatggaaacacttctgacctttcagtcaaccagccagaaaacttacagaacttcttatggtctgaatgttggtgtccccccagagttcatgctgaaatcctgactccccaaggtgatgatatcaggaagtggggcctttaggggaatgattagattgtgagggcacagccctgggaaataggattagtgcccttttaaaggaggcctgagggagctctttcaccctttctaccatctgaagacggggtgagaaggcgccatctatgaaccagaaagcagtccctcaccagacatcaaatttgctggcaccttgatcttggacttcccagactccagaaccacaagaaatttttttttttttttttttgagatggagtcttgctctgttgcccaggctggagtgcagtggcgtgaactcggctcactgcaagctccgcctcctgggttcaagccattctcctgcctcaacctcctgagtagctgggactacaggtgcccgccgccacgctcggctaattttttgtatttttagtagagacgaggttctgggcttggtggtgggcgcctgcagtcccagctactggggaggctgaggtaggagaatggcgtgaacccgggaggcgcagcttgcagtgagccgagatcgcaccactgcacttcagcctgggcgacagagcgagactccatctcagaaaaaaaaaaaaaaaaagaaaagaaaagaaaagaaaagaaagaaatttttgttgttttgaagccacctagtttcttgtattttgttttagcaggctgaatggactaaaacagaacttctggtttagatcattagctaccaacttgggggaatggggccaggctgcaataaatgacaaagcaatcctaagagatggattatatatattatatatataatattttaatatatattttatatatgcatatatatttttatatatgcatccatgtgtctatatatgtgtgtgtatatctttaacagtaacacctactgttaaatataccattagaaaaattccaaaggttgaaactactgcacagaagcgtatctctgtccagggttgtctaaacactgaagactctccaggagaatttgcctctggacgttaaggtgattgacctggggactttagtttttgttgctgtgtaacaaattacccaaatggagtggctgaaagcaggagccgtttgtcatccctcagctctttaaatcagatgtctggcccaacgtgagtggttctctgtttgggtatcacaaggttgaaatccaagttgagcaaaggtctcatctggaggctctggggaaggatccccttcagagctcattcttgtagttggcagaatttgtttcctgtggctatagactggggtctctgttcttttgctggttgtgagactggggttcccttcagctcctacaggctgttctctgttcctttccatgcagccctgtctatcttcaaagtcaacaatgaataatctccttggtttgagtatccttccacattctactttctctgacctcctaatctgccaccacatgaagaccattctctgcttgtaaagggctcacgattcagacaggtccatacagattgtctttcttacagtcaactcagtcatataacgtaacataatcactggattgctatctcatcatatttagaggttctacccatactcaaaaaggaggaggttatatatataggccagggtcatgggtcattccagtttgtgccaaccacatgaatcagagaatctggttaaacatgatgtggtagacagcctctgaggtggcccgctgtgatctccatgcttggtatttacgcccttgtgcatctccttcctcaagtgacctggacctagtgactcacttttaacaatgagcatatggaaaaagggatgggaggaacactaaataaaaaggtgtacattgactcaaagtcacatggacaatgcacatttaaaaacattactctgtgaagaaaatcttggtgacattgtagcagatgatataggaatactggtccttgtgccactatctagattagagtaatatttatcacatattcacctacacagtggctgccatctttgtcaatgcagagcattaagaaaggaccaaatgccctgactgagaggaggaatacaactggagtggaaatgtagttgtcagcagaaaagagatggaaaatatatttaggggtggaggtgggatttggggttgaggaaaatgatgggagtgtaggaactgtaaaaacagaggtaggcatacttactctgtttcagttcttgacaattggcaatcttaaattatgaatgtttattctttattaagagtatttacaatattcctttcctaacaatgctgaaccaaactgattggataatacagtcataaatttaccttcacacttcatcaaaattaaaggaataagaacagctacataatgcctttatacacatttcctcagtcaaaaatgctgaggggcgtgtgttgctttaaaaatgtgtattgtatggtgaaatctagaattaaactcctaacttaaggtcggatttaataaaaagcaagaggagcagagtgccaggcccacttgactgtgtgttagaaaattctattttatttgctctgcacttctctgtcttatgaaacctgactttttaaaaattaaacttagattcccaactctgagactatattcagcatattttcttcctcggcttctttgcttctattactccctagggccatctttgtctcttccccagtaagccaacttccattgctgaccaaaatatgatacatcaacatttaccatctttccatgttattgcttagtttcattgctctattcatttttacaatctcccagcaagccctccccttttcatgtttttatatttctcttctctggaggctattttttctcttcttatgtcttgcactacatttctattttgaaaaaacaaatacttgtactgcttttttcttaatcaagagtaaggctgaactttattacatattctcaggcattgccaattgactttactaattcctgaaaatcatccattggttgttaattctgtaccattatctcctggaccgtgagatcactaacaaatgcccttactgagaacagttggtattggatggtttaatcagattgtaacttttttttttaggtgtacctaaagaatccctaagtctttcttcttggcctcagaagtttagagttttaagttttcttggattttataccattagagctggagatcattctatatttccttatctaaagtctctgtgataactcctttccctatattcttattttctcataatgcctataaaaattcagcttataatgcttataaccataagcattataactgctttccctgtattcttattttctcatattgcttgtaatcataatagattcaggtataatctatgcaaccttaatattcattagttctgatggttttagatatgaggatggtccaaaatatttgatgccatatatctggaaaccttgtagtgaaggttattaaatcctagggaatcacaggaagaagtatggggagaaatttccaggaaaaagaacagatgttacaggggcaagctgatttattatttcatattctatatctctcttacaaatattgccctctctcccacccaagcttgataatatatacatatatttataatttttaaagagggataaattggtgatgactgtagacttatttacaaatgtgtactaaataacacttgaatcagttcttatgattgactcaagctatgacttactatagaatgtctgagtttcctggttatttccctctttccctcttatgcagatcaaactctaggccccacacctaacattgctgatttaatgatttaacattgaacttggaagtgtgtgttttacattggaggaacctgattacagtgcataatgtcttcacagataagtgttaatgtggaaaatggtgccatattttggaagtcaactggaaaatgacacatggcaagcttggcagcacaacagtcgtgaagcagttcatgatcagccttggaaagttgcagagagatggcaggcaatgacagtgattcaggccttccctgatttatacaggaaattaacatctaagtggtgtgtgtacaaatttttaagaacaagtgatcctgatggaaaaataatatggaaggtaaaatttaaaaagaaaactcttagacctataaattgatcattttgttttcagagaacttgaaagtgaatttgatgcttagtttaatcaaattagaagttgaatagggctgtatgattaaattccataatggatcataagttagaagtaaaccatcattcctattaatgtttctataaatctaatcataattttgtggtactctgattcataatgtacattaaagtataaaaacacagaaaatatttttaaggaaaaattattatctcactattaatatgaaaaggagaatgcacaatcaatatttggaggaaaaattatcattctctacatattttatgtgttgccttaagctggaagacttcctttggagagaaggataaggcaactccaagtatgtgaaaaacaaaataaaaagagcagacaaacaaaaatgtctgggagcaaagaaacaagaaacttctgggatttatcaaaggatgattcattcttggttttatggggatgcagggtcttttcagttgggctggcttaggaaattagaagaaagatcactgctggcaaattacgcttttccatgagaccagatttgcatatccttgtacaggtaaacaaacactgcagcctacaataaaagctcaggcctggaaaataactgttacaagataagaagtcatttaatgtttaatgatttaatatcttctgtgtaattatttttatgctcaataagtaagctctaaatccaaaagtcacgaaaattggtcaaaaaaggttaattctagaaacaagacaatgagaagcaattgatatttttgcagggagaacgatgtcatcaataatcggtttcataataattttgagtgcagagagcagtttttaacataataatgctgtcctgatggcaagtcaaaagtaatttgttattaataatagatgaagcaataatattttcaagtaatattttaataaactggtagaatctagagaatttttaattttgatatttattgagggggcaaaatcagtgtaaagttatagttttcatgcaattaatttcacaaaattcctattcatgggcttgtgtagtgcaggttaacattacatgtcatttgttttgtagaagaggaagatgagagatcattagtgaacaggtttaggatatcctgtgtttagggagaggagtgtgattattgcatgggaaaataacccatgagtgaggtttggagagttaaggatagggaaacctcagtgagagtaagggagagaggaaacatattaaagggaaaatagaggtttcggtatttcttgaagaggtagacttcatagtcctcaaacattacttctccccttcttctgtaatgctagaaaccacctgatttctagctacatatgtgattgtctagtacaaacactatgtttcccagctgtgtagacagttaagtgtgaccgtgtgaccatgtgtccaagaattgttcaaaggatggcagatgaagagatgaatgcaaagtaatggttgtacccttaatgggaaataaattgccctctcctttttatctttgctctctcctgtgtgctgcagtgcagacatggtattgcacaaccttgaatcatgtggatgaccctaaatattgcagaacatccctaggtaaaaaggaaccaggttcctttggtgacctcatatggcagaactgctatgttgccctggtctacatgcctcaaaccgtatgcagaggaatgataaacttctatctagtttaaatcatggttaatttgggtttttgttacactagtatctgaacctacacattaactaatgcagcatttatatattaagcaattctaggattttgtctctttctaataattatggctttcctgagggcctagattacaaagagaagactggcattcacatctgtaggcagccttatttttttttttttgtattgcaagctgttaccatgcaagagtataaaagaaggccaggggaatgataaaaaatattgttcaaaaattcaactcaatctgcaaattactctttggtaaccctcttttgtattatcatggaaattaatatctagtgataaaaattggggtatttttgaaacacgtaaggatggctgtggcaaatataacatttgaaccaagttaggcatgaaagagggctcaactgtcaggcaaactggagatagaaggaagtcaatattgtaggtaaattgtgaatctatgagactggctaaacttttagagattgacaggaaagagaaaagaacagataagtaggaaggagtatttcataatgttcagaattttcaaaaagaagaaataaggaaagcaaatccaaaagtaagaggtgtactaatgtcctctggtatcacacaatcagggtagaatattgaggaagaatagctcagagacaaagaaagaaacagaaaagaaccatcaggaagcaagtaaagttaaccaattatcatgattttgtgaaaatgattagtctttctaaaattaagcaggaatgtgaatatgtacatctaatacccaaatttctaaatactcagatttctaaataacattctgcaagcagaactccttggagaatcggggttgggggagcaaaaatacaagatgaatctggagcgtcttgtgatgagtaagcaactccttaaaaaagaaaagaaaaaggtaagaaaagggaaaataaaaatggacctgtccataggacttaagaaacaactggaagagctgtcagtggattaatctggaaccacatgaataatgaaatatttatagtatttgcattttaacccaaataacacaataaatatccataaccctctactggtataaattaatgttgaatgaataaataagtaaataaataggggagaagagacatctccttacacaagaattccattcaataaatgtgaaagtaaaaggggaattagaaaatcactattagagtactacagtaataattgctgcaggcaacttccataatgaacactgaaccgattaggctaggataagcaggatatttttacagcctcaaagtaatttccccaaaatatttattaattattgtgatggttttaagatatttcatagatactttcatacacttctttccagaagaaggagcttaattcttcaccctgtgtatatgggctggtcttagtgacctgcttccaatgactagagcctgcaaagaagaaacaaatagtaatttaacagtggaacttgcagataccacctgtaccaaatgatgaagattaacatcaccagtaataagatatatcgagttcatgtgcatcctaatatcatgtgataagtagggcccatcacttctccgtcattcctttcaggaactctataaccttagtctcatcactagaaaagagcagacaaatccaaattgaggggcattttacaaaatatgtgaccagtattcttcaatgtcaaagctatgaaagatgagaagactcaggaactgtcacaggttggtgaagaccaagaaaaaaaagacagataaatgcaaggtgatatcctggcttgaatccagaaatataaaaattacattagtggaaaatctggggaaatttgaaccaagtcatttgttaaaaatgttttgtcaatgtttatttctaacttttaataattataccatgaatataagctgttacattagcaggatatgagtaaagggtatacaataaaattttgaatctattatctttgcaacatttttgtaagtctataatgatttcacattaaaagtttatagaaatcaacatattttttaaaaatacctataacattagggtcaagtgcacagtttcttcacactatcagaatctctaatttctacctataaattacatgtggggaagtgatggactagaattgaaaaaaagatccaaattatacactgatagcaaagcacttgagtctgggactcaaaatagtacctaattaaattatgaacaaaatatacaagaaaaagacaaaagatgtgtagaaaagaaaaatactataccaaatgaatagtaatgagtggttagaggccaaaatataattacacataggcaacatcaaatttaattaaattctcaatttggtagatattatgttcttgccttgcaaggtaaaacattgctttaacagaagaatttattaaatttaaatgcaagttctaaagaagttgctagtatcatgtggaaagtaacatttaagagaaactgaggaaatggaactcaagatgaaaatttagcaaattaatttcgaaaatgaacgtttttatattcatttatgacagcatcatgggcaactgtgctgatagtcatagattaccttcatctctgaaattatcttctggtctgaagacagcagccatgaatgtagcagcaataacattgaatactgaattgaagcatgtgactttgtgataactttcagagacaatacatgtgataggttgaattattgccatgatactttactcctccctttccacatgactttcctgcttcttcaatcagaggtagagatattataatttcctgcttaaagctttgtttggccaatttagtgttagaaaacttgacaggagcaaactcttgaaatgtgttttgtacgttaaggattgctctcttggactttggggatgcatgacaagaatgtggccccagctggttgcactggtcccaaaaggatgagagacacatggtgcagatgtggtctctacttggagcttagagggaagccctgaggagcccagctcacatcaaccaaaccccagccaactctcatacacaaatgagaacactattattatataaagctatagagagagtttcatggtgtttgtaatgtaggtttattatggtaataagtgactggtagtaagttagaattggtgtcttcttgctttagttttgacttggattcaaataagaaagagattagactcgaaactgtatgaggtaaaaatcactgtagggagatattattataaaaatatgtcctaggacacttgaacatctgaacatatatgctgtacttggtatatagcatattatatatatacatatatatatgtataaagtatactgtatatattaatcaaataagtaattaaatatatcaaaatggtacctaattaaattatgaacaaaatatacaagaaaaagacaaaaatatgtagaaaagaaaaatagtatcctgaacgaaaagtaatgagtggttagaagccaaaaatatatagcataatatatatatatatactctatatattaatatagagtatacttttatatgtaaaatggcgaagagtgaggtttggaagcagattttcagaggaagctgtgccgtgaaccccgctcctctgctccttgcatggccctccccaagtcagtgcagtagcttttcatggggttaatggaagtaaaatacaacatatgctgatgtctagggttttgtgcaataggatctcctaaaaggatagggattagaggacctgggtgacacactcaggttgaaggctggattgtggaaggcatggaaagacttctcggcatggagtagggatgcgatcactcaggtcaaggggtcttcaagggcctgactagaccataagctgggaataggtgtgaggaggaggagagacaaagagagaagatgacaaagagcttctttcagtctccaggttttcagactgaagcaggactgattttaggaatgattttagagaagatttaaagcttttatatatcagtatgtttattatatgatggaatgaacctcttaattattgaatagaggctctattaatgactgaaagtgaccataatacttattgtaggataatagatcaaaattgtattatgttggactaactcaataaattgcttcatttcttttgtcacacaaaagctgatatttcatttttttatattgaaaattgatcatggtatgctttctttaaaaacatccgttgtatatatttctgaaggtgaagtggcttcagtcagtcacatatattcaatttattttattcttttcaagtatattagatgacttagatttaaaaatctattgatttatattttagccataaattcagtgctttagcaaatattgaatgaaaagttaagtggctaaatataatgattggttatgaatttctattgcgtattaacacattcttttcaatataaaaatgttttaaataacttttttacaatgagaaaattttattccatagagtcagggtacatgttactgaagaactatatgcatgcatagatatcatttaacacattgaatacaaattgttatattttacatattctatttataaatcaagaaacaatgggagatatgtagaatatccttaaatagattaaaatgatgcaatggaataatgatatttttagaagataccaagagaacatggagctcatttagtccgtttttaaattttaaattgtattgatgaggatatttgagcctctaaaaaataaaagataaagcggaagagatttttaaggtcatatcaagagtatacataatacttggccttctagttctctcttttcattattccttgcagtagtgtctaacttacaaattattctcaaaaaattctacaaatttttttaaaagggatgcatattcaaatgatagtttataacacactggggataatgctacactaaagtgaacaatttactattattaaaaataattggatagacatcagtttgaaacaacagaacagttctaaacattatacttaagctatattacataaaataaatatgtaaattgtccatacattcatacataaatatttgataaaatattccactcttgcttttgcatttattgttaaaatatcaacaattatttaaattcattactaaatattatccatgaattcttgagaaatgaaaaatccatgttgttttttttcttcataataacaagaaataaaactactatttctgaaaaaataatatctataatcttggtgatagattattgaaaatttatctgaatttgttagatttgagttttataatagattacagagtggctgaaaatacaactcagtgtattataagtcaacctcagtaagaagtaacttttttttcccttctactcttgtgatatcattatttactaataactgcaaatatatttaccagttataggtctttacattttcagtggtcattttaaagcaacatgcaagagaccttgcttgtgaagccagtttcagagaggcgaatctcagagactcttgtacttatgacccacctctgccctgcttcattgagttaggaacttacattatatgcagttaattgggtcatggaaagaaagacatgtcttttgtctaaaacctaagtaagtaaatcttgagctgtgaaaaaagaatttttgaatggctccactacatcacaaactcctcagcactcctcctgtggcctgttaagaagaaagagaaaaggacaaaaaggagagaacagcaaaaaaatttaaagaaaaaaggaaaggaagaaaatatgttcaggaaaagggtaatctcgttcaaaagaggaacagcactttccagaagtaaattagaacccacaccaccctccattcctaccctgaagtcataaattataacaaactaaaccaaaaaacagtagttttgggttagtttgctttttatggttgattctgtgttactcaaaattggattttaaaagatctgttaatatgtccatgaatttaaaaagaatttagacatattggaaatagatacattgcttttaaacaaatgcataatcatttctacaagtaatttttatatgatttaggtaaagtatgtcaatgtcatttggtacaggtcaaattataataccaggtcactcattcccctggtctggatttctgatcattaccaatgataaatttaggaagggtgttgaggagtgtgatagatgacgggaagcattctagaaactgtgatctatcaaaatttccaaatagaccatagaacatctccacaggtgtgctttaggaagaggtaaaggtggtgaaatgtttggagaatgactggttttaggtgaaattctgccaaaatacacaagaaataaaacaagtggatcctgccaaaatacacaagaaataaaacaagtggatccttgagtatagagattcatttggcatattgctgtgtgcatcattgtattttttttggattgttccatttgagattattttgaggtcagagcctaggatgtgttccttagcatcggttttcctggcatttataccagctgagcccacaaggtaatagagttgatgctaaaacttttcctgcatccaaaatattaacccaacttctttttctacaattattgcttcattcatttggattatcaagacaatagcagcttcaaaatctcctgattaaaatgcactttggagaggtgtttagccatcaactaaattggtggctaactggaataatttatccatgccaaaaatacttccagcatctgtgtaaataagtgctttttcgagaggggtctggatagcttatccacaggtaccaccacaagcatgaactttactgggcttgtgtctcaatgagtaaaagtattgaacacatgtaagcattcaaaaattattaaaaataataatgaaagaaaagtaagtataaataaatgtgtctggaaaatagagggaggaatccagagagaaatccaagatggcagactacattggaaactatctaggcctgatgccacaaggataaaattccactgtgagatggtaaggaggctgctgtggtagtttctctttataattaagcaaactcttccccttcaaagattgatgatttttgcctcatagtctagtttctaagtgactcgttttcaatgtaagcccagttcctataactctgaacctggaattctgtcccctggaaagaaccataattaaatttatgcagctattcttctgatagtaattaaagttagtcatacatattcaattccatttccaaatgaatatctttcatcactttcatctgtatttttcagtttttttatgatgaaaaagttagtcttagtttctgatatgataaattatgactctttcaggaaaattgttctttgtaaaatacactctttcctaaagctacatttgcaatttaaaactggttaaatagtagaagtgtgtgtgtgtatgagtgtgtgcatatgcacatgagacttcaaaaaaactatcttttgtcaatttttttttttttgagacggagtctcactctgtcacccaggctggttttgtcaatttttaatgggattttttcttcttttccttgttcagttgtttaactttctcatagattctggatattagacccatgtcagatgcacagcttgtgaatactttctcccattctgtaggttgtctgtttactctgttgagtttcttttcctgtgcagaagctcttgtttaggtttcccttgtcaatttttgtttttgttgtaattgcttttgagaacttagtcatacattctttttaaaggccaatgtcctgaatagtgtttcctaggttttcttccaggattcttacagtttgaagtcttacatttaaatatacattccatcttaagttaattttttttatatagtgaaagataggggtccagttttattcttctgcatgtggctagccagttatcccagcatatttgttaactagggactcttttctctattgtttgtttgtgtcaaatttgtggaagatcagatggctgtaggtatgcagctttatctctgggttctttattctgttccattggtgtatgtgtctgtttttgtaccagcacaatgctgttttggttactgtaggcttgcagtatagtttgaagccaggtaatgtgatgcctctggatttgttatttttccttaggattactttggctattttggttattttttggttccatataagttttagaatgtgtttttctagttttgtgaaaaaaaaaatgactctggtaccttgaaaggagtagcgctgaatcttaagattgccttggaccatatggccattaaaaaaaattgattttttccaatccatgagtatggaaggtttttccatttctttgtgtcattttttatttctttcagcagtaatttgtagttctccttgtagagatctttcacctcctttgttagatgtattcctaagttggtttttcgggcaggttttgtaaatgggattgccttcttggtttggctcttggtttgaacatcattgatgtatagaactgaattccttccttacaccttatacaaaaattaactcaagatggatcgaaaacttacacacatgatctaaaccataaaaaccctaggagaaaacctaggcaacaccattcagggcataggcattggcaaagacttcatgactaaaacaccaaaagcaatggcaacaaaaaccaaaattgacaaacgggatctaattaaactaaaaagttctgcacagcaaactatcatcagagtgaacaggcaacctagagaataggagaaaaattttgcaatctacccatctgacaaagggctaatatccaaaatctacaaggaacttaaacaaatttacaagaaaaaaacaaaaaaccttatcaaaaagtcggcaaaggatatgaacagacacttctcaaaagaagacatttatgtggccaacaaacatatgaaagaaagctcatcatcactggtcattagagaaatgcaaatcaaaaccacaatgagataccatctcacaccagttagaacggtgatcattaaaaagtcaggaaacagcagatgctggagaagatgtgaagaaataggaatgcttttacactattggtgggagtgtaaattagtttaaccatgtggaagacagtgtggtgattcctcaaggatctagaactagaaataccatttgacccagcaatcccattactgggtatatagtcaaaggattaaagatcattctactataaaggcacatgcacatgtatgtttactgtagcactattcacaatagcagagacttggaaccaacacaaatgcccatgaatgatagaccggataaagaaaatgtggcacatatacaccatggaatactatgcagccataaaaagggatgggttcatgtcctttgcagggacatggataaagctggaaaccagctttctcagcaaactaacacaggaacagaaaaccaaacaccgtgtgttctcactcataagtgggagttgaacaatgagaacacatggacacaaggaggggaacatcacacactgggggcctgtgggaagatgggggctgggggagggatagtattaggagaaatacctaatgtagatgacgggttgatgggtgcagcaaaccaccgtggcacttgtaacaaacctgcatgttctgcacatgcatcccagaacttgaagtatagttttttaaaaaagaaatgctgctgggttttgtacgttgatttttgtatcccgaaactttactgaagtcatttatcagttccatgggccttttggtagagtctttaaaatttttttttaatttttaatttttgtgggtacatagtaggtgtatatagtgatgcagtatatgagatgttttgatacaggtatgcattgcataacaattacattctggaaaatgaggtatccatcccctcaagcatttagtctttgtgttgcaaaccatctaattatacttgttattttaaaatgtacaattaaattattattgactatagtcaccctgtcatgcaatcaaatactaggtcctatccattctttctaactatattttctgtacccattaaccttcaccctccttccgtcacctcctgcactacccttctcagcctctggtagctgttcttctactctctatggtcatgagttcaattgatttgatttttagatcccacaaacaagttagaacatgatatttgtctttctgtggtctggcttatttcacttaacataatgaccttcatttccattcatgttgcaaatgacaggatctcattcttttttatggcagagtctttagggtcttctaagtacggcatcatatcaccagtgaaaagagataatttgacttcttttcctatttggatgccttttatttctttccgttgtctgattgttctggcaaggactttcagtactatgttgaacaggagtagtgatagtggcgatacttgtctctttctggttctcaaaggaaatacttccagtttttgcccatttagtataatgttggctattgcattttcatagatggccctttctattttgaggtttgttccttctatgcctagtttcctgagggattttatcatgaaaggatgttggatcttatcaaaaccttcttctgtgtctattgagatgattatgtgtttttttaattcagtttatgtggtgaatcatgcttattgatttgcatatgttgaaatgaccctgtatcccagaaatgacacttctagaaggaagacatacaagtggccaacaaacatgaaaaaatgttcaacattactaatcattagagaaaagcaaatcaaagtcacaatgagaggtatcatttccatctcatgtcagtcagaatggctactattaaaaagtcagaacaaaaaacaacacatggtggcaaggctgcagagaaaagggaactcttacacaccgttagtggaaatgtaaatcaactcagccactgtggaaagtagtttggagatttctcaaagatcttaaaacagaactagtattcaacccaacaatcccattactgggtttatacccaaaagaaaataacttgttctaccaaaaagacacgtgcacacatgtattcatcacagtactattcacagtagcaaagacatggaatcaacctaggtgctcatcagtagtggattggataaagaaaaggtggtacgtatacactgaggaatactatgcagccatacaaaagaacagaattgtgtcttttgcagcaacatcgatgcagctgggggccactatcctaagcaaattaatgtaggaacagaaaaccaagtactgcatgttttcacttataagtgggagctaaacagtaggtacttaaggacataaaaatggcaaaaatagacactgaggactactagaggtgggtaggagggcaagcgttcataaactaactatggggtactatgctcagtacctgtgtgatgggattaatagtatcccaaaccccagcatcagacaatacacccagatggcaaatctgcacatgtaccccctgaatctaaaataaaagttgaaaaaaatctggctgaatattgtttttacattttaatcattggaataaaaagtgaaagttgctgtatcagtatttgtttacccactcatttcttcatgtcctgcttaggattttgacactgtgatcaatcaatattgcttcaaagaaataataaaggcccggcccggtggctcacacctttaaccccagcactttgggaggcctaggcgggcggatcacctggagtttgaccagaatggccaacatggcgaaatgccatctctgctaaaagtagaaaaattagccatatgcggtggcaggcgctgtaatcccagctactcaggaggctgaggcacgagaattgtttgaacctgggaggcggaggttgcaatgagccaatatcgcgccactgcactccagcctgggcgacaagagcgagactccgtctcaaaaaaaaaaaaaaaaaaaaaaagaaaaagaaacaaataataaaaatgcacatttagttttattttaggaattattatgtaagcatgttgccttatctcattctttgaagttatcctttgcttaatcatttttatttatattcttggaaggcaatattgctaaaaaggtttttggcaggaaattactgagtcaaaatttccaaaaaaggatattgcatcattcattttatgaactttgcattctgaaggttcagcatcatttggggtttctttgaaaaccatgtaaatacttctacttcttttaaggatttataaaattaagaatatgttaaaataactgtttaaatttcagaactggatggtaaataaactgcagtaatttgccaatgtcagttttcctttagccatctctttcatctcttgtcctcatttcacatgttttaaatatagatgttattgctaatcagatgcactcggcatttcaaagtgatttgtcttttctagataaatacatattttcattgatttttaaattccagaatgggatcaaatagaagcaaggtgtgtttatttgtttgtaaattccagattatacaatttggagcctggaataatgatttcctcctgaagttaatattgtgaataatcactttacttaagaagtctctgtgctaaattagaatcagaaaatgcattgtttactggtaagagagctggtattgctcttctttctgctctttccctttcttacttgttttggtttttgtttggtcctggtgaattggctaatgtttagatgatgtcacgtagataggtactaccaggggtctttttataataaatattttaaaattacagaataataaactggaaaatgcccaggtcaactaagggtattgctgaaatgcagattctgattcagcagttttcaagtagggccggaagttctgtatttctactacgttcccagatgacgcagatgcagctgatcaccatgttgagcaggaaggccatagaggttgggaagtagaattagatctcctctaagacaggggttcttgattttttttacataagtcatggatttctttaacagcctcatgaagcccataagtccttttcaaaataaggcaataaaatttataaaaaataagattaaaaaatgagcaatcatatagaaataccagtatcaaattatttttagaaaactgtatgtcacatagtagtatacgtgcttcactattaacattaaataacaagacctaacaaagggtccactgatttctgtaatttcaaagagtaatattttgcctaggtgtggtggctcatacctgtaatcccagcactttgggatgacaaggcgggtgggccacttgcggccaggagttcaagaccagcctgggcaacatgatgaaacccgtctctactaaaaatacaaaaatgagccaggcatggtggcacatgcctgtgatctgagaatcgcttgaactcaggaggcggaggatacagtgagccgagatcacaccactgcactccagcctgggggacagagagactgttgcatctccgtcccccccacccccaccacacacacacacacaaaagtgatatttgatgatttctgaagctaccatattaagatatgacaatatctgttatttctatgtatgacaagtgtctaaaaccactgtagttcattgctcacattcataatgggaggaaatgtcacattttagttagtaggtaatgaaaataaagatgctaatatcttttaagcaagtgctctaatttcctttgcatcagtacatttcacagtttgtaaccaacacaaacatctgattttctttgtataatttgtgaattactaaatatagaagcgaaagcttgacctatctataccatttcatcggtgacccttcactcctgttgttgtatcttttcatactttattttttgtaaatatttataaaatatatgactatatatttttaaatgtacatgtcacacttgggaaatcacaatataagaaatcaaaacacacatgacattttaaaatgtgtagtggtaattcatgcttaaaacaatattatttaaaaaacttagccatatgttggccgggtgcggtggcttatgcctgtaatcccagcattttgggaggccaagcctggcatatcacgagatcaggagttcgaggccagcctggccaacatggtgaaactcactctctattaaaaatatgaaaattagccaggtatggtggcatgtgcctgtaatcccagctactcgagaggctgaggcaggagaatcgcttgaaaccaggaggcagaggttgcagtgagccgagatcctgccactgcactccagcttggttgacagagtgagacttcgtctcaaaaacaaacaaaaaaaattagccatatgttaggttttttttaacttctggagcatacataataataaaaataaaatcaatactaagaaaactataaaacaaagtacagggattacaatggataataccctgcttctggggagtggttgtggtcagcagcacaccttcacacaggatcttattctgttcttgaaaccagctgggacagggaggacgtcaggaccattgatcccatctcacaaatgagaaaattgaagtttggatatattataattaactcacataactggttgtgaagtcagggctcaaattaaggactttttatagatctatattatacatctatgtatttagtacctattctttgctatccacagtaataaaagagaattatgaaagggttcttgctcttagcggaccactttctgctgaggaagagacataccatggtcgatattgcatatattgatatgtttataaggtgccagggccctgtcccagcctgcaggaggaggtggagttactgaatgccatgcctcttaaaatcatccaggatatagtagagtttgtgttttggaaattaactttagagtttatttttaagtcatactgtgcatccttgactgagcctgtaccttcttttaaattccttttgttaatcttttctctcttggaataaacaactctttagcaacagctgtgcaaaacgtcctagaataaaaatcagcttgaatccttgggattcaaaagcactccttgttttatgcaaaggatggaaagattttaaaaattagctttttatttatttgagtcttttttgatgtcattttttatgacattcaataaaatcttctattcagtatagttgttgcccatattttattaaacttatccttacctcttttctctttgctgttattacatataatatatgctgtaattttttttttaaatcagtaggacagtttctttctatttctagtttctagaaggtatttttgttctaattgtgttttggttttcatcataaaaggatttccacccagcaatttttggggtgagaagataatggagaaatgtttgaaattctaaggggaacaaagtatgaccccaaaatattttatccagccaggacaaaaataaagatgaaaaattttatttttatgcaagccaagatgttagttaaatatgctttgtgcacaaagtagatgctttaaaacataaagaaactcagactatcaatgaaccttccttggcacaacaaacaggagcactgaaaaaaacagaaagcaacattaataacaacagcaaagctttattgaccacagcatccaccaactaaaaattgtttcaaaaaatacagtcaacaaagcatagtgagagcattgctaaatgttttattaatttagcagtccatttgggctgtcataaaataccatcaactatgtagcttataaacagcatacatttatttctctcagttctggaggctgagacatccaagatccaggtatcgcagattaaatatctggtgaggacccgcttcctggttcattgttggtgcctcttgctgtgtcttcacttgttggaaggggtgaggggtctctcccagacctctttgcctcttttataatagaagaatcccattcttgagggctctgcccaatgatctaagcacctcccaaaggccccatctcctgatagcattaccttgggggtgaggaattcaacatgtgaattttgggggacataaacatttaggccataataaatgtatttaaatatagacaacaattaaacagctatgaaagttatggatttagaagagtataaatgtagcaaaccttgataatcatttcattttatatagttgcatttatttcactaatatttatgtagtacttactgtgtgctggcataggttctaattgttttagcattttaactttcataatgtaaaagaaaagtaaaacatgaacaaattttgaggtgagaaggggtaatgggagtaagcttgacagtgctttgaaggccggttatttaaaaaaaaatttttttctctaaacataaaatgggaatttaaaaaggaaaaaaaaaaactccaacctaattccatacaggaaatgtagacacaatctttagaaaacagtattttctttaataacagagcatttattagaagttctttaatcttttaaatttattttatgtcacagttaagtttaatgtaccttattacaattgcatctgtttgtgtttttaaataaaatgtatttctcacaaactctctctctctctatatatatacatatatacttatatacatatacatatatacatatgtacatatacatatatatatatatatatatatatatttgactatccatctgtatatatgcctaaaaatatattggactaagcgtcttactgatgatattggtttttccgatacagagatttgatgtgatttctttttacatttgtcctcacatgtttttcattgtattaaatatctatgaaaaggtagtgttagttaccaaaacctgatttaaaaatcaaaaaaagaacactgaaagcactacaccaaaatgtttattggtaattctagtgttaattccaggggtaaattctagtatatggcaatatagatgcttattttcttgttacgtctttgaatttttaatttcccaccagaatgtgtacaaatgaataggcataagcccatccttagtttaaaggtgcaactacagccaaagaacgtagaaggaggaaaaggtaaatatctttagagatttttgcttcgtagaaaggcatttgggttgggcagcggagatcaagaaaaatggcaatttcaaatggagctgggtgacagatgaaaactcagcatcctgaaacagggtatgcatagtattttggggtactttcctgtatcaacatagagaagaggaagggtggcatggtggaagccttctgttgcccgttcacctcatgagtcgtggttcacagcaagcctgctgaaggtttgccaggctcattgggaacaggacccttccaggggctgcacctagccctgtcaggtgtcaccattcctttcctacttgggaggagaactcctggcagttgcttaaaaccacagtgtgtgaatgataatggggtgcagattcttccccagtcaggagggaattctcagtcctttcctaactttccatcaaacccactgcctctgggcaagttttggctgatctttacatttctctttggtccctaaaaacctaatgaaagagtatatcaagacagattactactgaggatgggggattcaacatgtaaaaatactgtgtacaaggggcacagtacatgaggcatatctcgtgcatctcacataatgtactcatgtgtaaacagcccagtgatttttaagcatattgagaattcatcccaaggacaatcccaatgtattaattcctttgtctgttccagcaacactgttatcctgtgatcagttttatttacaacttaaaaagactgaatggaaattatgtattaaatttctacctcatgctagcaaaaaaagagcaatggcaaataatctaaaacaacctaataaatcaaaattagcagaaatctgtcaaacatcaatgagcaaaactaaaagtctgcgtgattataaagggcaactgtgttacaattagagttttaaaatcagcacagaaaattctatcctttttctttctgatgaaagttatagtgttagcatttactttttaggcttatcagtactatgaaagtaaaataacatgaaagaaaaatgaaatggtgtttttaaaaatgggtaatattatcattttataatttaaagtttggacatcatttaaaagtcccagtttcattcagttcacttcagttcactcatttgcaaaagtacacactttttctcagttcaatgagtgctaattctaaaatggacaattcaataaataaaaagataaggaagctcctctgggtctgaaaaatgtgagcaatgatagcatgctttttattctggtttctaagaaattagcatcttgaaatagctttcaaaaatgttattacacagcattaagcattttaaaatttacccttaaaatattctaaattaaaaataattcatatcaggcagattttactatttcttaaaataatagctttattgggatacattatgcataccacaaaatttagccttttaaaatgcacattccagtggttttttatgatcttcacagacttatgcaacaattaccactttctgatttcagaatggtatcgcccattatacagatttacacaaatgtataatgacatatgtctaccattatagtatcatgcagtgtatattcactgccttaaaaatcttctgcctattcatctctccctcctcctcaacccctggcaactactgaactatttactatctccatcattttactttttccagaatatcatatggttgagtcatacattaagtaacatttctgctggtttctttcacttaacaatatgcacttcagtttcctctatgtctatcatggattaacaattaatttttttctagtgctaaatagtattccattgtctggatgtaccacagcttacttacgcattaacttacggaaggacattttggttgcttctaatttttaaagctgctataatatctacgtatagggttttgtgaggtcatgtctttaacacttttgagtaaatactaaggggcttggttgctggatcatatgtttagttctgtaagaaaccaacactaactcatgtggacgtaccattatggaattaaccataaatggaattactttcttcattaaaaaaatatttttattggtagtgaatataaatacactggatttttgcatattggtcttatttcctgcaaccttgtggaactcaattattggttccaaaagtttgtgtgtatgtgtgagcatttgttgtattttaagtgtattttgtttcattcttaacatatatgttgtcatccttcatgagatttttggaagttttgttaacttttgttactgttctacatagatttttgcaattcatccatattaatatgtgtaatgacatttatttttagttatattttatgttcatacaatgaaaaccttaaatctatttacagtctttcttgttgatggaacttgggttttatccagattgttaacatgacaaaaacgctgcattgaacattctttttttttttttttttttttttttgagaggtagtctcgctctgtcgcccaggctggagtgcaatggcgcaatcttggctcactgcaaactccaccttctgggttcatgtgattatcctgcctcagcctccagagttgctgggatcacaggcgcccaccaccacacctggctaatttttgtatttttaatagagacagggtttcaccatgctggtcaagttggttttgaattccttacctcaggtgatccacccacctcagcctcctaaagtgttgggattacaggtgtgagccactgcgcccagcctgaacattcttttatatgtcatgcagtacacaagtgatccttctttctttccttccttccttccttctttccttccttccctctctctctccctcccccctccctccctccctcccttccttccttccttcctttctctttctgtcttccttcctcactcccttccccctctcctgtctttctctctctctccctccctccctttttaaaaaataagtatatagttataaatctctgggtcataatatatgtagtcctttatctttacactttaacctatgctgtaataacaattcctttttttttttttttgtttgccaatttggtcattataacatgctatctcaccgatgcttagtctttattttctaaattgctaatgaatttgaagaaatttttaatattatttgttaggaataaatgtttgtttttgtttctagcacagtatgtttctgtcttttgcccattttttctattatttgtttttctccatgatttgcaatatttttatttattctgggtactaattttaagcaattatcttgttgaaaatatcatctcccagagtatgtcttctttttatgtttttccccctggtgttccaagttgaaaacagattttttgttttttactaatgtagtcaaaacacattatcattttaatttatgattaatacttttcagtattatttaagtaatctcagcagaacccatgaacataaaatactcttctacattctcttcaataaaatctccatttttggctttgcatatttaaggctaatcaaacttaattgttatgtgtgagatgaggaagaaatctttgttgacttttgctatatagaggatcaaatgtcctggcacagtatattgtatactattttatttgcaatgctggatctttcttttatcaagtttccagttcccatatttcccacttgatttttttactctatgtattagtccattttcatactgctatgaagaaatatctgagactgggtcatttataaagaaaaagaagtttaatggactcacagttccacatgagtgggaagtcttcacagtcacgaagcccatgaaatcattttgcagaaggcaaaggaggagcaaaggaggtggcaggcaagagagcatgtgcagggaaactgcccattataaaaccagcagatctcatgagacttattcactatcacgagaacagcatgggaaaacctgccctgatgattcaatcacctcccactgctccctcccatgacacgtggggattatgggagcaacaattcaagatgagattcgggtggggacacagccaaaccatatcatttcgcccctccccaccccaaatctcatttcctcacatttcaaaatcatgccttcccaacagcccccaaagtcttaactcatttcagcattaactcaaaagtccacgtccaaagtctcatctgagacaaagcaagtcccttctccctatgaacctgtaaaattaaaagcaagttagttacgtcctaaatacaatgagggtacaggcaatgggtaaatacacccattccaaatgggagaaattggccaaaatgaagaggctacaggccccatgcaagtccaaaatccagggaggcagtcaaatcttaaatctccaaaatgatctcctttggctccatgtctcacatctaggtcactctgatgcaagaggtgggttcccatggtcttgggtagctctgcttctgtggttttgcagggtacagcctccctcctggctgctttcacaggctggtgttgagtgtctgtggctttttcaggcacacaatggaagctgttggtggatctaccattctggggtctggaggatggtggctctcttctcatagctctactaggcagtgccccagtggggactgtgtgagagctccaaccccacatttcccttctgcactgccctagtagaggttctccatgaggactctgccctgtagtacacttctgcctggacatccaggcatttccatacatcctatgaaatttaggtggaggttcccaaacctcaattcttgacttctgtgcacctgcaagctgaacaccatgtgtaagctgccaaggctttggactgcaccctctgaagccacagcctgagctgtatgttggctccttttagccattgcttggatgcagggcatgaagtcctgagactgcacaaagcagcaaggccctgggcccagtccacaaaaccatttttttcctcctaggtctctggatatataatgggagggactgctgtgaagacttccatcatgccctgaagacattttcctcattgtcttggtgattaacatttggctcccagttattatacaaatttctgcaactggcttgaatttcttctcagaaaatggtctttttattttttatcacattgtcaggttgcaaattttctgaacttttttgttctgtgtcccttttaaacataagtttcaattccaaaccatatattcatgaacgaataaaactgaatgcttttaacggcacccaagtcacatcttgaaagctttgctgcttagaaatttcttccaccagttaccctaaataatctctcaagttcaaagttccacagatctctagggcagggacaaaatgctgccagtctctttgctaaagcatagcaagaatcacctttggtccaattcccaataagttcctcatctccatctgagaccacctcagcctggactttttggtcaaaactattcaacaagtctctaggaagctctaaacttccccacattgtcctgtcatcttctgggcccttcaatctcttccaacctctgcctgttactcagttccaaagtcacttccacatttttgaatcttattagcagtgccccactctactgataccaatttactatattagcccattttcatactgctgtgaagaaatatctctgactgcttaatttatgaagaaaaaacaggtttaatggattcacagttccacatggatggggaggcctcacaatcatggcggaaggtgaaggaggagcaaaggcatgtcttacatggcagcagacacgacagtgtgtgcaggggaactgcccatttaaaaccatcagatctggtgaaactcattcattatcattagaactgcaagggaaaatcccaccccaatgactaaattacttcccaaggggtctccccatgacatttgggaattatgagatttgggtggggacacagccataccatatcactttatgttatttgtttattcctgcactacagatttataggatatggtattgcttggcagacaaattcacctgtcttaattttcttaagagtatctaggccattcatggatttttgtacctttatgctcattttagaaatatgtattcaagtttaggttcagagttaagttgaaatcactttttatccacagactagaatggctaacacatttttagtcttatttaaaaaatctcaatctaacctctgatcataaagacctttactttttttgtctttttaaaattattatattgggttcttggccaatttccatttgatttgttcctaagaacactgtatttttgttgccatggtaaaaggacattattagttaaattttctgctccttgctttgtagagaaataccatttttttctgttgatattctatccagcaaccattatttataatactttttgttagagtttcttgaattttctttgtagggagtcattttatttgcaaatatgacagttttgtttttccttttctaatctgtgccttttaattttttttttcaagtttattggttggaagaaataaaattgcttgcactaaaaagtttacccaaatatggatttatctgtaacattgtatagcctgatcttctgtgcccttaatttcctatccccagattactttgttagatctggatgcttgattacatttagatttcgtgtgtgtgtgtgtgtgtgtgtgtgtgtgtgtgtgtgtgcgttataatagatgatattttatatttctactatgagtctcataatgtttattcatctcatttcttgagatgttgccaaacccaattatcattgcctagaactatttgctagactccaaaaagtggccacaaattattctcttccctcttttctctgctgtctttgcaatagacttttccactcctcccatgaaaaatggaattcacttcttgccctcttgactctgggctggtgttgtgatctgctttcatcagcataatccagggcatatgaatttggagggcttaagcacaggactcaagagaccttctattcttgccctgttgctgccctgaaactactagccttctttaatataatatgtagagagaaaggttgagctgagagtcagtaccaactgacagatatgtgtgaagtcttttcagacaatctgactcgattgactctaaatgtatgttttctaggggagaccagcatattgacaagtttagcccttatattcacagaattgcctgtccaaagaactgtaagctaatacgtgactgttgtttgtaaatgaccgcattttaagaatatgtattatgtaataacagatacgtgatataatttttgtatttattatgggctactaaatgatgatattctaattctatcaatacttattatctggaatacttgtgtgacactgaccactgactaatttcttccttggcctcctccagcctgcggattttcagcgtctcattttaaaagagtgtcatttcttcctctggtctcctcttctaacatttctatttctataagtaaatgtcaatatatctccatcccacagatatcttcagtttttccatttttgctatctacatgagaatacctgattgagtgaaaaattttggatttcaaaactatatgccctgttggggcttcataaactgatttataaatgccctcatcctcacatattcacaaaatgtcctgtttctgcttttaggggatttttgttattttcgcaatgcattcaaacaagtaaaatgaactcttagaagctaaaatattacattgcacaaaagcctaatgcataattggtaatcatgtatttttgtatgattaaagctaatatattcactatatgtaaacatgcctaagtagatttatttgttgttagaattcattttatgtatttccaagtacattaatatacatacatgttttaaagacttaaccagctaaatattctgtagttgggaaaaataaagtatttaccctttgaattttgaaaaatgtgttttattatatacaagcaagtcatatataaaatatgttttgatttcacacactataattaaatttcataatataaaaccaagctcagtcaattcttttatttatcactttttattcaggtttaatttaacatatctttgggattaaactacaatagttttctactttattcctttaggtattttatgataaactatataacatctctctgatctactcaggaggggctgttagataaatcttttgattgcagtaataaacacaaccgtgtctcaatttcctctttccaaaaagggtgatttgtgaggtttaactaaaatatagtatttgaaatagaaggcaacaggtaagtaacaggattatttacataatatattttcacaagtaaatataattcacaattatacctttgttgtttttgctagtaaaacaaacatgttaattaatgaggattttttttcttctactggatgagagatcctcttgagctagctcactgcaaggatcccatagcagtctaagtcatagacataaaaaagtacatagttgttggacctgggaactgggagtttgggacttacagctgctttctttcaccattaatgcactgatagtgtctatcagttttgcttttgtctgtacatctttgcatgcttgctttcttttcttgtctttttttttttttgcccatatttttctgatgtaaaacaatgtagacacatctccctgactctgggaaagttgaatgaagaaatgcttggaagggtgagacttcaggctgctcacagactattacttgctatcgtcagaatgtttgtgtctcctcaaaactcatatgtttaaattctagcccctaaagtaatgaggaggtggtggggcttttgtgaggtgactagatcatgagggtggaaccatcatgaatacgattaatgcccttatgaaaggaaccccagggagatccctcttcccttccaccatgtgagggcacagccagaagtatgcaatccacaacacagatgagggccctcatcagaagccaaccatgccagcaccctgatcttggacttgccagtctccagaaccatgacaaattaaattctgttgttttttaagccacccagtttatgatattttgttaaagcagccccagcaaactaaaatagcaatttttatcttcatttcttttactcatgatgtctccctttctctgtgcatctgcttctcttggtccctctctccttagcagttatgtctggatctttacattctccactttcctgtacccactgctacagaaagcctgtctcattctcaaagctccatgaactacttgctcaagttcccaccccccaactactcatcttctttttggcctctgattcacaagactgagtacatataaaattgtctcagtgtaactttgtgaaatacgtcacatatcataggttatggcactttcttgtcaggagctcactcctaaactagtagactgaggttcacaggttgtgtcccctaacaagacgagggaggaactcaggaaaggacaggacaaggttaaggaatgacgggtaaccctggtagaaaaaatatggctctcactttccaaaggaagtaattgtgctatcttggataattttaaaaaatattaacatgtaaaagtcacttaaaatgatatagcaaataaaatagagttaactatcaatgaacagatttgcttaacttacagtccagtcttcaccaaagagcacatcctagagctctttctgtccagcattatcataggatgatttgagagaagttataattatggattaatatgaaagaccaagctgaatctcaatcccttgagattccatccattaattaagtcaggtcacccaagaattacatcctgggaccatatggtcctgaaagcttgcagaattgcagctgcattttggcagcttttccactgactcgcatgaaaggcttctgcaggaaacagcatcaggcaagaacacactgaattatatgcaaggaagcacatccttcccctcagtacatcctatatgaaatccactgtcacaaggttatattagagataatctatggggaagtcttactcttccaggataatgttttatcttcaatgacaatgaatgctacataggtaaccatctatgtagctctctttcattttgcagctaggaaattcagagccaaaatctagacttttctatgactgtcatcttttaaaattcacttatttaacttttaacctcttcctcccctcccctcaatatcatagttataacttcttattgtaatgcataccttcattttaatcttttagttaaaaaaaatcttgccttttaaatgtttgtaaccttagctcaggtggttgcatgtatataacataaggctccactctgacccaaagagaatcatcataggatccaagccagatatatttctctagaatattagttccattatatctctactggaaaaaaaagtctttatatatccctttgcttacagcagaacgacaaaatttactgttcagattgtctcctgttgtgtgtataaattcttacctccatgtgcttcctcatgtggttccatttctccagggtgacttcattttttacctgacaatgaacgttcatacagaatatcacgtcagtttatgctgctttgtacttccttaaattattttaccctccacctacactttgaaatccaagtaaaaacctaagatttaaccctgctgatccagatcacaataattccttacttctctgacttcttccgatagtatttattaactgcatcaggaagtccaggttgacttcattgaagtgaaaatctgccttttgagcggctgcctagataaaaggtttttagttttgttcatacaattgtgtctttgcacatgttcatcttcttatcagtggtgaagaaaggagttaacatcatggcactatcttcaaaaggtcttgctctcagggctggcctttgattgacatctgggagcttgactgtcacaatagtttctccactcctagttgataagtttgttttgctacgacagggttgttggtacaaacaatgtgatttatggtgaaaacctgggcagagggtatctatgtgaccagctaccagtaaaaatctaactaaataataaaacagatagttatagtaagtaagccaaaaaaaggaacacaatacagagggacaaatactcaaaaggaaaattaacaacatcaccaaaaaccttagacgtaagtacaaaggacaccagatctgtgagtccttctgtgaatcaccaaacatgtggctggtctttgtgacttctgaagaccacctgaaatgctgttaaaaatgacagtgggctgggtgcagtagctcatgcctgtaatcccagcactttgggaggcccaggaggtcacatcacctgagatcaggagtttgagaccaacttagccaacatggtgaaaccctgtctctactaaaaatacaaaaattagccaggcacagtggcgggtgcctgtaatcccagctactcaggagactgaggcagaagaactgctcgaacccccgaggtggaggttgcagtgagccaagattgcgccattgccctccagcctgggcaatagagtgagactctgtctcaaaaataaataataataaaaaaaagacagtgaaggtataaaataggtataatttcacaacgactaaaaaggggattggagtgagcaatagtgaaagagcacatcacagtttggcagaagaaaagtgtgcaaatttgtccctaagaaagtgtagcgcagaaaacagagaggggaaaaaaatgagagttcaggccgggtgcggtggctcacgcctgtaatcccagcactttgggaggccgaggcgggcagatcacgaggtcaggagatcgagaccatcctggctaacacagtgaaaccctgtctctactaaaaaatacaaaaaaattagccgggcgtagtggcgggcgcctgtagtcccagctactcgggaggctgaggcaggagaatggcgtgaacccaggagatggagcttgcagtgagctgagatggcgccactgcactccagcctgggcggcagagacagactccgtctcaaaaaaaaaaaaaaaaaaatgagagttgataccagtgtcagtccttccgcaacccccaaaaagctcaggactgaaaagccacgcacaagggaaggcaggaatcacactggtgcctaagggggttattggagtcaaagaattggagtcaaaatattggagtcaaagccctctggtcacccacactggtacttttataagctccagagattagctgctttcattttaggaaaaaaaacgtcatttttaaaaataaaaaagaaatgactccaggttgatctgcaatttcttaactatctccctaccagtgtggcacctgacaaagcctacccaggtgccacgagttttcaagcaacatctgacactttcattcttgtatgtgatttgacaatccaggcttatcagacatctgagcagaattgtaccgcatgtgagagctatataaaaacatcattaaacaaaaaacttgacagtttgttttgtattaaattctttacctctccaatatagcagaggcctcaggcagctgttttatgcactgaacccagccctgtgtggaggtgactcacccaagctcagctgagcggagtatattcctcatgcatttggtccgtctacatttgtaagtttggcaagggagtgagcatttgtttttatcttccatatggcaggaaaaaaaaaaaaaaagcagcagcagcaagcctgatgaaagaggggattaaataaaaggagctgagatgagctgagatgagaggtggaaaattagaaaggatcccagtccatgctgatcccttccatggagcggctgtctgcctcctgctgagacctccgcctcccgctgagtcctggagacacctctgtctgctctcacagtttccctgtcctgattagactagctccagtgggagaacagagatctttatagactgccctggttggattttcaattgcatcataattaaattcaatctcagacatatgcattagaaacgtaggtttttgttttttaaatgaccagaacctagcacattactatatacagggcaggctctcgctttctctcgaatatgcataatatattaaatattattatagatattatattattttaatatgttatgttatgataatagattattattatgaatattgtattattttcatatattataataatggaataacatatattattatagtaatatatttgtatatgtaactcagtaagttaagaatgaacatttttattttcattggcttctgtttctcggccttctgagggtatcatcaatcattaactctatccctaaagcttgtagccagggcaacgtaaagggttcttttcatccttttacacttgtggcagcctttgtcacacatcgcctcattacgttcactctgacctgttctacacctaaaacccggaactgctgccagtctccacaatggctctcccacccacagctccctcttgctcgttggctttgacacagggcatctgtcccttggtcctacacaggctgcgctctggtttcagctccatcgcctgctctgagcaaagaactcgctccttaacgactgataactggaacttaactctgaagctccctaaactcagctgcagccagctagcttcatttcagccccaccacgagaaccaggacaaccttctctttttcaaatgaagttggcaaaaccaacactactctacccacaagcatgttgtcaagatcaaactgaacaagtaactccatgtgaatatatttgttttagatagcatagcatgtgatattggcctgtattgtgatacaagttttaataacacatgctaccctgcacaaagtcaatcctttggtgaaatttagtagagagtgatgattaaatgaaagtaatgggtccatttagatcagaaaatattaaaattttgccaaagaaagaaaaattttgccaaaaaatatgactattttcaaaaagttagatcatgtttgaaagtgtaaaaggtgttcccaccacaagatgttaattttggctccattcacggtgagaaaaacaatgaatctgacataacttttctttcttaggtagtgctgtttgtttcacagtaccctgatctcatccaggtgttttaaaactgacattttatttctgattttttttttgtgcataagtatagaaataagttgagcttcctagagcatacagtatcatctgttatttctttttcaactaaagttacagcactgactcatttataatttcccggcatttggcccatctttaaaattcttaaaattatagctaaaagccttgcagagacttttgccaacaccttaagtatcttattaattgggtttgaaaattatgtctagactggacattcaattcattcaattaaaattaatgagaatgcataaggctgctggttcagagttgagttcttgccaacctatctctaaccaaaagtaaaatatgctaaattttggacaaagtccctgtcacaatcaccgaatgatcacagagtgcttcatcattgccagtgactactcaatacccctttccactatttctaaagttcccattgtcccatggaattgatgaaaatcagtaaacagttcttggctgtagctttgacacatagtgtggtgtatttcagggtaccatgaagcctacggttgttttgcaggattaaatagtcctgggctggctggaaagacttatttgaagttgtggaaaataaatgtttgaaaaaataatttttaaaaccaatatttacagagaagaattttgaaatatttttatttgtcttatttgattttctttagactcaagctccaccatttagaaattattcctctggttctagttgaagacatgattgcattggaaagaaacatattgaaaggaaataatttaattcagaccattagtaaacatacttgtaatattattttattcttagctatccaagtaataatgattttctactcctgtttgtcatagcaacaatgtcaatgtgggtttcaagagtgtattacatgaatttaaaataaggaaaaactgtataccacaatattcttcctcactggactataagaagacttagacattaggatggtgtctttatatattttgatttccctcatagctctatttccatactttgtatctgggtttcgccattcaaatattgctcaaataaataaaatgaatgacttggatttgaatttaccattttacctatcaattaaagcacacggtggtaactgtattcccttccatgaaattttgaatgtcacaaacttaaagtgcatgaagatagacatttaagactctatctagtcttggagctgactgtataaccaaaatggaatagtatggttgcagttggggaaatgccatttatcacattagtctagaattccttctgttctgaaacaaatacccaggcattatttttagcttatatataacttgcaaagagctgtacttggatacctaccaaataaaaaatgttaagtataaccatagagacattctttcttattctgaagaataaaggcatatcatcaaggttaaatagaattatgtggttttaagtaattatgatttaattagtagaaaccagatttttagaactagaggattttatttcttggtcctttaaaaaatgctgaaaaaaaggtattccaaatgctaatcagtctttgtaatggttggtgtaaaatctggtgacataaaagtgacctttgttccagtcccacccccatcctaatgcacctgggcacctggaacaaaacactcagcttgtggttctgagtttcttattgtgagaagtaggagccagattctctaactttctatggattgcattcgatgacttttttgttcttatccagttatcatgcttattagcatgatatcattttcaaccagttaaattcattaacaaatgaagtaagcatgtacacttagctggatgagaaaatgctcatgatccacagcagtgaggctcttctatgagcattgtttcatcatcccccttttagaatcaccctctgcttccacctcctacagtatgaatgggtcatttaatgctaccaaattattttccactctccaaggatctgctttctagctaccttctgttatcttttgaaaattttccatggaagttaccttctgtttgccacatcattttttctccctaagtcaccattctcttctagatttccatggcatttgacgctgttacacatacaatccactgtatgctttccaatacttcattatgttgcggtttatctacctctttctactgttttagcaataaaacagtccataatacctttcgttttttaaatgagacacaataacctgaaactcttacacaagtgaatattttccatgatgcttaaaatgtgtacacctcccaattttatttacccggcaaaatttactgagcacttattctgagcttgccactgtacaagagattctagacagaatgatgagaaaataggcaccatccctgccttttatgtggcttccagtctagtgggaaagacaacaactgataaagtaggcatatgataggtgtttactgataggtccttctaagggaagagtctcagttctatgccagccatctgaaagagcctgacctagctgtgggggggggttccattttaggttgagcagcaggatgtgaaaaggaactgtggcaggaaatatttaataacatggtgtgttttaagaattgaaaaaaatgtatttatatataaaagaaaaaaccaataagttatgtgtgtattaaaaatatgatgctctgagtaatttactatgtagctgaggttaccgtgggatctgacatccacccatctgtctgttgagaagacactttatacagatctctaaaaatacccttgttgaggcattttctcatcaaaatagacattgtctctctcatatcccattagttgtgttggaaagaaacatattgaaaggacatatcctaatatggaccattagtaaatatatttgtaatgttattttactcttagctatccaagttcttacgaatatagaccattagagtaatgagttaccaatggtagagcctttggccttgcaattccacaaatttcaaatatttttatctatctatctatcatctatctatatctatctatctatctatctatctatctatctatctatctatctatcatctcaatcaatcatctatttatcatatatcatatctatctatcatctcaatcaatcacccatctatctatttatcatatatcatatctgtctatctatcttctatctatctatctatctggatatagttagtgtgctcaatgtgtgtgtgtgtttaggagattggaaattctagcataaacaagtagatacatgaactgatggacatatgaattaggtatggctaatatccctagagctactaataatgtttaagcatagaagtagttcttcctcatcagctgtggaaggccgttttgaacgggcactctgaggacacaggaggagatgtggttgtctgggggaagaggcaatgaaaagaacacttttcttcctagaaagggcttctgaggagcactttctctgaggagcactttttctttttctcttcctgagtcagagaggacttggctctcaataatactcattgtgggatgactcttcagagggatgcaagatgcattgcttccttcagagacaacagttatgccatccatgacctctgttccttacagaactcccaggtaggagctacaacatatactgtgattctgaatataaatctctgtcatattggccagggtttctcatcagtaaattgttagtaaaattttccttctgcatgaaaatttgaaactcacctatttagaaataaaatttatctcaaaaagaaaaatgtatcttgggagtcttgtactttacaaatatagtcaacattattagttctgacccactaaatcaatccatcagtattcaggcaaaactctgaaaaatgtaaccatgattttcacaaagtaaataaaaattacaatggtgttataagtaatgatctgctctctacaacctactgtaaacttttctttcaaaatgatctttctaaacaatgtccccagatgacaaagtatgcaatagagtttttcttacgccagttttaatttctgtgtatattcccaattaattatatatcctaatatttatgcggccctctgtcacttgcaaagtgctttcacacttttacgtttattattatctcatctcaaattaacatcactctttggtaaaaacaagtgggtattataattccaatttgagtggtgaagaagagattcaaagaagttaattatttgcccaacatcaaataaaaagtgatttgcagagctaataagagtcgtaagtatttactagtcaacaaacacatcctggtccttatgacaggtgtgtcatatacattcccctataatgcttgcctcagccttcgaaggaagataatattacctccaattaactatgatcaccaagttaacccaggtgagtaagtagcggaatctaaaattacagtggtgttacaaattaaactagactaaactaagagcatttcactgtgtgttataatatagttttctctcattcagattagctttgcttttttcatctaataatttatatcgagacatttgttatcatagaaaaatttgggtacatatttttcaagtcaaagaatgacatataaaataatttatagtggagacagtatctttttaaaaagtaattcttttgaatggtaattttctatcggattaccaagttcttctccctgaagagagctttaataggagagtcggcatatggcaatgttgacttaggtgttgcaacatgaaataactggaaatgtttaactcatgttcatacttatttaattcttttagacattcctcttagtgaatatttagataatggagtagagaagaaatcctatggaaactttatcatcatcatcaaatatttatttctaagcacctcacaaaataaagaagatataacttcttcctaaacctataaatccgaaaaaggggatctaaagactacacatccagaacgaagtatttttcaaataattaattaaatttatgcttacaaataaaaaatcaaataggtttaaaggaataattaaaattaagaaatattggggaaatatttgaaggtaaactttctatctaagaggatatgggtcaaactgatgtaattgacaaattaccatagtaatttttaggagctggtttgataagtttatagagtagaaacaaatgaagctatctatggtagaaaagagtagatgttgtcttcctcaaaaaattacatattacacatattacagtgcctgcttttttaaagtaaagtgctcagatgttggggaaaaaaaacccatttttgctattgtttcagtatctctgaaaagagattacttcaatttttggtgctaggatattgatattatcataagatatagcacagtgaactaaaactggctcatgaatttgggatttttaattaaaagaatgaatcaatcaccgtggagattcaaccagagtaaaagcttcaaggaatggaatttacatcatcttaaattaggttatttttcagagcattactctttagggacgttacctaccttaattctagtaagcaagaagacaattaaaggtaatttatatgtttttctaatattacttttgaatattaatcctgaagaattatctagtctctgactctcatgtacattgctatttgactcattacttgaaaacacttgtataactcatattaaacaatattagtgttatcaatgcggccacagctctgtagttattgcttggctgtgcggacattttacttctccatatttctattgccacttagttccgttgaatttgattgtctattttaaggaacaaaaatcaacttacattaggtacaggagttaatggggtcattcattcacaaactctcaaagaaccaagtaataagttggtttccatatgtagcactgccctctactgggcaaagaaaagtctgatgttattaatggttttctaatttcagtacttaaaggcagcttagtagaaaatactgatagagatattcgaattgaactaccctgatagttttttaaggtgaagagcctgattattattatagaatatgagaatcttaacattttgtaaagacattttacttccttttcctcttgttttgattaaacatgatctttgatttgaccttagattctttcgaagcttcaacatatgaaaaatatggtatattgtactataaactagtaatgtaataatgaaattaaagtcaatttggcattaattcaagggttttttatttgaatttgctcttggtagacataaacaagtatctttatttttaaaattgtttataatttattttgtttataactttatattgataatcagtttatatttggatgataatatttggatgtttgctttaaggtataccttatgtaggatatcaacaagagactgtgaagtgttatcttttctcattttctccttactctgttacaacgtagggcaggggttttaggaaatcacaccataaccagactctgttaattaccgtaaaagacaaaagttcaatacaagtttttagtgtgctcataaacataaaatctaagtaatgttgaataacattggaaaacatgattagttacatcagcaaatgtaaacagtttggatcaaactgggtaatacaatcagcattagatgtcagaactcacggagatggcaaaaacacacacacaatatttttccgcattgtttccatgatttgaaatctaatgaagctcacatcttttaaaattttgcatgtcatattaatatttgtctcagccaaacttttacaagatacagaatgacagaagactcgatattattcccttacaggtatctgtaatgatattacatgtatttgtcggggaagaaacaaacttttaagaatcagctgaattaaggtagaatttacacccatctgtgaaaacagaggatacattgaagacatttgccagttaggccgggtgtggtggctcaagcctgtaatcccagcactttgggaggcagaaggatcacttgaggtcaggagtttgagaccagcctggccaacatggtgaaacctcatctcattctcaaaaattagctgtgtgtggtggcgcacacctgtaattccagctacttgggagactgtggcaggaaaatcgcttgaaccctggaggcagaggttgcagtgagccgagattgtgccactgcactccagcctgggcaacagaacgagactccatctcaaaaaaataaataaataaagtaaagatattcaccaggtgggagcaaaggggatatcagatggcagggccaacattcttctctgaaaatactttttgttgactctttttgactaaaatattactctaacctgaaagtggaaggtaatagacacctttcagtgaggatttttttcagaaagatttaccaacaattttttgcataatgatgatccaaaagccatatttttcagtagaactatatttataagaattctaaagagaatgaaatattaatggtgtctatttcttttaaaagtgatatggctggtagggatgcagtaaatgccttgaagttgtaccgcccaaaatgccttaaatcctattactgagcattcttggggctattgtgaacacttacctgactttcaatgcacattctaagaataaaagcatccatcatgacattaccccatccaatatccttgatggttttctgtcatatattggttaaaatctaaaatcccccttattggcatgagaccctgcagatcttacctctcttttctcctaagcttgatatccactatgcatggcaggtgtacctacacagtcactcacatccagtgaacaaaccatatcaaactcttctatttctctaaaacagaaattcttcatagtacacagagaagacatgaaaagaatctcattgatctacaatataatgaatagaagatacttaaaatgttgtcttcacaatcactaacttaaatttagtggttctttcctttatgaatgtaagcagacaaccatcataagaagtacttgattcgcacagatcacacaaccaaaaaaaaagaagtccttgcgactttctcaccaatagaaattatctctatttttataatattttgtacttgttgcagatactcaaattgtcattaactgatgattactttaaaattatagtaggtataagagctaacattagagctatcctaataatcagtaattaagcataaatttcattacacattttgtaatgattagataattgtgcttataacttttttgtcatcatatttttaacgttatggcttatttagtcaatttataattaatgtaattatcaatatatacattttattcttctatttgctttctatttaattttttaaaaatcatttttctaatttcttgccttctttgtattaatcaaacatatttttgtcattttccctacaattatgtcaattaaacatgattttagtattcttttaatagttaccttggagattacaatttatgtcattgacttacacagtctatgacaaattatttctttacatgtgaaaaaactctaaggaactaaatatcacattgataataacatctcaaaaaataaatacagaacaaatccaagtaagttttgaacggcctgtgtcttcagtcatatataccttcaatggaatacaaactaaagataaaaagaaacaaacagaaaatgtggactttatttagggaatttttgttgttcgtgtcatgaaagttctaattctaaaatgacttgatgtgtacagtagaattaagcaaatgaataactgtgtaaatatttgggaaccagagtttttttctgtgagagaagagcttatgtatatggactgaggaaaagagagggagatcctggtgatgaattgcaccaaagttttgtttttgttgtttaaccataattttctaattgttagggtgaagtgacagtcatcctagatttgttcatcctatgtattagtttgttttcacactgctatgaagaactatctaagactgggtaatttataaactaaagaggtttaatgactcacaattccacatggccggggaggcctcaggatacttataatcatggcagaaagcaaagggtaagcaaggcatatcttacatgctggtgagcggtggggggaagtgtcacacttctaaaccatcagctctactgagaactcactcactacatgagaacagcatgggggaaactggccccatgatccaatcacctcccaccaggtccctcccttgacacatggagattacaatttgagatgagatttgggtggggacacagagccaaactctataattctgtccctggcccctcccaaatctcatttttttttcacatttcaaaactaatcatgctttcccagcagtctcccaaagtctcaactcattctagcattaactcaaaaggtcaagtccaaagtcttatctgagacaaggcaagtcccttctgcctataaacctgtgaaacaaaaagcaaattagttacttccaagattaaatgtgggtacaggcgttaggtaaatacttccattccaaatgggagaaattggctgaaacaaaggggccacaaggcttcatgcaagccccaaacctgacagggtagtcatttaatcttaaagctctaaagtaacatcttttgactccatgtttcacaaccagggcaagagatgggtttgaatggccttaggcaacatcactgctgtggctctgcagagtacagctcctgcaacgtcttttgggggctggcattgagtgcctgaggcttttccaggcacaaggtccaaggtgtcagtggttttacccattctggggtctggaggatggtggccctcttctcacagctccactaggcagtgccccagtggagactttttgtgggggctccaaccccacattccccctttgcattaaggttctccatgagggctccactcctgcaacagacttctgcctagacatccaggcattttcatacatcctctgaaatacaggctgagacttccaaagcccaactcttgtgttctgtgtacaggctcaacatcacatggaagccatgagtgcttggggcttgtaccctctgaagcaatggcccaagctgtaccttggccgcttttacccgtggctggagctggagcagctaggaaacagggcaccatattccaaggctgcacagagcagcagggccctgggcctagctcatgaaaccatttttcccttctaggtctctgggcctgtgattggaggggttgccatgaagatgccagaaatgccctggagacattttccccattatcttggctatcaacatacatctcctcattacttatgcaaatttctgcagctgatagtttgaatttctcttcagaaaatgggattttctttactactgcatggtcaggctgcaaattttccaaacttttttattatgcttcccttttaaacataagttccaatttcagattatctctttgtgaatgaatatggctgtacacttttagaaagagccaggtcatctattgaatgctttgctgcttagaaagctcttctgccagataccctaaatcataactctcaagtacaaagttccacagatctctaggcaggggcaaaatgccttcagtttctttgctaaagcatggcaagagtgacctttgctccagttcccaagaagttcctcatctccatctgatactatctcagcctggagttcattgtccatatcactattagcattttggtcaaaatcattcaacaagtctctaggaagttccaaactttcccacatcttcctatatttttctgaaccctgcaaatgatttcaacctctgcccattgcccagttccaaagtcacttccacatttttaggttatcttatagccgtggcctactctgctggtaccaattttctatattagtccattttcaccctgctataaaaaactacctgagactgagtaactgacaaacaaaagaggtttaattgactcacagttctttatggctggggagaccccaggacacttataatcatggcagaaggtgaaggggaagcaaggtacatcttacatgtccataggagagagagagagaaagagagagggggagtaccacacatttaaactatcagatctcatgagaactcactgactatcatgagaacagcatgggggaaaccaacccctaaatccaatcacctcccaccaagtgcctcccttgacatgtgggattacaatttgtgatgatatttgggtatgacacagagccaagccatatcattctaggcagaagaagtttctcaaaaagatgatgttgaaaaccttgttgtcaaccttgaatgaaagaaagtcctaatggggcagaaatgaaaagggaagctgcacaccaagtgggagctgcaccatggccatcataaggattttgtatctaggtaaagctcctagagctgctggctgcgaagttattattcaagaagtacatgacagaaaatccttggttgtgcacaagggagggagcttaaaataagatccttgcctaatggtgggtgcgtcaaagtgctgtcctgctccatagataagaagacaagaggaactacatactgacactggaaagtggttgggatggctgccaccaaaaaaattcttggatgaatggatggaaaagccaacttccagaactacaaaactctaggtgtgagttgctgtgcataaaattaacataaaataagtgaaaagaccagtgaaacttcatggctctgaaatggggaaaacagaccctagaagagacatatttgcctccccataaacaaattaacaaacaaataaatgtatctcttttttttagatggagtctagctctgtcacccaggctggagtgcagtggcacgatctcggctcactgcaacctctgcctcctgggttcaagcgattctcctgcctcagcctcccaagtagctgagattacaggtgcccgccaccatgcccagctaattttttctttttatttttagtagagatggggtttcactgtgttggccaggctggtcttgaaatcctgacctcgtgatccacccacctcggcttcctaaagtgctgggattacaagcgtgagccactgcacatgaccaaataaacatatcttatatagtttgtatatgttggtcaaacctcatgttcatatataatccccaatattggaagtggggcccggagggaggtgatttgaacatggtggtggatttctcatgaatggtttagcaccatccaccttggttctctccttacaatagtgagtgacttctcatgagatctggctctttaaaagtgtggcactcccactctcctgctcctgctttcaccatgtgaaatttctgctcctgtttcactttccagcatgagtgaaagcttcctgaggctttctcagaagcagatgctgctatgcttcctgtgcagcctgcagaaccatgagccaattaaacttcttttcatataaattacccagtttcagatatttctttatagaaatgcaagaatggcctgacacagaaaattggtactgaggagtaaggcgttaatataaagatacctgaaaatgtggaaacagctttggaacttggtaatgggtagaagttgaaagagtttggagggctcagaagactagaagatgagggaaagtttggaacttcttagagactggttaaattgttgtgactataatgctgatagtgatataaacagtgcagtccaggctgacaaggtttcagatagaaatgaggaactttttgggaactacagcaaaggtcacccatgttgtgccttagcaaagaggttggctgcattctgttcatgccctggggctctgtggaagctagaactaaagagtgttaatttagttcagagatgagagaaagaaggagataagaggaaatcatgtgggagtaaagaaatgacctaaggttcaaacttatatttaaaagggaagtagagtgcaaacgtttagagaatttgcagccttacaatgtggcagagaaaggaaaaacttttataggagagaaattcaagcaggctgtggagcaaccacttgctagagaaatttgcataactcaaagggagcccaatgctgatagccaagaaaatgggaggaaggcctcaaaggcattttagagaccttcatggcagccccttccaccataggcccagaggcctaggaggaaagaatggttttattggccaggcccaggtccctactaccctgtgcagcctctggaagctgctccccacatcccagccactttggctccagcctcagctcaaagggccccggatacagcttgggctgctgcttcagagggtgcaagccttatataagccttggcagcttctatgtggtgttaagccttaggtgcacagagtgcaagagtgaaaaacgctagcagcccctgcctagatttcagaggatgtgtgagaaagcctgagtgcccatgcggaagcttgctacaggggtggagtcatgacgttgaacctctactcaggcagtgccaaggggaaatgtggggttggaacctccatgcatagtccccactggggtacagcctcatagagctgtgggaagggggccaccattttccagaccctataatggtagattatacagcttgttccctgtgcctggaaaagccacagacactcaacaacttgtgagagcagcttcacgcactaaaacttgcaaagtcagagggatagagctacccaaggccttgggagcccactagtgtgcccagtatgtggacatgaagtcaaaggagattattttggaactttaagtttactgactgtcttgctgggttttgaacttgcatgaagcccatagaccccttttggccaatttcttcctttttaaaattttaatttaatttaatttaatttttttttttttgagatggagtttcactctttcattcaggctggagtacagtggctccatcttggctcactgcaacgtctgcctcctgggttcaagcaattctcctgcctcagcttcctgagtagctgggattacaggcgcccaccaccacacccagctaatttttttttttttttttttcatttttcagtagagatgaggtttcaccatgttggccaggctggtctcaaactcctgacctcaagtgatcctcccacctcccaaagtgctgggattacaagtgtgagccaccatgcctggcccaatttctcccttttgtaatgggaatatttacacaatacctataccccattgtatattggcagtaaataactttttaaaaaaattttacatactcataagtggaagaaagtcatttccagataagactttggatttgggacttggacattttgagttaatgctggaatgagttaagactttgggaggactatcgagaagggatcattgtattttgaaatgtgagaaggacatgagaatggttgatatggtttggctgtgtcgcctcccaaatctcatcctgaattgtaatccccataatccccacgtgttatgggagggaccaggtgggaggtaattggatcatgggggcagtttccctcatgctgttctcatgatactgagtgagttctcaagagatttggtggtttggtaaatatctggcatttctcctactggtactcattctctttcctgctgccctaggaggaggtaccttctgccatgattgtaagtttccagaggcctccccagccatacagaactgtgagtcaattaaacctcttttctttataaattacccagtcttgggtatttccttatagcaatgtgagaaggaacttattcaatggccttacacaaaattcatcttccattaaaaatgagctccaaccaaaaaattacagaaaaagaagattaacctgaaagagaatcatcagtcaaacaagaattggaaatcatagataacattgaaagaagccctaaaatagcactaaagtggataaagtgataaaagaaggaggggctattgcatttataacaactgctaagtaaaagtctactccttcaaaattaatatatcaaaatagtcattttattttgttcacacttttgagagttggaaatttcaaaaaaattcatggtggacaatatttatctctgattcactttggagacgggagcaggaggatccactcccatcacagccctggactgacatgtctggttcactggggctgtttgacttctctgtctctctccatggcacatggtgtcttatcttccagaactttcaagggcaggtgctacatcctgtgacatggcatagggctttcaagagggggtttcccgagactgagcttcccaaaaggctgtctttggaaaatataaactgccacagtaggtaagacagaagattccccacaggaaaatagagagtttgtaaagtgtgtgtagtgcaagcgcataaggagttggaaaatgcagaactggaaagtgttaaagaaaaacagacaagagataagcagtgttgccttctgtcaactgggaatatcaaaaggagaatatacaaaaattttagaagatataaaactctggttttcttcagatatgaaaaaaactcttgattctctctatcaaaggaatgctttgaatattgagtgagataaaaaattcaaacctaggcacgttgtggtgaaactgcaaaatatcaaatacaaagagagacattaaaaaattcattaagtagaaaagccagataatgtacaaagaaaactcaatataatgtatgtcgtacttttaagaggtagagaagtcagtggctgctggagtagccaaaataggtttcctagaagaactgggtgtaaactagtctttaaagcctgagatttgaaaagtggtaaaaaaccaaagttcttttcctgggcacacacactctgcaagtatatgatttgaacatggtagaatatattattttaataaaggtaatgacaatggctaatgtttattcactatttataagtacagaatgatttttagggatttttcaaacattataccatgtaatctctgaaataatgttgggaggtggctattgtttttgtcattttatagacaaaatttaattgccaaaggtaactgatagtaagtagaagaatcagcatcataccccagatatgcttcttgctagattccaaggtcttaatgaccacatgataccctctaaagagaccaagaattctatctattcacaacacctctgccatacttactttccatgtgattaaccagagtttactgtaggggaatatgcatatggggaatgcgatttctcccaaaatacaactgtgtttgtagaacagcaagaaacataataggggtggtagtggggttttgcttttttatcttgattttctaataacagcaacccttgaaaaaataaatctcagatgaaattttctttatggaacaaaaagcaccttgccttactacattaacgctggaagaagaagattaatgtttccttaccttttcagtttattcactcttccttctatgctgtttagaaaataatggatatcaaaaaattgcttcaacacttcagacaaacccaaattgtggtctttgcaaccagccctcccttcccaccaatcatacactttggagtaacgactgaaattctgctatatccttcagattaacaatttatgcaaactcttaaaagtattctcatggattggattttaaactctgacataagggaaatgattattttatttgaagtgtgttaaacttaaaaaatatgtgatcctacttatgataaaatgatgtaacaggtttgtagccatgctttttacatcccacaggggctgaaaaacattcagatatagtatttaccaatatttcccttaactttctcatagatggtcataatcgttaaaacttatttatagactttttttctcttgactggcatgccggccatatgaaattgggtcaggaaagaacatcaaagtcttttaaagcttgtctccatctatgcatttttcttttgtacatttttatcttttgggggttttagatacattctgtctctacatttacaggctgatttaccaacatatttgctctgtgtttgggctggggatactcattcctggctctattctggaaaggtatgtgacagaaacttgtactcttcagaaggaagaacccataagaaaaactaatagtgattttctgcaatactgacctttttacaatactgattctgtcttctagcattatttcatttattagattgcacctcatcactattatagcttacctgtatattatcatttgtctttttcccctggcagacagatacaaatcaataaacaattctaaattagtgagcatattgtagtgtaggatgtgcattttacttttatatgtatgttgagtggggaagaaatgtaataataattctggaaacaacattaggtaaggaagaaaagacatagattctggttataactctgaccctgactggctggctatgaggtggggcaactgagtcatttggggttttatgtttctcttctatggaagtgaagtaaataacaaagtagccagtattactgaccacttattatgtgccaggaacatttcagactgttgcatgcataaacatatttaactgaaattacaactatgtgaggtattaataatattgcctctttaatttgagaaacgctaggtagggagagttaacttcccaagtcacacaacatttagagaaggattgaacctagggaatctatcctagtgtctaacctcttaacctctatattgcaactatttcccttaaagtggtaggagtgggtgaactatcttcacaatccttaaattccttccagttctaacatgacacaattcttaatctcctccccagtgttggtaagtaaaatacttagatagaaagtggaatttctagaagataaaatgcttaaaacatcaggaaatctggtgaaggcaaacctgaaaaagagatcttggtgagataggacatttttcaaaataaaagccatttagaggggatacctgggtggatcatggcggacgggaggcaggactagattgaagctccaactcggatgggcagagcagcatatggaggctcacatcgtgaatttttgctccagaatgactgcaggcataaatcaagaaacctgagaagacccacagaccttttgaaggaagtggattgctcctgcaggacctgggagacaccccaaatactgagtgcccaaactgtggaagtgggaaagggagaacatttgccctcaaacacacacacgcattggggagactgaaagtctatattatgagaagattcagatcataactggagctgagtcaacttagctgagcaaaatacgggggtagaggaaggaggagaaaaagccctgtgagatcactgggtcccctagcaagccatttttgcctggcttcacaggggtccttggggagggtggccacaggcactgggaaaaggccacaggagaaggatatctccagctaaactttgtaacaatttgaaactgattgcatagtctcctggccaacttgagggaggagcctggggcaagttctcagccctgctcacccaatgcctggaaatagactcgctgctgttggggaggcacggtgggagtgagactggcccttcaggttgtgtgggaactgggtgaagcctgtgacttctggctttcccctatttccctgacaccctgcatgacacagtagagacagccataatcctcctaggaacataattccattgacttgggaatctcacctccataccccacagtagtcacagcaagacccacccaagaagagtctgaggtcagacatgcctagccctgcgcctacccccatggtcttttcctacccatcctggtaactcaagaaaaagggcatatactcttgaggtttctagggccttgcccactgcctgttcttccccatactaccacagctgatgctctctggaaagtgccacctcctgccaggaggccaaccagcacaaaaatagtgcattaaattaccaaagctaagaaccctcacagagtccatttcaaccccctgccacctccactggaacagatgctggtatccacggctgagagatcacagatggttcacatcacagtactctgtgcagactacccccactaccagtgcagagcctggtaaatttgctgtgtagctaaatccagaagagagataacaatcactataacttggctgtcaggaagccacatccctaaaaaaagggggagagtactacatcaaaggaacaccccatgggacaaaaggctctgaacaacagccttcagtcctagaccttccctctgatagagcctacccaaatgagaaggaaccagaaaaccaactctggtaatatgacaaaacaaggttatttaacagccccccaaaatcacattagcttaccagcaatggacccaaaccagtaagaaatccctgacttacctgaaaaagaattcagaaggttagttattaagctaatcagggaggcaccagagaaaggtgaagcccgatttaaggaaatttaaaaaatgatacaagaagtgaagggggaaatattcaatgaaatagatagcataaattaaaaaagtcaaaacttcaggaaatgatggacacacttacagaaatgcaaaatgctctggaaagtctcagtcatagaattgaacaaatagaataaaaaaaattcagagctcgaagacaaggtcttcaaattaacccaatccaacaaagacaaagaaaaaaacaagaaaatatgaacaaagcagccaagaagtctgagattatgttaaatgaccaaagctaagaataattgttgttcctgaggaagaattgaaatctaaaagtttggaaaacacacttgagggaataatcgaggaaaacttccccagccttgctagaggcatagacgtctaaatattagaagcacaaagaacacctgggaaattcattgcaaaaagattatcgcctaagcacattgtcatcaggctatctaaagttaagaggaaagaaagaatcttaagagctgtgaggcaaaagcaccaggtaacctataaaggaaaacctatcagattaacagcagatttctcagcagaaatcctacaagctagaagggatcggggccctatcttcagcctcctcaaacaaaatgattatcagccaagaattttgtatccagcaaaatcaagcttcatatatgaaggaaagatacagtatttttcagagaagcaaatgctgagataattcaccattaccaagccaccactacaagaactgctaaaaggagctctaaatcttgaaacaaatcctggaaacacatcaaaacagaacttctttaaagcataaatctcacaggacctataaaatgaaatacaatttaaaaaacaaaagcaaaactaaaaaaaaaaaaaggacatacaggcaacaaatagcatgatgaatggaatggtacctcacatctcaataataataaatggccaaaatgctccacttaaaagatacagaattgcagaatggataagaattcaccaaccaactatctgctgccttcaacagactcggctaatgcataaagacttacatcaacttaaagtacaggggtgggaaaagacatatcatacaaatggacactgaaagcgagcaggagtagctattcttatatcagacaaaacaaactttaaagcaacagcagttaaaaaagacaaagagggacattatataatgataaaaggccttgtccaacaggaaaatatcacaatcctaaacatatatgcacataacacgggagcttccaaatttgtaaaacaattactaatagatctaagaaacgagatagacagcaacacaataatagtgggaacttcaatactccactgacagcactagacaagtcatcaagacagaaagtcaacaaagaaacaatggatttaaactataccttggaacaaatggacttaacagatatatacagaaccttctacccaacaaccacagaatatacattcaacagtgcatggaacattctccaagatagaccatatgataggcaacaaaatgagcctcgataaacttgagaaaattgaaatgttatcaagcactctctcagaccacagcagaataaaacttgaaatcaactccaaaagaaaccctcaaaaccatgcaaatgcatggaaattaaataacctgctcctgaatgatcaatcggtcaaaatgaaatcaagatggaaatttaaaaattctttgaatgaaacaacaatattgacacaacctatcaaaacttctgggatacagcaaaggcggtaccgagagaaaagttcatagccctagatgcctacatcaaaatgtctggaagagcacagacaggcaatctaagttcacacctcaagaaactagagaaataagaacaaaccaaacccaaacccagcagaagaaaggaaatagccaatatcagagcagaactaaataaaattgaaacaaaaaagtccaaaagataagtgaagcaaaaaactggttctttgaaaagataaataaaactgatagtccattagcaagataaaccaagaaaagaagacagaaaatccaaataagctcaatatgaaataaagcgggagacagtacaactgacagcacagaaatacaaaaggtcattcaaggctactatgaacacctttttgcatataaactagaaaacctagaggagatggataaattcttagaaagatacaaccctcctagcttaaatcaggaggaattagataccctgaacagaccaataacaagcagtaagattgaaatggtagttaaaaaattaccaacaaaaaaatgtccaggaccacatggatttacagcagaattccaccagacattcaaagaagaattggtaggaatcctattgacactattccacaagatagagaaagagggaactcttcctaaatcattctgtgaagccagtaccaccctagtgccaaaaccaggaaagagcataaccaaaaaagaaaactacagaccaatatccctaatgaacatagatgctaaaaaccttaacaaaatactagctaaccaaatcccacaatatatcaaaaagataatccaccatgatcaaatgggcttcataccagggatgcagggatagtttaacatatgcaagtcaataaatgtgatacaccacataaacagaattaaaaacaaaaatcatatgatcatctcaatagatgcagaaaaattattccacaaaacctggcacccctttatcattaaaactctcagcgaaatcggcatacaaaggacttacctcaatgtaataaaagccatatatgacaaacccacagccaacataatactgagtgcagataagtagaaagcattccctctgagaactgtaacgggacaaggatgcccactctccccactcctcttcaccataatactggaagttctagccagtacaatcagacaagagaaagaaataaagggcattcaagatggtaaagtggaggtcaaactgttgctgtttgctgataatatgattgtttacttagaaaaccctaaagactcctctagaaagctcctaggactgataaaataattcagcaagtttccagataaaaaattaatcttgtatttgtacacaaatcagtagttctcctatacaccaacagtgactaagctgagaatcaaatcaagaactgcacccttttacaatagctatgaaaaatacttagaaatatacctaaccaaggaggtgaaagacctctacaagaaagtctacaaaacactgctgaaagcaatcagagacaacacaaacaagtggaaacacatcccatgctcatggatgagtagaatcaatattgtgaaaatgaccatactgtcaaaagcaatctacaaattcaacgcaattcccataaaaatactaccatcattcttcacagtattagaaaaaacaattataaaatccatatggaacaaaaagtaaggcagcatagtcaaagcaaaactaagcctaaagaacaaatctggaggcatcacattacctgatttccaactatactatgaggccatagtcaccaaaacagcagggtattggtataaaaaataggcaaatagaccaatggaacagaatagagaacccagaaataaacccaaatacttacagccaactgatctttgacaaagcaaacaaaaacatgaagtggggaaaggacacccttttcaataaacggtgctgggaaaactggctagccacatgcaggagaatgaaactggatcctcatctctcaacttacacaaaaatcaactcaagatggatgaaggacttaaatctaagacctaaaactataaaaattctagaagataactttggaaaaagtcttgtagacattggcttagccaaggacttcatgaccaaaaacccaaaagcaaatgcaataaaaacaaagacaaatagctgggacttaattaaagagcccttgcatggcaaaagaaacagtcagcagagtaaacagacaacccacacagtgggagaaaatcttcacaatctacacatctgacaaaggactaatatccagaatccacaacaaactcaaacaaatcagccagaaaaaaacaaacaattccatcaaaaagtggtctaaggaaatgaatagacaattctcaaaagaagatatacaaatggcccataaacacatgaaaaaatgctcaacatctctatcagggaaatggaaatcaaaaccacaatatgataccattttactcctctaagaatggtcataataaaaagatagtagatgttggcatgaatgcagtgaacagggaacacttctacactggtggtgggagtgtaaactattacaaccactatggaaaacagtgtggagattctttaaagaactaaaagtagaactaccatttgatccagcaatcctactactggctgggtatctaactagaggaaaagaagtctttatacaaaaaagatacttgcacatgcatgtctataacagcacaattctcaattgcaaaagcatggaacctacccaaatgcccatcaatcaatgagtggataaagaaactgtggtatatatatatatgatggaatactactctgccataataagaaatgaattaatggcattcacagcgacctggatgagattggagactattattttaagtgaagtaatcaggaatggaaaaccaaacatcacatgttttcactcgtaagtggcagctaaactgtgaggatgcaaaggcataagaatgacacaatggagtttgggcactcagggggaaagggtgggaagggagtgagggataaaaggctacaaatagggtgcagtgtataatacttaggtggtgagtgcaccaaaatctcacaaatcgccactaaagaacttactcatgtaaccaaacaccacctgttctccaataacctatggaaataaaaaaattaaacatcatcaacaacaaaataaaagccatttaattaacaaatagtactagaatctacagtgccaataatttgttcttcaatctcatgtattcaagtaacatccattttctaaaattcttttgtttaaaacagcaagtatatcgagtacaggaacagttaagaaatataaatgaatcatatgataacagttggtatgcgtgcacacacacactaatataacccatcaattatatagatagatagaaggtgacattaataacaaagtgaaattaatagcagatatctatatctatatctatatctatatctatatctatatatctcaacacatatatatttggtgggttaaaacctagtctattgctggcctgagtcataaggtgctagttcttgagtaagtaaaagatcttctttgaatcatttttggtattctctgtctctaatcatgacactgtttctcatgtagttcttcaaataacgttgaggacatccaccatacactgcttcctatcatcaaacatagccagccacccactgtgtctattctactcctaaatatctattgtgccaatttatctacatctgtaccaccacctgcctagtaccagctaccttaccctgcacttggttgatttttctaatggtttcctcacattcactcctggtcctcactaggcagtcatcatcatattttaaaactgtaatttttctttaagttcctccaagggaggaaaaacaagtagaagtgagtaatctagataggaagatacattataaactttcctaattaagacatttggcactggcccagcaataggcagattcatcagaaaaatacaatagagagggtgaaagtggcacagatatacagaaatgtgatatatgacagatttgaccatgcagatcagaagggaaaaaatggattattcgataaggcctgctggaaaaatgaataatctatacgtaaatcaacaaaattggacccttctttttgtatgcaaaaaatacattttaggtcattcaaaactgaaatcagaaagcaaagctgaaacaattttagataaaatagaatatatttatgacttcagtttttgagtcagtcacaaaaagcaaaacaatgaagtaaatgttgattcatgttgattaggttaaagtgaagaaacaaaaaataaagcaaatgctgtggcttgaatatttgtgctcccccacccccctgcaaattcatatgttgaaacctaattctcagtgtgagggtatttggaagtggggcctcagggaagtaattaggtcatgatggtgaaaaccctcatgaatgggattagtttccttgtaaaaaaggccccagagagatctctcaccccttcagctgtgtgaggagacagtgaaaagacaggagtctataaagaggacctctaccaacaccttgatgttggacttcccagtccccagaactgtgagaaataaatttctattgtttatgagtcacctggtttatggtattttgttatagtaggaaaattgatgaggacaaaattcttgtgatttactaaataatatatacttatatgtaaattaaaatgtcagagcacaattgggaaaagatatttgaaaaacatcaaagcaatgaacaactcatatttagaatataaaaagctctaagtataagtaaaatatagaaataactcaatagaaatcaggagatgtaaatggacaacaatgtataggagagaatatcagaatgaccaatgaatatctgaaagatttttaaatgcatatttagtcagagagatgtaaaaccataggaaactacaatttcatatttatcagattggcaaaagatagaaaatgggataacactaggtatcagtgagaatatggaataggggatttgcctatgcaatgattttagatgtataaattggaatacacccttgggaaaataattggccaaatctaatcaatatgaaaatatgcatagtttcaaaccctttaattatactcctaggtacttacaacaatgccatgacatatacaataaaaggtgtataaaatactcatagtgtaattttctatgatgggacaaaacaagtaaaaaacctcattcttccactctcccatctgatccccctttcagaggagaatccttcctggataccccagaacagatatgccccctttaataaacctttgtgacccagttaccttttcttactgggagttactgcaacatgcaatttttcatttgcttgggtaatttttactaatttttctgagtatttatataataagttcataagtatcaaaagttttgctgtgatattttccttgtatgttaacacaattaaatcactgacatgttttggactttaaatcagtgtgtcctcggtgtgtttttttttttaacttctgccttttccccccaaagcatttataatagctctaggaactggtatactgcagagaacagacgaagaaatattaactttgcctggcttaatttagaagaaaagtaaattattccagtgaaagcaacttgaaagtaaaatcagaataaaactagcaactgagtttcaatttctgtactttatgctgccttgcattttatgaggtacaagatgaaaaatcacaggtacagaagcttgttttcttactctaataattattatttttaaagagtacagttaactgtagaaaatgttttgcttgcacagttactttcaacttattctttgtccactctttggttcaaactcttggtggaatgaacaatagtaatagtaagaaaaacaaccaaccaagcaagaaacaagcaaatgagaaaacacaatgctgtgagggaagtcataggaagtgtagttattttatgtcagagatttatgtactttgcagtcgatatttgaagaaaatattcatcttgtagcttctgaaagcattttacaagtcactcattataaataactagactgaagagcattttttaaaacaaatacagagatattctcttataagaaggtgtgaagagtgtgattactaggtggagaaccatgagaagctgctttatattcctgcattttgaattctcatcacatggctttctgttgtcattgagaaatgaaggtgaatccaagcttaaatatatttgtgtaattttttaatggcaagcatgtattgatgtattgatcttttctcctaaattctcagtaagctttttactctctatgtatttaaacgttcagtgttcatatccagctggatattcttacaaattatcttagtacataagaaatattcagtaatattcttgaataaatggatatatacaactaccactataatgtactgacttagatgagaaaatgaatactgactcagtattaacaagaaatctcatgaataaactcatagtctatgatttagctctctaaatttaaattatatttatgtgaataattatcttctgaaactctttagttatatcaattctttcagaagacaaatatccttatcattaaaaaatatacttagaatagtctctggcaaaattttaatttgtattttagcttgttatatgaatcaagaagagcagaattcattccattctttggaatcaaaaaataaatagtgtaagcaccataagacatgatgtgttaggacactaccaaatagagtattacgatgtagcttggattcagaagccaagcagtctggcaaacataataactgtgtgactttgtggaaacaaattgaactctctaaacttcagattttcatctgaaaccatggaatggtaatattaactacttcatagggtcatagtaaagttgtatgtcaagggcttagactagaagctagcaaatggtgtactgttatctataacaacagcagcagcagcaacaacagcaataataatgtcataatcgttacaggttcaacaagctgccttatcaataatgggaatttagcatcatatatacacacacacatatgtatataaatgtatatatataatgtatataatatataatgtatacatataggtctacaatgtatataatgtatacatataggtctacacgtatataatgtatacatataggtctacacgtatataatgtatacatataggtctatacgtatataatgtatacatatgtataaaaaatatatatatatatatttgagatggcattttgctcttgttacccaggctggagtgcaatggcacaatctcgtctcactgcagcctttgcctctcaggttcaagcgattctcctatctcagcctctggaatagctgagattacaggcacccgccatcattcccggctaaattttgtatttttagtagagacaaggttttaccatgttggccaggctggtctcaaactcctgaccttgtgatccgcctgcgtcagcctcccaaagtgctgggactacaggcgtgagccaccacacctggcccagcattaaatatattgagtggcttaataggcacttgtttgtggcagatgtatccacctggtataaataatagtgtacgcagcattattatcctatatataaattatgaagaatacttctaaaacctttctttacaatatcatccaagtttctaatgaatgaaagtttgttttgttttcttgtaattttgcacagtcctttaaagtatctgagcttttttggatattttcccctttattaagtttctctttagtgcgttgcaaaatttctgaactctcagtaatggtgtttcactgactcccattatgatggaattgtacaatgacaaatgaatttagaagtaccaactacttgtccttcaatattctttttaaaagaggaaattttcctgcaaacttgtaaagtactattgaattagttcaaaataatgataaatgtagatttggacagaaattggagaatgtgaatgttaaggttgacactgtataaataattcatgtagaaccatatgttaaattatatttattcaagtagtaatatgattggcaatatgcagggttttttttttttggaattattagccctctttctttcaaatgcatgtgtccagaattggttccttccagtgggttcttcgtctcactgacttgaagaacgtagccgcggaccttcccagggcgtgttacagttcttaaagatggtgtgtctggagtttcttccttccgatgggtttgtggtctcgctgacttcagaagtgaagctgcagaccttcgcagtgagtgttacagctcttaaaggtggcgcgtccagagctgtttcttcctcccggtgggttcacagtttcgctgacttcaggaatgaagccacagacccttgtggtgagtgttacagctcataaaggtagtgctgacccaaagagtgaggagcagtaagatttacttggaagagcaaaagaacaaagcttccacagcatgaaaagggaccccagcaggttgcgactgctggctcaggtggccagcttttattcccttatttggccccgcccatgtcctgctgattgttccattttacagagtgctgatgggtccattttacagaatgctgattggtctgtttttacagagtgctgactggtgcgtttacaaacctttagctagacacagagcactgattggtgtgtttacaatcccttagctagacagagaagttctacaagtccccactggacccaggaagtccagctggcttcacctttcatgcatacttcattgattccaaaaaataaaagatttctccaaactaagaaaataacatctcattgtgcacacttagaggaatctgaagaatgtctctctgtcacattagcagatatatttttagatttttctcataaagccaaataaatgtcagtagagatcagtattcgagtttaatacagaaattgcagaattatcagatttttaccctaaaatttcctaaattgtttccaaggaagatagcattctgaatccttgagggaagtaatatttccactaaatgctcctgtaacagtgccatgtgttttatcaaaattatttttatatcccttcctgcctctagacaataaaacttttaagaataaggatactgcttgatattattggctgtgtccccacctaaatctcaccttgaattgtagctcccataattcctacatgttgttggagggacctggtgggagataattgaatcgtgggcacagtttcccccacactgttcttggtagtgaataagtctcacaagatctgatggctttataaggggatttccctttggcttggctctcattctctcttctctaccaccatgtaagatatgcattttgccttccgccatgattgtgaggcctccccagccttggggaactgtgggtctattaaacttctttttctttctttctttctttctttttttttttgagaggcggagtttagctcttgtcacccaagctggagtgcagtggcacgatctcggctcactgcagcctccgcctcctgggttcaagcgattctcctgcctcagcctctggagcagctgggattacaggcatgccactgtgcctggctaatttttgtatttttagtagagacggggtttcaccatattggccaggctagtcttgaactcctgacctcaggtgatccactcgcctcagcctccaaaattgctgggattacaggtgtgagctaccctgctggcatcactttttcttcataaattacctagtcttgggcatgtctttatcagtagcatgaaaacggatgaatacacagctttttctcactttcttaactctgtcatatttcagaggggatagtttatactctatgtgttgaataaagaacctatatatttctggtcatttgtaagtaaaagtcagtgttaatttaaatgaaaatataaagatttcttcatttttaaacattctattgtgctatgtgatatatgtaaagaaaaatccataaagcttatatgcagttatatgttttaacaatatttctctgtgaacccacagagaacttcattttctagttattatggtccttaccagaaggtgtcaagaaagagaaatttatttgttcaataaaaaacaatatcaacactccccgcccccccaaaagaaagcaaacacacttaaagaatttccagttgcacttaggatgctgaagactctcaacctatattgagaacaacccagaaaattgacaaaatcatatatttttgggacccaacagagaacagagtttgcaagatatacagatgaactgaattccaaatgatgataagctagtgtgacaatttagaagcctgagaccccaggcacaagggcactggttccacccaccagcttttgccacaggcctccacctagtgtttatgagaaggactggtggggggttggggggagagcaaaagattcaagagagatctccctctcccttagtgagcagagccactaaaacctatccctttcctgaacaagcacttttctcatctaagcaaaagtcacctgcactacaagaacaccctggaaatctctgttgcaggcagatgtcacctgtggccaggggaggagtagaagcaaaaatcatctgcttatgagaagtggcagagcacctgttgtacctaattctgcagtgatgctaaacaaagagctgctgccagaggagaaatgggaaacatgtctacccaagaccttttctcactatgtaagacagattttaggtgccatggaatgagtgagaaagctccatccatgagactaattactcagggcctgcttgtgtctgaatctggagcataagaacctaaaaactccaccttttaacaccaagaatctgcactaataacaaatgatagtaatttgctaggggaaaggcaaaagtatggagagagacttctgtgtggaatgtctgtgcaggacctgctgaaagcagagaaacaaatatttagaaaaaatgttcagataatccaggcatcacactaagcacaaggtagcagcagctcacaactggagaaattttcagttttcaatgcactaaaggtaagtataacaacaaaaaatccaaaacacatcctaactcctgaatagatggacttattcccctatgatgagagttaagaaaagcagaggaatgaccacatttgagtgtatatacaatttacctcaatatctaaataatcaccacttaatttaaaaattatggctctctaaaaagcaaaaaaaaatagtacctattttcaagagctaaaacaatcaactgaactagacttagagatagtctagataggcacattaaaatacctatacctaatatgtcaatggctctatttggcaagttgggcatcatgcagcaatacatggaaaacttaagcaagaagatggaaattataaacaaaagctttttttaaaatcctacactatcagagataaagaattcttttcatgagattatcattacactttacataactgattccagaagggctaagcttaaaggtgggtcaatagaaatgggtcaatcatttcatggctaatagaaatggttagtcatttcatgaaataatcttacatgaaacacaaagtgaaaactgaatgaaaaaaaaaatacaacagagcacctatgagctgtggaacactgttaaattgattaactcatatttacttgttgttccaccaggagaaaggtgcaaaaatgtaaaaagaatattttgagcaaaggctaagtacaaagaaaaacagacctgagcacacgagagtcaaactaaaatcaacaacaacaacaaaaaacaaatatggagaaaaaagtcttgaaggtagccggggaagaaaaaaacattacatgcaggacaataagaactacaatgaaagcaggtttcttgtcagaaacacagctatgtaaaccagaaaacaatggagtgatatctttaaagttctgtaggaataaagatgaaatactgtcactctagaaatttatacccagaagaaatacaaaatgccaacaccacagaagttatcacctcccttcccagaccacatcacctttccctgctaaggtaatcacaatactaacatttatgaaaatatactcttaattttcttcatagttgtgcacctatgcattcacctaaagtttaaatctaatcattctattcttgttatatatttttgctcaatattatgtttataggaatcattggcatcataatgtgcaactctatcgatcttcattttaatctctgtgtacctttccatgacattgtaatttctcacaatttattatacattcttaaattaagggagatctcttctgtggtttctctagctaggcctctgtgacaactctttcttgattcaccacttatttttctgatgactatggctgagaaatttggttacatgaagacattctcaaaatttggccttcttgacctgtatatatatcctgaaataactcatttatttctattgatttaacaatcaaagaaggtgacttcctaatctgcatctatctattcattgagtatgttgactctcaatttccaaaaaaactcatgggctaagcaaagcctactgcttgaaggtagcatactattttgatagactcttagtaacgtcttaggagaatggattcagggaaagatatttgtaggaatctagaccttgaactgtgtgattttagatcaattcttgcaaggtgggaattaattgtgatgggatagagtttataactttggattggtagttacaacaaagaaagggtattgaaatgagtcttaaaaaagatatcagttttgataagtaagcagttttttagagtcttatcatctaggaccagccattttctggagcaagacatgaagtcatttttacttgggcccagccttgtttaacacacagataggaaagtacatctggtacaagtgttattcaacacagggaaagcgggttatgttaatgtgaattctcagacgctagacattttaagataaactgttatttacaattaaaactcaatgcatttgtgtcaggcagacactcaaatggcctcctcttgagtgtgcgatgggacctatgacttgcttttaattactagactatgacaagggtgataagaagtcactttggtggttatatgacataagattgtaagttccctcttgataccagaccctctggcaatgaactgagagttccctctaggtaacagccagcaagcaactctgagcagcctccagctgacatctagaaaagaactgagaccctcagtctagcaactcataaagagctaaaacttgacaacagccctatgagtctggaagtggatccttcccctactgagctttcagatgaacccccaccctggttgatacctggattgcaggcttgtgacagatcatgaaacagaagacccagctaggttgtggcagatttatgatctatagaaactgtgagataatacaataagtcctcgcttaatgttgttctgtccatagatttttggaaaccatgtaaagctggtcccagaataacataattttgatcaatattgttttattataactttgatgagaaaaaaattggtttcattatatgttatcttgcttagaacctactgatgacattaagtgagggcttcctgtatagcgttatctatgttgcttaggccactaagtgtggcaacattattagacaataactaacacagcattgaaaactaaattctccatgttgggtacacaaaaaggatttttaaaaatgcattctttgttttttgttttttcttttccttctcttatttctcccaatctatttatcccagtgtgttttctctcttccttcctcttgacattttaagttccttccttttccattctttctctctgcttcttactttgtttctggcaaattacacagttatcttcctagtcacattgaaactttggacatatttttggtttattatataaatgtccacaagaggatgtttcttcaacatgcagaggccagggaactggacatatggctgaaagtcctgtgcagtgttgtttattcacaggaaacagtcaatcagcttaatgcattttcagcgtaattgcaagtttaagccagaaagatgttctcatgcaaagaagattcctttgctgttgttgaagcagaatggaataataggaaaggcataggttctttatttttctgatttttaccttcacattatttaattttatacgttgttttgagggacagatattgtagatcgatttgggttttagatcccaaacatgggacttttagaggaaagtaggttgagtatgtggggtctgatataaaggaacgaaggaacttatgagaaaccaaaatagatctttatttttttattttaatttttcatttaaattttatagacagggccttgctctgtctcccaggctggagtgcagtggtactatcattgctcactatagccttgaactcctgggctcaagcaatcctcctgcctcagcctcccaagtattatagctaggactacaggcatgtgccaccatgcctggctaattttttttttatttttgttttgtagatacagggtctcactttgttgcccaatctcgtctcaaactccctggcctcaagtgatcctcttgcctcagcctctcaaaattacagggttggcagatatgttaccatggctggcctgaaatagatctaaagatgagtgcttgagtgtattttcccagcactcattctgtaacagcatctagatgaaaaagttcagcagtttctatctctagacggtagtatctatactatttcttgccctcacagtgtcttaatttacatgactttctcttgtcacctgcacggtcttcccactctgctcgtgccgtatcatttccaccaactccagccattccagaccacttattagcacacattataccatgctgccttgcaaattatttttgctattttaaaattttatgtcagaatgcactgctgcttcatcttcatcttgacagcaagagaagctctgatcatgcttcatctcaaaatataccctcaccattaagtcatttctgatcccaaagtcagaattgcaatctgtcttctatcctgtaacagcaagcttcctgatactcaatcctacttagaagcccttttgcaagtcatgatgtctgcctgcctcactagagtactcgctttttgataggcgattactctgttatttccttctctcaagggcctaccattgtagatttcacaaaatattggctcaatattttcttgataccagttcaactgcaaaacttaaagtaaaattccaaccccccccaaaaaaatgaaataatgtattttaaagtggcaaataaacatgtggctttctgaagctgttacataaatcagtattaataaatcaaatacacctattgaagtcatgttccccaagcaattgaacaataatttcccaactctattttttccaagccattctctactacacagaattggagagcctataaaatttaggtcaatttcccttctgctcagcaggaatacaactgcaaagttcggtaacttgcagaacaaaaacactcttaacttttctttagaagtctttagattataaactttcatacttttcaattatggttgaaatctcattttcttttcgtatggtttaaatatttctcttgttttaccatctcattcctgaaatatattattggaaacaaaagttagttaagtttttataaataacattatcagtttaaatgctgtctaatcaggtaactgctgcttataaaagtaatcagaaaataaaaatgtaaactaaaaaaatcccaaatatttacttcattattatttaatcacttttatttatttagatgtttcacattttcattcaactacttccatacattttttaatcatcacaattatagaaaatggaattatttttctagcttatgatattttcacataataaagtgggaaacatatttcaatgcatattagacacagccaatcagtgtgtttattaataaaattaaactatgtaagttaaaaccttcatatgctaaaatggaattggacttattttgcctggtaacaaaatgcaggtactccgtaacgtttttattaataatgttaaccattttatattaaacacactttcttatctgaaaaaataagaactcagatgaaagataataatgaaacgcttagtattatatagtgagtgcttgggtattttaacttcacagctgactttgaaaatatcagtatggaaaaggtacaatatgctacagatacggcttttaattgtgagcaaggatgtgacaaattgcatgaacagctatgccgtgtattttggaagatcatctattacataacatcaataattctgacaccttgaacatcagcttttcttgtgaaattggaagcatgtttaaagatttctaatacatacatttcaggaaagttagtatatggttatttcataagaaaaggttggttgaaggattaatatatggaagacaaaattttaattttcaaaaaaattgggcaagtatacatgtgctctaattagtatgttctgcaaattctcatttatttagaggacatataattataaaactgagagatcagtggattttatcaaaccacagtaattttgattttgaattattgccctttttaacttagtgttctatttaataaatttgataatctcagtgagtatcaaagttcctcatttagtcttaaggagtaacttacccaatcctgtatgctattgactttttgggaagaacttggaaatttattatgcatcttagtatacaaatttccaacaccaactgagtctggaatgtattaattaagtgcagattcaaaataattgctcactatgagaatcctataaattataaagcataagaataatttcttaaacgtttaattatataagatatctcatttttaatgtatattgtttgcaggaaaacatgccaagattagcaacctgtacacaaacattctttgagcctctagatacagagtctctgagagcagtttccagttccaacacaacagcacctcatcttctgcctgcactcctgaacacacgaccaggctcacaccactcgagacctccgtatacacaaaataggacccataagtccttctgaaggtgtgtgggtgcatgataaatgctccataaatagctactgatagaaaacctacatcacaggtaatagttgcaagaggatcagattacaatgtgtggagtgtgaataaaaatcagattacaatgtatggagtgtgaataaaaatcagattacaatgtgtggagtgtgaataaaaatcagattacaatgtgtggagtgtgaataaaaatcagattacaatgtgtggagagtgaataaaaatcagattacaatgtgtggagtgtgaataaaaatcagattacaatgtgtggagtgtgaatgaaaatcagattacaatgtgtggagggtgaataaaaatcagattacaatgtgtggagggtgaataaaaatcagattacaatgtgtggagggtgaataaaaatcagattacaatgtgtggagtatgaataaaaatcagtttacaatgtgtggagtgtgaataaaaatcagattacaatgtgtggagtgtgaataaaaatcagtttacaatgtgtggagtgtgaataaaaatcagattacaatgtgtggagtgtgaacaaaaatcagattacaatgtgtggagtgtgaataaaaatcagattacaatgtctggagggtgaataaaaatcagattacaatgtgtggagtgtgaataaaaatcagattacaatgtgtggagtgtgaataaaaatcagattacaatgtgtggagtgtgaataaaaatcagattacaatgtgtgcagtgtgaataaaaatcagattacaatgtgtggagggtgaataaaaatcagattacaatgtgtggagggtgaataaaaatcacattacaatgtgtggagtgtgaacaaaaatcagattacaatgtgtggagtgtgaataaaaatcagattacaatgtgtggagggtgaataaaaatcagattacaatgtgtggagggtgaatgaaaatcagattacaatgtgtggagtgtgaataaaaatcagattacaatgtgtggagtgtgaataaaaatcagattacaatgtgtggagtgtgaataaaaatcagattacaatgtgtggagggtgaataaaaatcagattacaatgtgtggagggtgaataaaaatcagattacaatgtgtggagtgtgaataaaaatcagattacaatgtgtggagggtgaataaaaatcagattacaatgtgtggagtgtgaataaaaatcagattacaatgtgtggagggtgaattaaaatcagattacaatgtgtggagtgtgaataaaaattagattacaatgtgtggagtgtgaataaaaatcagattacaatgtgtggagtgtgaataaaaatcagattacaatgtatggagggtgaatgggagttagctgatgagcatgaaacacttttttttttttgagacaaagtaccatggtggtagagaaagggggatagtttgaagatcaataaaaattaatattttgaaaagatcagggtagaggatgttaataaaagatctctggaatggtaaatactgtaagacatgaagggtataacagactttattcataactaattgattttttatgacaaaggattatttgtttggggaaataagtagttaagtgttcccttcatgccaaaggcctcaaaagctaaaagcactggtaacacttgtttaaaggtcctctctgtattttatgcagagagtaggattaatgtccaacatgtctgaaaaaatactcattctaaaggaatgactctggatccacatgttacaaatgtggattttattatttgtttatattatttaccccaaaccaagctttgttctatgtactataaactatttaatcatgattttcccctctaggatataatttgtgaatagtttgcagaaatgggagcattatcttttaaaaagtgacttctctagttctagatccctgaggaatcaccacactgtcttccacaatggttgagctagtttaccttcccaccaacagtgtaaaagtgtttctatttctccaccatttgacccagccatcccattactgggtatatagccaaaggaatataaatcatgctgctataaagacacatgcacatgtatgtttactgcggcactactcacaatagcaaagacttggaatcaacccaaatgtccaacaatgatagactggattaagaaaatgtggcacatatacaccatggaatactatgcagccataaaaaatgatgagttcatgtcctttgtagggacatggatgaagctggaaaccatcactctcagcaaactatcgcaaggacaaaaaaccaaacaccgcatgttctcactcatacgtggaaattgaacaatgagaacacatggacacaggaaggggaacatcacataccagggcctgttgtggggtggggggaggggggagggatagcattaggagatatacctaatgtaaatgatgagttaatgggtgcagcacaccaacatggcacatgtatacatatgtaacaaacctgcacgttgtgcacatgtaccctagaacttaaagtattttatatatatatataaagtgacttttctgcatttcagaaaatcaggtttaagttagatatgataatgattaaaacatttacatatattaaatgtacatttagcaatgtatatttaattatgtataattaaaaatgtatatttaatgtaataaatatacatttagcaatgtaatttaagaaaaagtgcttaagagctagccatcctaccttggtgaaggtgggcaggcttttgtaccctctgtcagtcatcagtggcagagtttcagttgtagtaacaggcatgttgcctcctaggtgagagcaagggaactcctcagagaaggcagctgctatttagccaactccagctaaggggtggggacacctgccagaagacgggatgtggtgggctgtcttggaatccaccataagcctcttggagaaaccaagagggtgaatgagttgctgccatcttggagcctactatctggggggtaagaaaacaaacaaatgcaaaaataaataatggaattccagacactaataattaccatagaaaccagagtaacagaatagtgattgggaggaagttggggaaatatttttcatggtgtttatgaataacttacctgtacagggaacatttgagcagagttgaaggatgagaaacatacagctctggggagacttgggaggaagggtagattgtagaatctgcaacctgtagcagttctgtggtggagatgggcatgtcctcttgatttatactgagaaaagttaagagtgacggaagatggacctgaggggttaccagggataaatgacatagaaatttcgtggccatggatatgtgtttaagttttattggaaatctgttgttgcagataataatgaaaagcctttcaagagttacacacaggaagactgcataatatgaaatacaatttacagtttagaacgtttcctttgttggttatgtggagattggactacagtgagtcaaagagggagaaaaggaaagatgaagagactgttggacttggccatgcgaaagatccttggccttggaccagtgtggaacagtttggcaaagtgtgagaagtgatgaggatatattttgaaggtaggaaattctgatgttttaggtgcagaagatgaagagtttaaaaaacaagttattggaataatcaactagttcaattgcattccatttaacaagatactgaaaatgagttgagcagatttggtgagcaggcatggggagtggaacacagtatgtgtgacagtgtacataaactcatatgtaaaagtatgtacacttaagtttaataaatctgataattataaataatacatacatgtaattgagaaagaaattatggaagttctcttgtttcctaggaaataaaaaataaagcaggtattttatataatatttcagagtttagactttggattatgtcaatggtttttgtttatataataaaaatcttagtgctaacccttaactccaagatactgtatcctgtaggcaatgaacctacatccattataagcgccagctaagataaatatcaaaaaaacagcacactaagattttaccacacccaccttctcatacacgaagtcaattagatttgacagcacagagacttcaatgatgaataattctacattaggaattagctgcctgtgtttctagaatttattaaacagaatgcagtttggcaaatgggagagactacttcatttgaagttcaaagagccgagtttgaactctgtttctgggatttataaccttggcaagtgagtgagcctcagtttcttccttgttatttagaggtaagaatatctgtattgtcttgtttgatgtaaaatatgttataatagtaagtatgataaaaataatttatctacccatgtaaatatgccagtttatgattcatcccctaaatagaagtaggagagcccgaggagacctgggcaagtctgacctctcacacggcatgacatttgctttacctgtgtaaccagccttctttgggtttccaatcagactccaagactggctgcttccccagggatagggcttttggagatatctgctgattcttaaacggtttcctccatcttccttgagcacctgataaactaacctttcttgggatccttcttgttaagcagccccaacgcattcttactgggtaggatttgtttgcctcgagctctagcctcggagggttaaatatcaaacagcattcacaaattaatatgtaaatatatctgataacattcacagtgaattttccttaatggtatcctgtagtctttaagagggaggactctagattcggactgtccagttctaaatcctggatccattaataatcaatgttgctgaagctttttgtgactaattgtgctcttctgtaaaatataaatatcatatataaagaaaaaacgtgattatttttaaaagtagaaacaaaagtatagaaaatctaaaataaatatggaaactttggaagaatgctgagtatatatcagatcattaggagctcgtaggaaatgctgcgttttttatacatgtatttttaatgacatgactgaacattttatttgagtctaatatttgtttgttactgaagtactgagaagtcatctatttcttaggtgtctcagggaaaaggcattgaattatgttctttttattttgttttaaattgaagttattactaattttattagagcttctgttacttaacctagatcagataactataacttgtcagtaattactttggtgtaacaatcagtattttaaaaagcttttgagaaaaaacaggttgaagatgaatatatgtatttccatgtctctatctatccatctatctatcatctatcaatcatctatctatctttccatagacataaaataatttttactcacatgtaataatcttgctatttactcaacctacataacacttataattcctggcatataattggagaatatacttttaaaatccaaatattttacttttgtaaaacacgaatgttttctttaccagttcatttctgcatgcaaattatttgccagtcacgatttttttcttttttaaattcaagatgtaattgaaatacagtaaaattcaactgttttagtttaatttttgtgttttgatagagttcgacagagttttgacaatcatgtaaccataccataatcaaaatatagaacatttccatcaaaccaaaaatttcacttgtacctttttaagcgattccactatatgtattttggtattacattgtagttttaatttgcattttcctcgtgactaatgatgttgaacatattttaatgtacttttacccatttttttaattgtgtagcttattttctggttatggaatttcagtagttctttaggtattcttaatacaagtccttcatcagttatgttattgctaatattttctctaatctgtggcttctctgtacattttatttacagtgtcattatcattttaaaactgaatttataatttttcctagtttgaattgttttgttgtattgtatctcagaaagctttgcccactcatggtcacaatatttttgtgcatgtgttttactttaaaagttttacagatctagctattacatttaggtttataaacgagtttgtgcgagtgtttgtataatatatgagttgggtattgatgttaattttttgtcatatggatatttaattgtgtcagcaccttttgttgaaaacagtattcttctccactaaaagacagcttttagtgtttccttccagtctaagtgcattttatttactattcttattacattggagaaaatctccaaaacagtgttaaataagagggagaagaagaacattcttttatttctatttgtaatttgtgttctcccctccatcctacctcatttagtctggctatgtgtttatcaaatttgtcaattgtttcaaagaattggcttttagttaaattgatctcattcttggtgctattgttgccatagactttatttttacttatgttgtaaagatacaatttgttggtactatctttgctttatctgctcagacatattttagagcaacaaaaaggggaaaaagtacattttatagctattgtttacttaatgcatacaatccttctgtctgaaaaacttgctgtaacatatcttgtagtgcgggtctattgctaataccctgcctttttttctcacctctaattctctttcagttttgaaggatgttcttgctggctatgaaattctgggttgactttttcttagcacttcaatgatgccactccatcatattttgtattgaacattttctgattagtagacatctataattcttatctttatcctcctggatatagtatgtcctttttctctggcaacctttatctttgactttcagcacttttaatatcatgtgtcagtgtgtcatggttcttgtttgtttgttgaggtaaataatttttatgcttaaaaagtccacttttgttcctttcccaattccttcctccctcccaccttgcctctctctgtcttctctctctctctgtctctgtctctctcttttgaaacctttagtctgggggttgagccaatccatttagaacctgatttgggattgttcattttattgttattgattcgcctgttacccttagtgcagcacaaactttaaatgcctccagtgtgtttagggtgaggataggtttgccagacttttccctcaatgtcttctcaccatctgatttcagcctttcttttgtgcctgcgtctcaaaggaggtctctgtgagctttgattctccttcagtggtggattcctattacttcttaacatttcctcctctgcaaataggcatgggaaggcgaaggctgttctcttttattctgtcgcagccccagtctttggcaagggttgtgttgctgggtcttgggtgtgggttgttctcggggatcctgcacctcttgtgtcactaggagacaactaatattttggaccccagaggttttcttgttcctgccccagagatggggggtttctttgataatctaaagaatccttttcagttctcttccgagaccagctggaatgggtctttcctgcatcctgagggagacaggttttactgcttgtttccccagtgacttgtggctgttttcctctagggaagatgaagaagggtgagattttgtgtctttcccaaagctgttctgtgcccttactccaggcctgtgtcatgagagacaatcttgggtctctcctgggtgccttgtgagggccgtggagagcccagatgtaggtacaaattcccatgtatctgtggctccgagggtttcacattctcttggtagcccagtcagtcattaagagtttgctaaaaacttcagctgacttcttactagccctggtgcatccagcctctgcttcaaagatgaaaatatttatgtcttattcctcctacctggtacctgtttttcctcagatttcaggttagtgctctacaaccttagctgacttaggaattcaagaaaagttaatattttacaaattatttagctatttttggttgtagatataaggttgcgtggtgcaatgctttttccaaatttctgtgatggacgtggaagaaccgaaatctgtgagccatgatatttgtatttctttattgatatatgaatggaactattactttcctttaaaacaatatgattaatgctgaatttggcagaacacgtatcattcaaagttttggtgccattcgagtcaaaaatagttgtatactttacagaattttgtccaatggaagtaattaatatattagggaattattttaagttaaagtaaaattcgtttccacagaatttccatctgtacacaatttattaaatttcaattcaaatctctgatggtagactctgaattcaatgtggaagtctgatttaataatcatatatacattgtcaacatttaaaagaaataatgctaaaattcttatcttccaattataaactaagaaatgggaaatctttttgtgttataaaaatgtggtattatgaaatgtcaaaagagttaactatgaaaaaattgtttgtctattacaataattgcatatcttctaagtaattatatactttatcaatgagatctttaatatcagtccaacttcactttctttaacttttataaagttaaatatgtaataatatacatttttttctgttcctcggtggattatcttgtaaatttcattctgaagaatattcctctgaataatttacttttattaatgaaacctatatactcattaaatattttgggaaaatacctttatgttaaccatgttttaaaatgactcaggatggcttatgttaattatggtttaaaatgactcagtattttcatactgccaccagcttatttatgtccctcaagttggtaggttagataataaaacgttaactgaagaaaagtctttgatttaaccttagtaacctctttttaatagatttgactgcttatttacaactatcaaactatttttggatcttgactgtgtcattcaccattcgtgctgtccacctcaactttgcctcacccatgtattttacaaaagcaaagggcaaatgtctattttcagtaaagagattgttaaaatggttttcaagcttaaatattgcaaaccacaaaatggtggatgctttcattaatgtgcacatttaaaaatacatttatatgtctcatgctttaaaatataataaaagaatttattaaattatgtacatataattgtactgggagatgtttcattaaaagtaatataccattcaatccctttgtgatactgaaattgattataaaaatacatatttgataataaatctgattatcatgtgtactgtaagtacatattttagagtaattattaatatccccattttaaccacttagactttattttaacaaatacataattagcatttaaaataactcagaagtaatcctaagctgaatagaaggttttatatggtaaatatgatggaagaaaagggattgttggcttgattccttcttctttataaacttgggctaagctttttaatttattttactgaatgcacttaaattcttcttgaaactaattactaaattttaagcaagattactggcacaaagagaagctatgaaggtcctggcaaaaaattttaattgtggtcttcaaatcaatataaaaaaattgccaacatagctggagatttcaaggatgaattagaaaatttaaaattatgttattgtgtggacttatctttaagtctaggaagggaactgagccctattttattttaaaatagagaaatgttaagagctaaatctgcataagcagaggaataaaagtaatacaaatattccaaacattaaatatataatacattaaaatgtttaatggttatttcatgattaaattatggatatcagcaaacataatgactgaatgaaaaaccaagaaagaacacatttctgtattaaaatataagaatagaaaaatccaatttcattaatgacattcttcatgtgatgggaatgatcagctaattgactgaaactatgttaataggggagaaagtcactttaatgaatatgcaatggtagacaatatgaatagaatattgatacaaatatttgttcaacctattatttggaaggctttagtgcttaaagctatgggaaatataaagattttaaaaaaactttcagtattttcatgtagtttagaatttattgtatggcagaggtagaaacaagatgccacattgaaaggcaaaatgatctttcaataaaacattgtacaaaatatagaggcacaaaggaggggcatatttttaatttccataaaggaagccagggaaagcacttcacggaggagatgcctacttaagtggacttccaagatgaacccatgtactactatctgctaacaaagaataaggagaaatatgtattactcagaagaattaggatgaacaaaagcattgaaacaactaaaattcttggaaggaagagagaagagggaatgtagatcacagttggaggggatgcccttggaagaatctaagaaaattatcccagtttatggagagaagccataagagataaaaacagatacaggaaggttaatctagttgattgagtttccatctgatgacatccattttaccaataccgtatgaagtgaagtctcagctgagagggtgtggtggggagagttgggacctctgaggagagaggaaggggtatacaattgttggttttgttttgttttagaaagggacaaggtaaacttagaaaggacaggtagtaagttcttttggctaatgatgagggtccattcaaagtctgtggtcgtgtatcacatggtagagtaagaatttccagcaaactttacttgctaggctcagattaaaaggcagatatagctttgcagccagggtttgtgctttatcagttgattggacaagggagagtaaatcaaagatgttgctattcagagcagtgattatgaagatggccaatgagttctaatttagtaaacaaagaagcaaatgcttggaaagtgtgatagaaaacatgctgaggccaaggaattagtagagtaaaggctctggtttcagtaacactgaaggttaaaatgacgagttaaatagtggagtatttggaactgagaattttggtggtcatgtggctttactggtgattactaaggtccagtatgcgatcaaagacaagatgaccgaaataggataaaggaaaaggttgtaggaagtgaggtggccaaagagctgccgattcaaaatgtggtacgggctttacatgctggttttaaaatcaccgggaatgactactagaaaagggggaagggaaagacagtgaaccaagaactaagtttttcagtgaactccacagtggagagtttgtagacattttgacactggtgtgtcacaacaatttggagattacagctaagtggtctgaagttcagaagagcagtaacattttgagggaggtagaagtggaaatggtttggcaataatgacgggggtcgtgaaggaacacgaaaagattaataacctccacctgtaagcagagtcagtgtctgtccgggagagtgatgtttgggtaaagggaaggggaagggagagaaaagagaagttgataataggagaaaattttgtaatcccagaagaagagttccagatagatttcttcaggggaaaaaatgggaactgtttatggtagtttggaggttgtgtaaagtacagtgggtgtcagaagtctcaagataacggatgacctggaggctgggatatccagaagagttgagacagaaagagaaataactagcattacattccttaaaatgcccttcctttttgatcaacacatacttaaaaatcatctgagcaggttctgctttatatatatgtttaaaattatttatatttgatgtataggtacagctttactagcctttgaggactttataaattatacataaaatgggtcagacatggtagttcacacctataatcccagcactttgggaggccaaggtggcaggattgcttgaagccagaagtttgaagctagcttaggcaatatagtgagaccccatctccacacacacaaaaaaaattagtcaagtgtggtggcatgtgcctctggtcccagctattcaggtgcctgtggtgggaggatcacttgagcccaggagttcaaggttacagtgagctatgatcgtgataattccactgtttcccagcctgggtgacagtgagattctgtttcaaaataatcaatcaatcaatcatacatataattgaatgaaaagtgttgagaaaaagattaatttttaatgtatgaatttaaaacaattctttttttcttttgcacaataaactgaggaatagtactacattaaagaaaggttttaaaatttatccggaacaatgaattattcttcgggcatagggaatgctcaaggagtgagaaagtcaggctaaagctctgcagctgcactaaacatcagcagcaggccaacatcgggaagcccttctccagggatgcaaatgtaactgcaggaaaatttgacattacatcgtttagacaaaatatatttagaggaaatgactttgaattgtctattatgccatcttcaacttggcttctcaagtagaataaatgttgctattaggaccagaatttttttaaaaagtagttaataaatgacttgtaaagtgtgctttctgttttgatctccaggtaccctcaactcaatctcgttcttgcctggagaagcaatgtgatgaaggatctaggtttgaaccctggcatttagctttctgaatagttgtcagatgagttttttttttaacaagaagctaaagaagattgaaatgcaatgatgaaaaattgactcagaggtggaagatgtaattgttttcagtggaatgccttctgtccactgtataggatctactgaatgttcacatggctggctctaagtgccattctagactacatactatgtgaaaaaaatctttcttctgttcattttatattttctcaggtcccttccaaggatggatgacctagaggctgggatatccagaagagttgagacagaaagagaaataactagtattatgttccttaaaatgtccttcctttttgatcaacactaatacttaaaaatcatctgagcaggttctgctatatatatatatatatatatatatatatatatatatatatatatatatatgtttaaaattatttatattcaatgtatatgtacagctttactagcttttgtggactttataaattatacataaaatgggtcagacatggtagttcgcacctataatcccagcactttgagggtcccagcactttctcaggtcccttggaagagaaaataattatttttattattactcaataaattaacatacatttggtttggaatttaaaaaattaaagatatcttgaaaaattaaacatcatattgtcttcactggaatggttgtctcacccagcgtcatctcttctagtggctggatcctgttcttcctgaaaaccactcatttctgataacagtagaactgtagctcagaatgcaagccaaaactgccttccttgagtctggccttggtcacaagtgggtcatcgctttatccaggacaatcatgattcttccctggaattttcacacatgatcttagccaaaaagctgagaagaaattctgggattttccaatgcacacttgagttttctttccagcagccaagctgtgtgaagctgagcctggagctgctgatggccatgattcctgagttagaaaatgtcacaatataagatgcacactaaatcaagaccaaaaacatttagaaactatgacaaatgaatgaaaattaagtggtgaaatgacattatgttcttctatttgattccacttatgtgaatttctagactaggaaaacttattttgattaaaagtacatctgtggtttcttggaggcttgatttgcagtaaacgtgcaggaaagtgttaacatcagcaggcaggagactccgatccttagaagggcctgcttgcgagcttggtcttcgctggcatctagaaacttatgtttcaagagagtacccaccattctctgataagaatgattcattgtcctaaaccatttgttcaaacaattggtttatcctgaatatctgtttttcttgaagtctaaaatttttatacagagtaggcagagtgtgtcctatgtaatcaaccctaataaaaaccatggactctgagtgtctcaagagcttccctggtagacagcatttcatacttgccattacaagttgctactgggtgaattaagatcagctggtgtgactccagtgggataagattcttggatgcttgcacctggtttcttccggatattgctggatgcaccttttctctttgctgatttcgctttttatccgttttccataataaatcactgccatgactatgcctatatgctgagtcgtgggagcactccttacaaatcaccaaacctggggatggtcttgggacccctggtacagcaaaaagaaactttttatctcaatagaagtgtgatttatgtggctgcattcaattgtcaaaattgattgaactgtgtacttaagatctgtgtattatacctaataaaattattttgaggaaaaaacgattaatacatttgttaaaaaataagattatgtgaagtgttattctttagttgcatgacctttcaaaagaagacctgaaattccatgacacaaaggacagtgttccaaagacagatgatttcatcatctgttgaatgaagtgcataacctctggaagggcctctgcaatttctcaacccactaaacccatggaaatggtaacattcacgtagtcctgacagacttcttattccacttggccatatggttaattagagaaaaacttggcattgcatttaaataatgtatattttcaacttttttaaggtaagagaggtgagggatcagggcttgaaagacatggaaagacatggccagatttgattcatgccttttataccagttttccagctgccagttgatggaggcatttcatgatttctcaaaaaactatcccaggcatggcagctcttcaagtggacaggaccttgttatcacattaagagctatttagacttattatatgagattcttctttgcaaattctaaatgaaattaagatcagtgaacattccaagatatctacatcatagtttattcttctaataggtatttcagtgaaaaagattctatcatcaaaaaacagaaatctttaatgtaataattctcagaagcattaatatattagcacgaaatgtgattattcaagatagagaaaaaatttggtgtttaccaactcttgtttttctcagctatagagccctgtggggctctttttggaatctatttcttgaggaagagataacatattaccaaagagaaaagtagttgtctttatttctaggtttttttaaattaaagtctataataatgtaaatttgaattacatactgaatttaatagttacatgataaaactagtatgcaaaatgcggtatatttttgtacattacaaattagaaaatgaagttaatactaacttttaaaaggaaagcaagacggtcggatgtctgtgttaaaactgagatttctcatttccctgactttcattaagtttagggtagcagctgaggccttgctaatgctcaaatcctcttctcattggtatgtatagttgaatgaggaattttcgggtgtcagatgggttaacagtaagaggatcttttcgtgctgtgtttgcttaattagagttggtacttccagatgttatctaccggtatgcaagaatttcacataacactgagggaaaacacattttacacatttttttagctcatgtatttaatttaaactaccttctgtaatatcttgcccccctaaattgtatacagaatgctgtgtttcagtataaaatgctgaaaaccaaatggaaacttctagaacccaataattttatataacacacagaaaaaaattattagtctaaaaatcagctcatcattcactgtaccaaaagatggtagaaagaagcctcataaaaattcagagttaaggttgtatattagacagaataaatctagagcaaaaataatttttttttcccagaaagcatcaaaagtcagtgagaagtgacaggactgattagaaatttaagaacctggaagtgtcctacaaagtggtagctataagctgtcatgtcatgatgtcatatttttaagtcttaggaacttctgtgaacacatgataaaaggaaatggatcacattacttttaagtaaatcacttattttatgatgcagtatatattttgagcatagtaacatcaccaatctatttgaataatcgtatttgtaaaatccctagaattttaaagatatataggtttcatgttttataactacctcttatattccaaaggataagttacataaattttcatccaggcaagagctgtggagttctagggatttgtagaatgattagttcagtggattttaatggtcacaaaaggaggaaatgatgcgtaaaataaccaaaatgtaccaatttggagcttacagaaaaccatgcaatctgtaataccagataccatgctttccatccaatttactaattctttccagtgacatgctgctgcccgtgtgacacagctgctggcctcatctttaaggcactgaaatgcctggaactgatgatgcagatgctttgcccacgcaatgcttagctccatttaataattgtgcattgacaagtgagtatgcaatctagccattatgaaaattaagctatcttatgagacagatgatggatgatttggggtgacagaatcatgatactactgcctattttataactgcctacagacaggcacaaattcttaacatgatactcattagcttgctttgttcaagcaatgaaacttgcactagacttgcagttattagaaatatattgaagcccatatgtgaaggtagacacaatctctcttggatacttaatatgaaaatcagatggcactacattgtctttactacccctcggaaatgtaaattttggaggtagtcactgcactggcaaatttacaagatgataactcccgaataactaaatcaaaattctattctgcctgaatggtacctatgacagatgtcaattcacctgtcataggtaccttgtacaagatcccaccaaagtacaggagcaatgtttgtaattaccttatatcatattaattggcttcactatatgattatggatacaaaagatttttgcttaagaatgatgtacttgaataagtgttacatttacatcatgaacatgaacattacatgaacattacatcaatcctgtcaacatcaacaaattgtattatagtggtgaaagaacattttaaatcaaaatctatgtagctaccttaaccaggaagagtgacccactgataagtccacaaaactgttcttgtgcaggccaggtgtggtggctcacgcctgtaatcccagcactttgggaggccgaggtgggcagatcacgaggtcaggatattgagaccatcctggctaacacggtgaaatcctgtctctactaaaaatacaaaaaattagccgtgcgtggtggcgggcacctgtagtcccagctactcgggaggctgaggcaggagaatggtgtgaacccaggaggcggagcttgcagtgagccgaggtcgcgccactgcactccagtctgggtgacagagacagactccgtctcaaaaaacaaaacaaaacaaaacaaaaaaactgttcttgtgcacacgcgtacctagttgaaacttggggattgtacaaggtcaactacactgtaaacgtgcatttttcactgtgctctcatattacatgttagatagcataaagtatggcaattatcacaccgatttttttttgagacaaagtctcgcgctgtcgcccaggctggagtggcaatggcactacctcgtctcactgcaacctctgcctcctgagttcaagtgattctcccactacttagccttccgagtagctcggactacaggctcacaccactacgcttggctacttttttatatttttagtagagacggggtttcaccatgttggccaggctggtcttgaactcctgacccctcttgtgatcctcccgccttggtatcctagagtgcggggattacaggcgtgagtcaccacgcccggccgcacaccaagttttggcttttggttaggctgttttcctccacaactacattgaaaaattactttagagaaagaccaagttttattctttttttaaaaatgtgatttcagtaaccagcagagtaccttgtacatagaagatgacaatttaatgtaaatgagtaaaatggataagaaaatggataaaaattttcatatattcttcagaaaaatcctacagctttactttctttcatacagttaaagggctactttacatttttttttgattggctcaggtagctcctgacttacgtgcttctgtcacacaactgacacaccaaataaacaaaaatgacctgaagcacaaaagggtaataaagagcagagagaagaggaaggtcaacattggaagaaggagaggtatatgagtttcctgtctatatggcttttagccagagagcagactgctgcggcttccatgtagtgtggcaaattctccaagtaactggcagcacttttggcttgaagaatcaaaggacggagtttggggcaactcacggccactagaaagtgattttttaaaatcctaaaaggagagacaacatatggagtttctcaaaatctgtaaataaatattgaccatttttcaggttgaccccagaatcgggtatatgctgttcagacttaaagcagtccagctaagtataaaagaactatactgagattggagatattgctgaagaaacagtttatagttgaaattcaagcaggttaattaaccttataacaaaaacttaaacactctttggggacaataacagaattcacaatttcaataacataatattcacaacatccagcttactatccaaacttccttgatataagaataaaaaacatatgatccagtatcatgtaataagatgatcaatagaaagcaactcccaaatgacacagatattagacttcatagagacggattttaaagcatctattttaaaatgctcaaaaaataaagaaaaatatatttgcaataaatgaacacagagcaaaattcagatgataaataaaaatatttaaaaattctaaaatcaaatgattaagtacctgaaatttaaaattcacaagatgaacttgatcacaagtagatgatagaggagagaagactagtaaacctgaagataaaaaaatagaaattatccaagtcaaaatgagagagataagcttgagaaaaaggaagaatattaaatatctgtgaatattaaaaatattaaatatcatagatatttaaatattaaatattattattagaatagaatattaaaaatcatagatgcttcagtccctgatacaaaatgggcaaagtatttgcatataacctatgcatatcctcctatacagtttaaatcatctctagatgacttatgatacctaataaaatataaatcctatgtaaatagttgttgtattttttagggaataatttttttaaaaggctgtacatgttcagtggagatgcaatttttttctgaatatttttgatctgtaattggttgaatccatcaatgaggaacacatggtgggcctactgtacaaagaaatacatgcgtaggcataccataatcaacttattgaaaaaaaataaagagaaaatattggaatcaaccacaaaaaataatatactggggacttgtgatttgaagaaatcctgacttagaaaccatagctaccagaagacattgcaacagtatcatcaagtgaagaaaaaagagagatatatcaatccagaattccatacacaaagtatccctcaacactgaaagcaaaataaagatacaatcagctaaattaaaattaagataacttattgccataaatttaagttccaggcactacatgaaattttaaaagaaaattttaaactgaagaaaaataaagccttagaaaaaatttgttcttcagaaaggagggaaaaacgtcagaaatagtaaataatgagggtaatataaaatatgattttttaaaatttcctgaaaatgcatagtctgatcaagctaaacttattatcttagttgtttgtaatgtacatagatataatacatatggcaattataacataaaagataaagattaagtttacaagatttctacatttttatgtgtgtgatagagtactaattctaagtatgttttgaaaagttaaggatatatattgtaatctctagagcactaagaaagtactctacaatatatagttgtttatttagaacacatattctaaatatatattgtaatctgaagcactaaaatataatgcaaaacttcaagacaccgatcattatcaaagtaaaaatgagctatttaatgaccaaaagatcaacttgtcaatagcaatcatgaatttgtaagcacctaataatagagtttcaaaaaaatcagtgacaaaattggcaggattaaaggaggaaacagataatagattggaaatgacttagtgtaatataagcaaattgaatccagaaatgtgaaaaaaaaagttcatacatcatgaccagttaagtagggtttatcacaagaatgcaagtttgatgtaatatttaaaaatcaatcaatgaaatttacctcattaggagagtaaaggagagaaactgtaacatcatttcaataagtgtacaaaagcatttgaaaataattctatacctattcatgatgaaactatcagcaaactagaaataggaatagtctaaacggcatcaaaaataaagcagttacaggggatactagcaagctggtaacataggaattttcagtcttgactccattctatgaaatgtagcaacaatccacaggatagaatgtctcttagaaggttccagtacttaagtacaagcttgagacaactgcatggtgtctatatttatatttatataaaaatatataaaacaaaaatttaaaaatctgataggagagatagattgtaatataaaaatagtaggaattttcaacatgatactttcaacaatagacagattatccagaccaaaaaaattaataagaaaacattggaatttaacaatactttagactgaatggatctaaaagacatatatacttaccatgccattcaacagcaacagtctcacatccaggtcatgctgatgcaagaggtgggttcccatggtcttgggcagctctgcccatgtggctctgcagggtacagcctctttcctggctgccttcatgggttggcattgagtgtctatggttttccaggcgcatggtgcaagctgtcagtggatctaccattctggggtctggaggatgatggccctcttctcacagctccactaggtggtgccccagtagaaactgtgtggggactctgaccccacatttcccttccacactgccctagaagaggttctccatgagagccctgcccctgctgaaaacttctgcctgaacatccaggcgttctataaatcctttgaaatctaggcagaggttcccaaatcccaacttttgacttcgctgcactgcagcagtctcaacaccatgtggaagctgccaagacttaaggcttgcactctttgaagccctagccctacattgacccctttcagccagggctggaatggctgggacacagggcaccaagtccctaggctgcatacagcatgttgacactgggcccagccctggaaaccactttttcttcctaggcctctgggtctgtaatgagagacgctgccatgaagacctctgatattccctggagatattttccctattatcttggggattaacatttgactcctcattacttatgcaaatttctgcagctgggttgaatttctcctcagaaaatgggattttattttctattgcattgtcaggctgcaaatttttctgaacttttatgctctgcttcccttataaaactgaatgccttgctgggtgcagtgactcaggcctgtaatcccagcactttgagaggctgaggtgggtggatcacaaggtcaggagatcgagaccatcctggccaacatggtgaaaccccgtctctactaaaaatacaaaaataagctgggtgtggtggtgcatgcctgtaatcccagctactcaggaggctgaggcaggagaatcacttgaacccggaggcagtggttgcagtgagctaagatcgtggcaccgcactccagcctagatgacagagcgagactctatctcaaaacaaacaaacaaacaacaaacctgaatgcctttaacagcacccaagtcacctcttaaatactctgctgcttagaaattctttctgccagataccctaaatcatctctctcaagttcaaaactccacatatctctagggctggggcaaaatgccaccagtctctttgctaaaacataacaagagacacttcgctccagttcccaacaagttcctcatctccatctaagaccacctcagcctggatttctttgtccgtatcattatgaacagtttagtcaaagccattcaacaaggctctagggagttccaaactgtcccacattttcctgtcttcttctgagccctccaaactgttccaacctctgcctgttacccagttccaaggttgcttccacatttttggatatcttttcttttcagcagtgccctactctactggtaccaatttactatattagtccatttatatgctgctgataatgacatactcgaggctgggcaatttacaaaagaaagaagtttattggacttagtttcacatagctggggaggcctcacaatcatcgcagaaggcaaggaggagcaagtcacatcttacatggatggtggcaggcaaagagagtttgtgcagggaaactcccctttttaaaaccaccagatcttatgagatttatttgctattatgagaaaagcacgggaaagacctgcccccatgattcaattacctgctactgggtccctcccacaacattcaagatgatatttgggtggggacacaaccaaaccatatcattaaccatagttcctgagttaacgcccgcttttaaaaagctgccttttctcaagtactttaagatttttagctccaattttaaaaacataaaaaattcataattcacacatttttttactgcagtcattgtagatattactccactgttacatactattagatgatagtgcacagagcctgggaggagcctggtttttgcccttttgtacattatctaactttatttccttttcttttattgcgttgagattcataatgatttttattttacttttcaaatctggtgagtagcataagaaggcactcattatagataactgtgcatcaattttgtgagagatattggagtatttttcatttgtagacttgaatctttttttttaagaaagtttctttgagaaagacctttaagatgtctgattagaagcaactggtatttccctcttctacaaagaagaaccaaaattctgagtagataatcacactttgaatagattatctaagagagaacactggagttcaacagaaaaatgacaggaaacatttaaagcaaggaaagagagtgaagcaaaacagcctgctttactgggaccagtggggagcctggagaggttctacattgtgtggaaaggctgagtgaccttcccagaatccatattcccaccatggactcccatgctcctagctacatgagagactctagacctttgtgaaccctgaggctaacatagggagtcacctagacactgcatgaaggcactgctccagtgagggagctcgtgctgggtaccacacccccacaagccctaagcagctacagcaaggcaccatacagacagcccagtcccctctagaccatgtcctgcccagaagcctaacaacccctgcattttcacatccctggagcctcattgacatcccctgctcacagccactgccatggctggctgcttctgtcaaggctgaagcacaatccattggcaataaccccacttctttaagcagcaaagctaccatgcattttcatacaccttcaggacaaacccctccagcagctgcaggctgctgccattgagatcaaagcacagtgaaatgcatgcacctccaacacctgcataaggctgttgccattgaaagcaaccccaccctccacagtatctgggctgcagtgccattgctgtggcccctacctaagcattctgctgggttcctaggggtcacctcacccatgtctaccacaatcagcacctgtgtgctccaccaggggtcctgagggcaggtttgcccagccaggacctaaccaccctgtaagtgcctgagcatgccccctggcaggctgcagaccaaccagccaagttcaccaccattggtcaatgaactatcttcccaggggcctgaggtcaagcccacccagcttgccattaccacaacgctggcacccacaacagctggttactatacatgtgccacctgtggacctggagactggctcactcagcctgttgcaaccactgccaagaccaaagtgaacttcttgtgagccagaaaattgtcccatccctgctattgacattgtccttgtcacacccactgcctagggccctggggacttgtccatctgcctagctatcttctgccattactagcacccaagcaagtcacctggaggccccaaaattgacccccttggacctactaacagtggtaacaacttataccaccctgaggctcaagaatgggcctatttcatgaccccgtacccaccaaaactttatcacagcctccactagcaattgtaccctaggccaatggggaaataacagatatcactgatgctgtttatagccagataaattatattcagactacaactgtacacactgagaatcaaaattaaagtgtgttacccaatgaacaccataaatacatcttcagaaatatgtcctccccttaaaaagtaaattctaaaactaagaagggtgactgttataccatatgagcagttatcaacataaggacacaataaacatgaaaaagtaagaaaacattacaccttgaaagggtcacaataattctccagcaacagagtccaataaaacaattataaaattccagaaagagaattcaaaataatgatattaaagaagttcaggaagatataagatataaaacaatacaaaaagacaacacaaataaatcaggaaaacaattcaagacaggaatgggaaatttaccaaagagatgatataagaagaccaaacagaaattctggaactgaagagttaattaaataaaataataagacattcaaaatcttcaacaatagataagatcaagcagaataaagaatttcagaactggaagacaagtcttctgaaataacgcagacaaaaagtaagcaaaaagaataaaagagaatgaacaaaacccatgtgacatataggacaccataaagtgaccaaatatttagggtcccagaaggtgaagggaaaaataaaagaaatagaaaacgtatttaacaaaattgtcctcaagtctaggaagaacattagactttgagatacaggaagctcagagattggcagatacaattttttgaaaaaggtcttatcttttgtaaattatagtcaaactgtcaaaagtcaaagagagataattctaaaaacagaaagagaaaagtatctgggcatttataaggtatcccccagtaggataactgtgatattctcaggagaaaccttataggccaggagagaattggatgataaatttgaagtattaaaagaaaaaacttccagccaaggctatcatactccataaagttacatttcttaaatgaaggagaaataaagtctttcccagacaagcaaaagctctgggaattcatcaccactagacaggctctttaagaaatgcttaaggaagttctacacgtggaagtgaaagaatgatatctgccaccatgaaaatgcatgaaagtataaaacccattggcagagcaaacacacaaatgataaagaaaggactcaaaacagaaaaccaccaaaccaaaatggtaaatagtaagacagaaaaaagggacaaaggaggtacatacaacctgaaatcaattaataaaatgacaggaataagctcttacataccaataataaccttgaaagtaaatggattaagctttccacttaaaatatgtagactgacaggatgaattttattttaattggttcaactatatgctgcctacaagaaggccatctcacctttttaaagacatatagactgaaagtaaaggaatagaaaaagattttccctataaacagtaacaaaagtgagcaagagtatctatacttatataaaacagactttttgtcaaaaagaacaaaaagggacaaggtttttatataatgataaagggattaattcagcaagaggacataattttaaacctgtgtgcacccaacactggagtatccacatatatagagcaaatgttattagatctataggaagagatcgactccaatacagtaatagttggggacatcaataccccactctcagcattagacaaataatccagacagaaaattaacaaagaaacattgaatttaaactgcacgttagaccaaatggacctaaccaacatctacagaacatgtcattcaatagctacagaatacacattcttctcatcagtatatggaacattatccagtatagaacatatttttgaatacaaaacaaattcttggcaaatttagtgactggaaatcatatcaagtattatctcagaccacagtgaaataaaaccagtaatccataacgagtaattttggaaactgtacaaaaagatgaaagttaaacaatatgctcctgaataaccatcggatcaagaaagaaattaaggaggaaatacaaaaatttattgaaacaaatgaatataataccacaataagatatcattttaccccagttagaatgtctattattaaaaagaaaaaacgatgaatgctggcaaggatgtggagaaaagggaacttgtatacactgttggtgagaacgtaaattaatatagctactatgaaaaacagtatgtagatttctgaaaaaactaaacatataactaccatgtaattcagaaatttatccaatggaaaagaaaatcagtacatcaaagggatacttgctcttgcaagtttattgcagcattattcacaatagcaaagacgtgaaatcaatttaagtgtccatccacagactaatagataaaaaaaagttctatacatacacagtggaatattattcggccacaaaatagaatgaagttatgtaatctgcagcaacaaggatgaaactggacatcaactaggcataggaagacaaatattgcatgttctcactcatatgtgggagctaaaaatatcttatggaggtaaaccgtagaattatagataccagaggatgtgaagggtgtgttggtatgtgtgctgggagaaggggataaagagaggttgtttaatgggtaaacacattgctagatagaaggaataagttctaagattcaatagtgttaccatcgtccagtcccctcgtgaggcccatcatgaggcccctcacgggtccatctagccataattacctcccaaggccctacctactaatagcatcatgtttgaggtcagtgtttcagcagaagaattttagggggacacaaacatttagtctactaccagaaggtaagcgcataaaggagattaggaaaatgaagatattttgaattatttccaagtttttgaccttgattactaaaaacatagtggtaccacgagcagttgtaattatatgggagaaggggagtaaactcagattagatatgttaagttagtgttgcccacacaaacttatggtggagctccacaataaccaggcaaatatacgagactggggctcccaggaactggcagggatgatggggagatggcctagctgtgagccagccagaatccaaggagactgcggagagtgagaagaaaagggtctaatgaagaaactgataggaacctaaatatcttgaagggggaaaaaaagctcttaactgatatgactgtttgttaaaataaaatttcaaaaatatatctactatttactaaaatctgatatcaagtagtataaaataaataatgatggcaaagttattttttatgcattcataaatgtaatagattttcagagaatgatttgacatttggttagagcctgtctggcaaaaagtgggaaacagaaaagtatttttggtgaggaaaggagtaggagcaaataaatacagggaggaagttatgcaaaattatcctagaatgattaatattttgaatgtaggtttgttagaatatataaaagggaaaaaagatactaatggaaaaacagatttggaaaaaccaatggaatttgaacttcgtagtttagatattagttaaacaagaaaaatttttgctacatattataaatttagataactgcatgatctgtcttgataattaatttaaccactgcttcatgtgatggactggaaaatcctttttagcacactgttcacttccatgttaataccactgcttaagaatcttggaagtgaattaaaatctaaatttaaagatacagaaatctgattttggccaatagtatcatgtttatattcaaaggagaattatgaatagttttattccccagagattgattgatttagcatgacaggtaatattctcaacatcactgctgcatctcaaaagtaatttagcatatttagtatgatgtttcatagcacaaaaaaatacattttggctagctttttattcttttacattaaaatgtgtatcacttttatgaatccttacacattgtgctttaatcatgcaatgctatattttaataaattcttatgtatttatagaaggagtatcagaattaaaaaggtgtaatatttttattcttgcagcactgaattgaaagacttgagagcttaaatgtttaagactcaaaagattctttttatctatttattgtcactgtagttctataactaggccatgggaaaaaccatgtcattttagcacaaaatattagactggcagtatgtttgtttgcacattaaatcttacatgcatctgaaacaaagcctgaggcacaacacctttgggaaaatgtacagtttaactaaaccagtgaaatgtattaaatggatattgacaagcattttgagtagcattaacattcaattttagataacacctataaaatgaatggtcaaaagtgtaaaatacttagaatctttgattgagcaatattatgtaagatgtttaagccaagctgcttattaaagccatatgcacctgtatatgcaaaacaaaaaatacaaaaaaggtaaataattctgatgattttcaaacaaattttgacaagatattctcaaaatgatacagggttgtataggatataattgtatctgtgtaacaatcaattcattttcataaaacagttgttaattgtacagaaaaaatacaatattttcattaaggtcggcaacaggaaattgtgcctcatatgatggctaattatttagcattattattggaaattttagataatataataatgtcagacaaagacataagagctaaaagatttaaatggaattataagtgaaatgaaataaaggaaatcacaaaaatcaggaaaatgtataaaatactgctaataatgacagagttcaataaatgtatggatacgtgataacaagcaaaaataattagtatctttatacaagaaataagtgcaataatgtttatcttttaagcctgttctgaagagcaacaaaaactggatggtcactaggaatatgtgtaaaatatatgcacatgtgcatggtgcctaaaatatatgatgccattgaaagctttaaagaagaaagggaagatgtactatttaaaaaatgtaaattctctacagatgataaattaatgcaactttgagccaaagctcaataggacattttgtggaatgtaaaaaattgtttctaaaagttattgaaaatcatcacaatatgcggggtatgtggcaggttgtcatttcaggtttcagggcataatttaaagctctaatggttgaagttgagcaaggtatagaaagtgcatcatccaatggaaatcatagaaagaaattcctgcacagttcaaggcagattacagaaatactaaatttagtaaaaatgagtaagttgcagaataatacaaatactaaggcagcatttatgtaatgtagaaataaaaatgataataagtatctttttatttttcatgcttctgtgtgtgtaagcatatatatttagattgggaagtttgtttctacaaagtgtgcagtaaaataaaactaataattggggataaatgaccttaactttatctgtactgttttctattaaaaaaaactttaaaaattatttcatttctaataaaagcgaatgcttatacactgatggtaggaatgtaaactagtacaatctgtatggaaagcattatagagatttcttaaagaattaaaagtagatctaccatttgatccagcgatcccactactgggtatctatccaaaggaaagtaagtcattatatcaaaaggacacctgtatgtgtatgtttattgcaacacaattttcaattgcaaatatatggaaccaacctaagtacccattattcattcattaaactgggtggataaatacacacacagacacacacacacacacacacatatttttatatatataatggaatcctacaaagccataaaaaagaatgaaataatgtcttttgcagcaacttggatgaagctggaggccactattttaagtgaagtaactcaggaatggaaaaccaagtatgttctcacttataagcgggagctaggctgtggataggctaagacatacaggtgatataatggactgtggcagctcagaagtggagtggtgagggatgaaaaactacatgttcagtacaatgcacactgctcaggtgatgagtgaactaaaatctcagacttcaccactatacaactcatccaggtaaccaaaaaccacttgtacccccaaaactattgaaataaaaaattaaaattaaaaaataatataacattaagtgaacaaatataaatttgtgattgttgtagagttttttttgctatgtttgtgctttgtagaatgtttcttaattttctcaaagcaaaatatcatatagttgttagaaatgatagatgaataaagaggtgttggtgattcctagagcaggctagctctgtgtcctgctctcaagaataagaaatacacaacagcaacaagcatgctcaggtgaaactctcagatcagctgacaacaaacagtgctagtgttgatagatgagaggccaaaaaataacaagaatactgtctcagtctattttctgttgctataacagaagaccataaattggataaattataaagaaaatacttttatttcttacagttctgtaggctgggaagtccaagagcatggtgcccacatctgtggaggctttcttgtgatgtcataacatggctgaggtatcatggcgagagggcaagagtgtgaggcatcatatggtgaaagggcaagagcatgagtctcggctgaggttcctcttagttttcttatcaagccaccagttccatcatagggggccccaccttcatgaccttatgtaatcctaattacctcctaaaattcccaccttcgctcctcatatgaatttgatgattaagtttccaacacatgaaatttggggggcatatttaaacatggcatgcacccacccacacatacagcgagacactttttggttacttgttaggtcttccagaaatttgatacaaagaggagaatctaaattgattcaaggtatgtcacctctaccatatgagatagagattaaaacagaatttaagttctattacaagaaattgtgaaatagtatttttagagaaatgaatttatgaactgatattcatatccactgcaatttataacttccccacaatttgaaatacaagttgatttagccttagtttggctaatttattatagtccttaaataatgtataaaatgttaattatgatgccttaaattttatgtgtatcataccatatgatatcatacatgtagactacacacatatatacgtatcacatgatatacatgtgatacatgtatgatatacatatgatatacacgtataatcgttcagttcttaagatggaatgtatttagataaaaaattttatcttcactcaatctaaaatctgatttttcactgaaatttatttatatatgctaagtatagccagcatttaattgtgtgagctacagttttcaaggtcacactcataatagaaatactaattaatagttagcacttatgggctttttatctcccaagtacttttccaataattaatttaatactctcaagaaccatgttacttctgttagataaaaggaaggttatactagactcactgggaagaaaattatatcagttatgtcttcacatacatttgcaatatgtatcaacatgaggtaggaaaaataaaagggaaataaagcacatataattcagcttatctttactgtgaagttgcggatttctagaaacatatgcccttttcctaaggtgtaataaattgaactttaacaaagtgtagaatttaaatgttcttctggacaattcactaaaagaaagccataaatgcagtcaaaatctatgataacactagaggagttcataattacttctgatatgtacattttatttcaacataatttattccagatttcgtttgttaagcaggagacaaatgagatattttgaagcacagtctgtcatatatttttggggatggctgttttgagcactggaaccatagtcttatctttgttacaatataaattttccataattctgttgcaatttagaacattctggctatatgctattaaatcaaaccaaacatttcataatgtagatgtaggccaaaaaaagactcaccatggtttgccgtcatattaatgttgtgcctataaaatttggtaaattgatgtgctggtggaaaatgctaattgttaaaacctgtatttattatcttttttgttacctttaagtgatctcaatgagttgcccttttacctctatttataaaattgaaatataattcaattttattcttgttaatagagcaaaatttcatgtcataaatgcacaaaaatgattcacatcaatattttgaatggatttacctccaaaattaattcaacattgggtaataaaaaaactcggtagagagagttgtctaccattctcatagcaaaggtcattcttctttggtgaactggctgtctaaagtcatcgaaggtgtcatcatttcctttaaagagtcaggtgactgtgttcttggagaatttcaatttagtgaattacatgctaccaattagatcaagagcaccacttttttcctacttcgtctctccctccctcctgtttctctctcatattccttctacttcctgttctctctcttcctcttcttcttctttataaacagctgtcagtgcctagttgattagcctccggtttcacccacacgcagttattttccaggtgctagcactgcaccctgcatgcatagctttgtgataaactttatacatttagtctgcatctgtaaatgtgaaagctttcatttaattggagaaatgttcaatacgtctagctgacgctgtgcctaatgtaagaaagtgaagagttgtagcaaatttaggcaaaataactattattaaacagaaagttatttttcttttggaagaatcatttatatttattaaaaatctcaatttactacacaatttaccaactattcaaatactcactttaaagtatatagaataaacaccttttatttctcactcattcaaatattataactagttgataccttaaaaaaactgagttatagtggttttctattattggtctatttattcaaaagcctagtttatctctcatttcttgttattatttgtctaattttgtcagaattttggaattgtttcaataaggagatggttacattccaataaggagttaactaatgaatagttccaaatatcaatgttagtattcttttagtggagtttaagaatccgtcccaagggcttgtctagaaaaggatttacaggtaagtaatctactattttctgaaaagtgttgtttctaatgatgatacacatttggtaaattattgacataaacctaaaaaaaatttttttcaacattaccaatgttattggctgatgacagggttcaactacctatttgttcagatattttgggaaattctaactgcattttctaatctgtttatcagcaaaaatcctagcatttctatggtaggctaaataatgaccctgaagatattcacaccctaatcccaggaacaggtacatgctaccttacttgacaaaagagactttgtagatgtgactaagtatcttgagatgggggattacttgtcttatctaggtagaccctaaatgcaatcacagttacccttaaaagagagaagcagagatagatttgactacagtgagggagaaggcgatgggactatggaaacagagagtggagagatgcagccaggagccaaggactgtgggcagcctctagaaatggcaaaatcaatgaccataatcctccgcaaagctaatagacataaccaggcttgttaatactttgactttatcccagtgaaactgtcagacttctggcctttgtaagtgttaagagaataaatttgtgccattttaagccaccaagtttgcggtaacttgttatagcagcaataggaaactagtccaatattctttaaaatcccttccccactaaaaagctacacagtcactgtaagccagtaaataactgatcacacatgtatagaatatttgctggtaatcatatgtctgtgctttatattttaatagtcaatttttgttttagtattttgtttagtgagcttatacatatatatgtatatgtatatattctaacttgcatttatttcccttttaattctcacaaagaaatcaccaacatttctccgtccatctacctgcaatgtaaacaactcatctggtttttaagcataattcattttgtaagtgaccttgtacagttaaaatgattttaataaggtattcatcacgaagacatttggctacataacaataaaacatcttctgctttgcagatagaatatctaaaaattcagagaggagatgtccctgtcttaaaatctgcctgacatttcacaatccatatttggttgggtagaatttattttagctagttgaaagaaaatacatgccttgtaaaccctgaggtgccatcttagtagcagattgcacaggaagtctctcatcacgcttgttatagaaaactattgtttcatcactttgctctcagattcataatcttgaagtgcatacacattaaaaacatattcataaaacaatttaataattatactcagcagaaagtgtgtatgaacccgtctctacgtgtacttaatcttttttataaacactaataactagtcatgaaaaaggggatcatctcagtctttgcatgtcagttttttgccataaaggtggaatattgggctgcattatctctcttgtctgtaaatattcccaggatactacttttttatggttaaatcaataaaaagattctctttgtgactgttacctccaaactgtggtgcccaccctgtaagcctggttcaaatcaatgaggaactgatttgattccacaagcaaaaaattacatccagttagtaattctcagagagatgattaacattctttttaaaaaaacatacaagaaatagaagtaaattcttccaagtgaatatgcttgtataaacgatctgcagttatgactgttaagaaaattgcacacacttcttaatgacccatgaatgtcctcatgaggttatgcagactcctgtaacttccacatgtataattcagaaatggaagatcaatagtaaattacctggaattatgcaattcttagcattttcaccctctaggtaaaagtcaagcaagttttgtgtgtgtacatgtgtgtccacacgtgtgtgtgagcacatgcaggaggtgagaagtaaaggtgaggatgggttgtttataaaatgatgtttggaccaggggcggtggctcactcctataatcccagcactttgggaggtcgaggtgggtggatcacctgaggtcaggagctcaagaccagcctgaccaacatggtaaaaccccgtctctactaaatataaaaaattagccaggtgtggtggcgcgtgccggtaatctcagctacttggaaggctgaggcaggagaatcgcttgaacctgggaggcggaggttgcagtgagccaagatcccaccgttgatctctaacctgggcaacagagtgaaactctgttgggaaatgataataaataaataaataaataaataaataaataaataaataaataaaatgatgtttgggaaacttgcctgataacaaaaagtttatgccaggaactgagacctatattttcttttagaattattcactggattttatttctaattaaatgaacatttcaagccaaagcataatttttttcttgggaatttaatcatatagtacaagtcaatatttgcacagaatttttttttttttttgagacggagtctcactctgtcaccagcctagagtgaagtggtctgatttcgactcactgcaacctccgccccccgagttcaagtgattctcctgcctcagcctcctgagtagctgggactacaggcgcgcaccaccactcccagctaatttttgtgtttttagtagagacgggggtttcaccatgttggccaggatggtcttgatctcttgatctcgtgatctgcctgcctcagattttaagaggtaggttgttcagagtgccacaaaataaggaaggaaaaaaaaagaacacttacatggaatttgacttcaatgcctaaggacccccccaaaataagctgcagacaattttcccctgaagcatcacatgaaagtgggcaattaaggtgggcccccaccttggcggctgccaatgctgcccctgcatactcgttgtccctgggaatctagtcctccaaaatgttaaaagggtatgctgtgcgctccactctctttattctcttcctctctaaactgaacacttcctccttcatgccacagaccgctgtggcagccaaacttggcaacatttccattaggacgcctaaaactgtgtcattacattttgggtcccatattttccccttttaagttgttctaacataaaagcctcttactgagattagggagaggaacgtggtaaatcattacagctcagtatttgctacatgcaaaatcaaaggtatagccttggaggcagacgagaaatacaaacctgcatgagaaaaatattgtgcccttatgttccagaacagtccatacagttcacttatttagtgcctattatctgagagtgtggcctatgacttggggcaattggggcatagcataagtggagatgagtaaacatggctgttttcagtcacctagagcctcatactgtgaatgtaagcagcatattgaacaattgagatgagagatgcaacctaaatgaaacttattttttaattcagtggcgatatgcttcacccccaaaaggacgaaaccttaagtaggtctcctcacttgcctgttcctttataggaaataaaatgtttaatggtcgctttacattataaatacagttgaccgttgaacaacatgggtttgaactgcatggtccactactaatatgcaaaaattttaaaccaaatgcttactaaaaatgcagaatttgtggcatgccaaatccaaatatatggagggctgacttttcttatctgtgagttctgcagggctgactgccagactggagcttgcacgaatttgggtatacacagggtccttgaaccaattccccacatataatgaaagatgactctactgtcacatgttatgattagaatattcattccaaactgttaaacgacaccaggaacctgatgtcaggtttgcctttatctttgccagctctggcctgctggagtgtgggctctagcactgggaagaggcagggttggtctcttctcttattcctctggccagtttttttttcaacttccactcataaccctcttgggctgttttggactttttcagggaaagagaaaggatgagaagtgtggaaggattttcttgaacaggcagatattggaactttcttctgtcactttagtgaactctttgctacttccagcaccctgggtctttttgctgccattcactttgcctggataggtgcttctgtactctgggtgctggcttgccagccattcccaggctccagtctctgacattcacctccagccttttgtatcctgttgagcagaacccaagacagctctctctttcatacctcacatctgctccttggctcattttcactttctcctgctggctctgatagaaacctagcagttctctgcatttccccactgcaaagaatgtgtgtcaaagcattactgtgagtaatctcagagactgtcttagcccatgttgttgctataaaggaatacctgagactgatgaattcattttgaaaaaaggtttatgtggctcatgattctgctggctggaagtctgggcatctggtgaaagcctcaggctgcctttactcattgtgggaggcaaaaaagagcagatgtgtgaagagatcacatggtgacagaggaagaatgagaggcagtggggtggtgccacacttttttttttttaactaccagctcttgtgggaactaatagagtgagaactcaggcattaccacgagggtggcatggagccattcatgaggcatctgctcccatgatccaaacaccttccactaggccccacttctaaactggggatcaaatttcctcatgaggtctggaggagacaaacatctagactatagcagaaactgacctctgtcccacatccgcttgtctcatgtatgaggcagcctgcaaatgcctctccttttgggtgaggacacaaagttcaaagacacctttctccaaaaacacatctcttcactatctatctccactttctgctttcttttttataattctgatagtaccatgaggtcctggagatagaatcaattcataattattcctgtatagattccgcatttgaggatcttttcccgcactcaactacctatctcatatccattgcattcatacctcagtctaaacagagacaactcagctcttaaaatcttgatagcaggccaggtgcagtggctcaagtctgtaatcccagcactttgggaggccgaggtgggtggatcatgaggtcagcagattgagaccatcctggctaacacggtgaaaccccgtctctactaaaaatacaaaaaatttagccgggcgtggtggcacgtgcctgtagtcctagctactcgggaggctgaatcagcaggagaatcgcttgaatccaggaggccgagcttgcagtgaggcgagatcgtgccactaccctccagcctgggaggcagagcaagacttcatctcaaaaaaaaaaaaaaaaaagaaaaaaagaaaaaaaaatcgtgataacaaatactcgcaatacaatgtgaaaagtgaaccaatagatacatcagcaacttattaggctaggaaaaggtggaagacactggccctgtctagaagtgagtggctagggggtgaagaacaggtcaatgttgaagacaaccaaacatttgagcaggaccttggaggaggagctctctggactcagaagaaggactgtaaaggtaaaggcataaaacaaaagctctgaactggtgatcaggacctcaaggtggtaatgactttacgatttgggaatctttttggtgtgatttgaaagattaaaaaacaggattcttctatcctaacacttcctctctctccttgccacgttaagatgtgcaaactctctggttctccagaatcactgtggtttcatgcatactttcttaaggccaatattaaattttatttcaatcaataacaaggtattgaattatcaatatgtttaaaaaaccatgtgaaaaacctgaaggcattcaaacctaagtccctaagaagtggacaatgaacgagagaaagtaagccagctgcacaaagagaaagaaacatttcactgagcactgaattggtgccaaatacgttctgtacaattccaggttgggtatttattatctacattttagagatgaggaaaaatgtagacagaaagtgaagtaatgggctagatctcagagacagaaaggggaagaatttgaatttggatgtgcctgctccaagtcccctttcctttccatgacgtattctgttgtccttaaatgtgacaaatgcaagctgtaatcaagaacgaatcttaagaaagagataaagtattataagcctacagaaaaggatggagctcatttcagtttgaaggactaaaagcagtccttttttattttattttatttaagttccagggtacatgctcaagatgtgcagatttgttacataggtaagcgtgtgacattgtggtttgctgcacctattaacccatcacctaggtattaagccccacatgcattagccattttttctgatgctctccccaaccccctgtcttcctctgacaggccccagtgtcaatgtgtgttgttcccctccctgcgtccatgccttctcattgttcagctcccacttacaagtgagaacatgcagtgtttggttttctgttcctgcattagtttgctgatgataatggcttccagttccatctatgtccctgcaatggacatgatctcattcctttttatgactgcatagtattccatggtgtatatgtaccatattttctttattcagtctaccattgatggcatttgggttgattccatgtctttgctattgtgaatagtgctgcaatgaacatatgcatgcatgtatctttataatagaataatttatgttactttgcccacgttttaataggatttttttcttgtaaatttgcttaagttccctgtagattctgtatattagacctttatcagatggatagattgcaaaaactttctcccattctgtaggttgtctgttcactctgatgatagtttcttttgctgtgcacaagctctttagcttaattagatcccatttgtcaattttggctttttttgcaattgcttttggcaatttcattataaaatatttgcctgtgcctatgtcctgaatggtattgcctcgattttctttttgggtttttatagttttgggttttacatttaagcctttaatccatcttgaggtaatttttgtgtaaggtgtaagtaaggagcccagtttcaattttctgcatatggctagccagttctcccagcaccatttattaaagagggaatccttttcccattgcttgtttttgtcaggtttgctgaaggtcagatggttgtaggtgtgcagtcttatttctgagttatttattctgtttcattggtctatgtgcctgtttttgtactagtagcatgctgttttgcttactgtaggctggtaatatagtttgaagtagggcggcatgatggaagacagcccttcttgtaggaagatggtgtttgaaggatgtaaaacaggcagcccaagacttaacaaagaagtcagttgtggcaggaagaagaggaagagttttcagcacatgtagggagagggggaaagctgagggccattccagaaaaagaagagtctagtttgaatgccatatgtcatgaggtttggtgtatctaggagatttgtaaaatttgaggctctaaggtcagaatacatggtattcacttaattcaatggaaaacaaagacttactaatgtttttagtaaaggcatataataattaaatccgtgtttaattgaatatagattcccacacctgctgtgtgaagcctgagtacaggtacacacactcacacacacactctctcacacacactcacacacactgacaccctcacactttcacactctcacacacacactcccacacacattacacgcacactcacacactctcacacactcacacacactctcacatacacttacacgcacacagtcacacacagtcacacacacacactcacacacactcacacacacactcacacactctctctcggctaccaagctttctaaagagaaaagataatgtattattaaactttgtttaacaagaactttgtttgcctatgtgcacagagttggtatcaaaaatatttttaaaaatattaaataactgacagtgtagatagagatatgaggcctttcaacaagccagttaaaaaccatgttatggtagtgcaggggagacatagtaaaatctggaaacaagatagatgagtgagattttaaatgcacacttttcatgaattaacaggtaaatacacatcaagaaaaagtaacaatggttcagaatactgtaactttggactataattagagtgggccaggttactttaactttggacatttacaatggcattatgaggaaagagaaagtcagaaggcaggttctatttaatttggaaagggtgaattttttatccctgtttatgaactcacaagatcagtttcttggcttagtttgagatcatgataaaaagagagtgggtctggcagggtcagacaacaggcaagtaagactagacaaggaggaaaaagaagagcatgtgacagcaacgcgtttcccatggaggtggggtttgggtggaggtgacgggatctcaaaggaaggccttctttatacagtttattgtcttcaccaagattggcacgaagaatagcagtaaaaggtgaggctgaaagtgctccaggctcttgtcaggaaaaatccattatttttccaaagcaagaaggaaccaggcattgatatttaaaattgcctttaaacaagagtaagcaatgatagatgaagagagacttgagtagcagaaaaagaaaatgaatagaactaatgttaggtagcaggaaaatactaagtgattaattctgaacacattgtagaggaacaggcatcattatttcctctgctctgattgtgatgaaggacgagaggaaggcaggcaaggctggcagtgctataatccagaaagatgaggatgcagactaccatgttcttagtagaaagagaaggaatccctttcataaatgagacaaaatcccaccaaatgaaaacattctcaaaactagagggcactttagttttattttagattattgcaatactgtagacaataatgtgcaccaaaacctcaagaaaactccccctgtgggtcagcatgaggagttctgggcataagttcttgaggcaggctgcctggactttcttctagcaggtgatatgatgtttgacagataccccagctctctgcttctcagatttttaatctttaaaatgggcatagagtagtgcctacctcagtaatgagatactcaaatttgttttcatatgtaaagtgcttagaatagtctttgttaaataaacataaataaaggtacttgtgggaaaaaggtgattctaaattcaaactataaatttcagtgtaaagacgatacaacaaggaccctccttctcacctagaaataactttagttctgaaagctctccaaacttactaactttttttagaccttccaatttcttgagaattactgaagcccagagaaatcaaagttgaaactcagggacagaattggtaccctaggttaattccaatttttccaaaatccttaaaatagtacctggggctctactcctgacaacaacaaaagaaagactagataaggaattaagaaggaatgatgaatataaaatgaaataatatttatgtatatattatcgtgatttctccactcttaaaacattttccatatctctattgcaagcaagaagatttcattttaaattggatcctgagggttaagcagaatcaataaggaacttcagagtgcacagaacttaaattatcaatattctctgggacaataaaatttatcatcatgcctaccctagagtgaaattattttgcttagaaatcatcagaaacataaataatgaagatcctcaccacagagatttatatttatatcatgttcaaaacgtaaaagatttttggaggtaaaaacccaaggcaaaaagttctcaaaatacagttatgaaatgagcttgatgatttttgaaaggtatataattttgcaagtgttaaggactcagtacttctacaaagataaccttaagagagcattcaatcatgaaaaaatataacaggcttagtcacttgttttcccctagagtccactattcagcacagttacatattaagtgtccttgatctaaccccaatactcacaccttagtattcatgcatacatatccattgattgttttatttgtgagtgtgacccagagcaagtttcacgattccaggtttactatagggcaaaacgagttatagttaataaagccttttattacctaagtgcaatccgccactagctacacctgcaaagaaacatttttggcatggtaggtgtgggaaaaggactgaaaagggaggaaatgatgaggaattgagcaagacaaataagatgatactaaataatcatgacatgaaattgttattattttaaaagctctatgtaaggtgagtgcaaacacctatccaactattcactgctttatctgagatttggctctcagaagattatgtttgatttaacagtatgctaatattgataagataatcattgtagtatgctttaaagttctcttttttgaacacttctttgactttatttgcataaatcttacatatgctttgcattcaacagaccaaatgctgtgtcttgatcataagaatgggaggcagatggtccaaaacatggctgagatgtctctggaacgcttaccaacttggggacattaggttggtaaatatatgtttctctgtatatcagacagtgacaatatttcctctcatagttgtttaggaattaaatgagacaagtatgtaaaacatgtagacagagcagagatgctgtcagtacccgcaacgaggaaattgcaccttgccaagattaaatgacttttaatttagaaagaaagtctcacaggggatgagggtcatagccaagctgagtaatcaagtttgtcttatctctggccatagttttctaaaagcactagacattataaaacttggctttttattctgattttgggcacttcacaactttttgtctgatttcctaacctcaaatgtaatgatagattgaggacttgaaactgacaaattggatttgactaatgctgaaataactgatctccactgcagttgctgcagagcttgtagaagtgacagaaacatgtgagaccatgacaacaaaaactcctcatcagtgcgtagctactggacacttagtggcaaacgcaagtatcatgacattgcacacatgtctaggatggtgacggtatgcatatttcttgaaataatgtgtgtgctttattttgcaaaacaccatattgaaggatatgtgtggagtaagatggcggtaattctcaacataaaaattgttgagataatttttagtgaatattttattatttattaaaattattaaaatgccaacaatacagaagtatataataatggcaataaaattcattaataattttacctacccgaaactattattttgaattcttagattttttttgtattgtatatgtagctcccccacccctttctttcttccctagtggtaattattaccataatacaggtgctaatcattcccaagtgccattttgtaatttgtattactattaacaatacatagtattgttttatgcttttagaacttacataagctgtatgataatgtacatatccttctgcaacctctgaactttatattacattttagttatttatccatgttagcacatataggcccaatttatttcttgctactgttatggaatattccattgtttgaagcaattatacttacttgtgtaattcttgctgagaaggaaataagcaggtcccctactttgctacaacaaacaatgctatggtgcagatgcccggatgtgtttccttgggccaacgcgggagtgtttcttcaggacacaacactgaattgccaggtcatagggtatttgcatctttaatttcactaaatgttttctaattgctccttgaggaggttttatcaattaatattttcactggctgcatattagtgtcccctttttctcaccaccatcaacaaatggttgtagaaagttgagagtgatgcaataacttactttcctgttaatttgcattttccttattataagtgatggtcaagaactttacacacaatagtcagtgattcaaatttccggtgatattcattttagtggatgatatcaccatcaatttggttgcacctgccagaaatctagaggtcattcttggcccttctgtctctctcattgaccatcaggctcttttgattcttcatcacatgtatgtttcatttcttttattcatatctctgccagcatcctggcccaagccacaatccttggtctacatacaactacagcaggctcccagctgataccccactccctagttttgcctccttacatttcattatccatctaaaccatcaactaggatgattgcttttagaggaaattatgatcttatgttgttttttagttaagtaggtgaaatgagcaggcaacataaaaatctctctctgtctctcatacacacacacatgcatgcacacacacacacagacacacacacagacacacacacatatttgccaatagatgtaaaataatagtttggctttctaggcctcgactttattaatcctcttgttcaaaatttaacagtatttctctgtatcaataagttattaatataaggcttgatgcttttgatataaaatttatttaaataaaatgagattcttttctatagaattaaatataatcacttagaagactgaatattttctttctagtccttacatattatcttaatattacatataaccagccacttgccttgcaacaaattaaagtctaacattacctaaccagggttctaaacaccaaatacatttctataactgaaagttataaaataattttgtagtgatcatccattaaaaattttcatttgccttagcattatcctcaaatcaacatgatctaaaattatagcgtgcagtttatcctttcacataattgtactacgttaaatctttggtcagatagtcatttagtacctattataaatctctgatcatgagcccattaaatgtcttttcatagaactgcaaagtgagatagtaattttcagttaagtttagccaaactgttttgacagttccttttacaaaaggttgtactttacataatattttggtgcatacttagagtgtttaaaaaatcttttttaaaaaaggttataatactattttgtatgtctaacttaatgtattgcaagtcgaaaatatttccatgcagacaataaagtaagaatatataactttggtatacagtgtgtaccatagattaaattattggccattaagttaaacatattgcccggctcttacaaagcggtatctagagcagtgcgttatctaaaagatcctgtggattgaaaatgccagagctactaatttgagatctatgtttgaaatattttggtttaggcttggggatgacctctatttaggaacttttaaatttttcatttggttactgcccttaggaaaattctcaagatactatacttgatgtctctgctatatatttgcaagggagaagatgctgacatctctgatgtttctaatcgcattaatttgtcaaataatatttttttctcataaacatcagcaatgtagttgcccaaatatataccaaattgcttcatgttctttggttacacagcatctctaacccagtaagtcctagcactctgaagagaagatgataggtcacccattttctgctctcccatgccaattgctgttgtccttccaggttcccagggatgccagaaatctgttttgatcccctaaggaaatggacagctagtttatggacagctattcctcttcctgatgggaagaaatgcattgcgtgttatcttttatcacttagtaaaaaggcttcatgagcttacttgcaggtggtttgtacttcagactataaactgtccgatatgattaatccacagttaagagctaagggttgtgatgtttacgttgatttcatcatgctaagaaaattcccttaacacattacaatctgttgattcagtcaagaagtatcattttccaatattattctagaaacttcatttttaaagaatgattattctaaatattagttcagtgatgaattatttcgatgttgaattagtttcctaggactttcataacaaaataccacagactgggtggctaaaataaacaaaaatatattcactcagagttctggagccacaagtccaaaatcaaggtgttggctagaccttatttcttctctagcctctggggaaggatccttccttgtatttttcaggttctgatagtctcaggcattcctcggtttgtggcagcatgactccaaagcttgatttctgtcttcatatggctttctcctctgtgtgtgtgtcttcacatactgctctcttgtgtgtgtgtgtgtgtccaaatttccgtcttataaaaggacaccagtcatagtggattaaaggtccatcacactgtagttatcactcaatttagccaattatatctgctatgacccttttcccaaacaatatcacgttctgaggactgggggttaggatttcaacatatccttttgggggacgcaattcaaccataacagatggttatctaaaactattaaatattgattgtgaattgcagggtataggcatatggaaggtctattataaagcaagtgtcatgaagagtagaaataaaattgtttatttttgtaaactggaaattcataatgtgtgaaaatgtttgctcaatttaaccaaataattgtatgttgtatacaatctgcaagtgaagtcagtcatggtattcatcaagtcggtcaaggaaacacacctgtaaaattgctctcgctccttgttcagctaaccatcattcctcaataatttgttgcttataatatttcttaggttgttaagatgaaaaatgggtatccacatcacagtattattgtaatgtgtcatatagaataccctacaggttaaaagcagaattctggggatagggtgcattatttggaattcaggctctgtcacttatcagtaattcagccttgggcaatttacttagcttcactctgccatcgtttctttacctgtacaataaggataatcatattagctatgtgatgtggttgttttgaaataaggcaaatcttctaaagtatgcaccaaagagtctgacaaatagaaatttcttaataaatattttctattctagttattgttaaaatgtccattattcatttggtatacaaaataattactatattttagtcacataacacatcaattaatgacacttcaaaagcaacctagaagaatttagatgcagtgtatgtaatctttcacccatgcttgcactagttggaattgctgttagtttggggatcttccagatgttcatgttcttctatctattgtatatcttttgaaaatatatagcttggtttactgaatatagtaattcctttgttgagatgggaccatactcttttaacttgctttcataccctctcacaaccaccacagcagatcaatggcagtatattataaaattctgacagaacagtctacagtatatatataattaaagagaatattcaacaaaagaaagatggttgaatctgtactgaacatgtatagacatttttcttgtcattattccctgaacaatacatacaattccctatacaatacattattccctaaacaattccctaaacaactatttatgaggaatttacattgtgttaggtattataagatttataatatatttataatatatagtatatttataatataatgcctaataaaatggtattgagtataccaactagattacttataatacttaatacaattagtacaaagtatcagtaccaactgattacttataatacttaatacaattagtaaaaagagaatgtgcagaggttatatgcaaatactatgccattttatataaacttgagcatcagtgggttttggtatctgtggaaggtcccagaaaatcccctatggatactgagggacaactgtacttacaacaggggagtttacttcactaatgtggaattttcagcagattgctgatgcccattagagaaagattgattggtgttccctgggacactaatttttggaacaggtgattcccaggcaagaaggattgaataatctttacagttagacatttgttgtagcaaagaaatgtggtttttttaaaatgcagtttagcccctagttaaagatacagtatatcaaatatcttaatattaggcaagttaataaaatttcagcacatggtaagaatttaggaaacttttttgacttttatctaaaaacaatgtttctcaacccagggcaatattgccttctaggacacatttgacaatgactggagacattcaatttgtatgtaactgggaactactagtgtcttccatcattggtggaggccaaggatgatactgtttccttaagttaaaaaatccccagttaaacacaaattctctaatgttgtattatttttaatgaaactgtttttgagatcctagtgttcaccagtaacctttctgaatatgtaatcactataccaaaaagctcttaacatttagataaaatattcagtaactgcttaatggtgaccgcgctcgtacttatgtttttgactctgattcatcatttcccgatcagcagtttttaacataattgaagtatcaacattcctttgagtttaatgttaattaataatatggttctggtctttgaaaaatgtgcatgtctgtaatctcctttgactttctgtaatattgctggaagttcctagtgactaaactcaagtacgttaaatcatttatacttctaaactgatgtcctaaaccccaaacactgattgagattaatatagtttaatcatttaattgactcaggcacacaagatctaaaatgtgagcatatatagaaaaacaggttatttctaaataataaataaattgtacgataaaattttacatttactactttggactaaattttggaaatgaaggtgagatttttatgctctcttaaaataaatatttatggcataaagcacactgtctttacatcttgaaacagtcctgtcatgttcagaggcctaaatctttactttgctaagcactgtatcagtaaattttggaaaatttttgttttaatctaagtgataaatgactagtcatgaaaatgttgtaacgtatgtggtaaattaggaagaatacgttgaaaaaaatcattcaggttttatcagtttggaattgtgacccaaattatagctgttgaggcagaaataatttgataaaggtttattggaagccaaatgtgaggactgacctgggaagacacaccgaaaaggttaggaatttccagaatctgttacaagttggaaggtgtgaataggaaactttaggagagggaggagaggcttcataccagagttgtcccttctggtttgagagtgtgatacagaggttacaatcattgtatacagattgcaacatacaagctaaaatgtctacctgcaagagagtcagtaaaacttcatgtttcagaaataaatcagggtccttctcagtgtccttaggttatgcattaatctgtacatcaacaatttgagaaactaatgataagattctttactcagggacagaaggtcaccatgaatcacaagactgtcacacggccagttattttggaggcctatttacttttaaagtaaactgtccggtatgacctgacagtgtgacctaagttatcagaatatagacctacagcgacagagatagaaagcgagatggttatttcaaagaggaaggctatatgaaaatcagagtgtggacagctctcagcaggagattgatgcaccaaacatgatcattgttgtcactgttgtgaaattaatggctagaaaataatcactctggaaattctggatgcttcataaacaggcaacaagtaacagtaagagccagagactatcaaatactatgagctatgaatttagaagaaaacatgtctaggtttagatagtaagtatatgatgatattattatacattagtttaatatttgctcattggacatattattcatggtagtggaaattgtaacattgaacgtatatgtagtaaatggtgaatctttaaaatttatgttagtcatctctgtaatcctgtacttctgtgcatctaattatttattttatatttgacctatatatatttgaaatatatatgtatatatatatatttgttagtacattatctttaacgaatgttttctctttacattaaatcaaatgttgaactgactatactgtgcactcacagaaaaatatggctttcagaggtccttcatagcagagaagctaaagcttatagtggagttctcagtcaaactttaaaaaatttagaagtaactgacacacatccacacatgtgcatgtgcacacatgcacaacacaaacatactagggacaaagagaacagccaggccatcagcgcattccagaatcccattcctgccttgtaaagaacttggtgacaagtcactgggaagtttcacacattgttttgtaattagagactttacttacaattacctggaaggcacatatggatggctaatatttaattaaaaataatttaattatcaaacagaccaacactttaagtaaacattatgaagaaagcatactgtttaatttattgactgattttgagaagacattcaatatattttatttgagagaagttttgaatgtggatgatcatttttgacatgaataatacaagattctacttaaattcccctcataaataagagagaagagaaaatgagacccttcatggtctggtggcaagagaacagtgaactaaagagctactcgaaataagcttggtgggacaaaaatgtcttccgtttgtcagtgtattgtaactataactcctttctcaaatgtattgaaaatgggacagagaattgccagagatcgctaaacagcttttttttttttttactgtccccaaagttaatgattaactagaaagcatatactcaagatcaagatttggaaaacatatttgtttttaaaaatcttaaaagaagtgagaaaaaaaggcacaataccttcaaaaggatgacaggaaggccaccctggacttccccagagaggcagggaggccagaagacaacagaacaggagcttcaaagagggaaaagcagatgtcagctgatttagaatttaaacccatgagaatatctttcagaaaataaagataggcatttttagagaaattaagtggcacaggatttgtcactagtagaagtacattaaataactatattttttagggagaagggcaatgatgctggataaaagcttgaagatgcaaacttgaaagaagagcatttgaaatggcaaatatattaataaatataaacagatattgtctgttagaactatggtgattatgacttgtggagaaacccccaataatgagaaaagagaactaagttaaaagaatcaaatcacatgagagaggtaggctgtaagtcaggaagaagacaaaagaaatgaaggtagttaaaggaaattgtctgatatgagaagcagtaaaggtactaaactttgataactcaaggacatgtgctataattgctgggtaatcattaaaaagcatagtaaaacaaacttgtaatcttgcaaatcttgtaaatctaccaagccaaccagagtaaatagaatactgaaaaaacaacccaagagaagttaaaagaaaaaagaaaaggaagagtaaacgtcaagaataagataaatagacgtgattccatactcatctaagtaagttatttaattacaaatggaccaaattctcaaattaaagagcaaccttattatattggaggaacacatctaaaatgtaaagaataagaaatctgaaaatattggacagtatggatctagaatttaagacatgattgcctttataaaaatatattcatagccctgtaactaaagaatatgtacacaaaacttcctaaaatttgttcagaaattatttgtaagctcttactatacactttctttaaatgtatagcgtatcaacagttagctgttacattctatatcaacaacattttttgcagaaacattaactttcattttccatttgaattcacaattttcgggctgaattactctcctctcccaatttctcccctggcttatttggtattctccatatcatgtaatggcatcattcacccagtcaccagggctagcacctgagtgctatacacaatattttattttccctccagtctcttgacttcctcaaaaccactgatagtgaataggcagactattcatcttgcttggaactacttcagttaaagactgtcacaatagctttgagtctctaaaggaaagggcatgggctttgtgatagtctgtttgtgctgctccgacaatgcaccagaggctgggtagtctataaagaatggaaatttatttctagatttgtttccacagttctggaagctaggaagttcaagatcaaggtgtcagtaggttcagtgtctggagaaggcctgttcctcagagacggtgctgtctcagtgtcctcatgtggtgagagagatagggcaaaaaaggacaaattctgtgtcctcatatggtggaagagcagaagagaacaaacccatcccctcacagtcctgtgtaaaggctctaatcccaatcatgagtgcttcatcctcatggtttaattacctcctaaagcctcatctattaatactataatttgagagacacattgagaccataacaggcctcaacctgctgactccctagataacatttccacctgttacttgcagtatttgaaatccacatgccataaagtttggagagttggaagacctttgtcaagttaaaaacttgtccccaaatacttggtttgggcagctatgcttctcctaatgagaatttaaaattatatcaagtggaaatacaaaatacgactacatttccttgattctatagtgacatcaataataaggggtactgtatgtctatgcacataaatacatctatgtatgtgtgtacagtcttataagaaaatttcaaagatgtcaaagtgaataaaaggtgagacttggaatcacagaaatgtattattgtaccacagtgaattactcccctcaaatctaggtccagtgtaaagaaattctatggaaagtaatacctttatgacctcatcaactgatactatttctaagtctgctcgacaggccagtcgaggtttttatctaatccccattcccatgcatgtaattgtctgcctaatattcctacttggccactggacaaatgaaaatcagttgaacaagcccaacattaaatcaatattctcctcctttcaccaaacaagttctatgcccagattgatttgtagggatatcagcattgctacattctctcactcacactgtagaaatgtatcttctaatctcatgagaaatgttaaattcttcttgggaacacagttactttgtgtatcggctacagtcaccaaattaaaagtgtttgagaatctgataggacaaattcatgtgatgtacattgtaggttagtgaagcagattgaataaaatatgttatatgagatttgcagataataaaatggttacttttgtgtaccataaaattatctgcagtcctgttattttcagatctaccctctaaatatgaaatatgagatgataccttcattgtattggcctaattctttgaacatttattatctatgtcaactcttttctccgaccccttctgagataagaatacacacatgtacacacacatgcagagacagagactgagagagagactgcaaggaactttaatgaagcaaatctaacatatatgtataataccataaaaaagaaaatgatagtcaaataatacaatttcccctctctttgtctctctctctctctctctgtgtgtgtgtatgtctctctctctctccctccttctttgtgctttccagtataattatatgtgaagatgcctattatactgattcattagatttaatgaagtagataactttttaattttagagaacaaattatgccataaatataccaaattatatgtttttgtatagctgtatttcatgctcgtgaatgcaaaattaattcctttcattgacgttagcaaggaaaatactaagtgcgtaaattgcaactccattttctccaatattttttagttatttgactaacatatttcttatgtaacctgtgcttcaagattgactgaaagaaattgtgtctaaaaaaagaatatatacaacaaacccctagagaagtgaaatcttcctttctttctgtctctttaagctttgttgattaaaacatggctgccttttctgaattagactggcaaggtgtcagagtcttgatgaattgtttaagttctgaatatggttgcaatgtaagcaggaggaaacatagaaaaccttgggaaaaggaatgtcttcttagaatacaaaataagtaatgcaaccatgttacaaatagatgtggaaagagaagacatgaaatattagactttaatagaagtaattacttgaaaaaccaatcacagagaaaactgcttaaaaatagatactttatatgcaataaaccatcctccagattatgtgtgtagtcaaccaaagactgctaaaaatgttaacagattgaaatatatctaactctggagtggaattgagccaggatttgatgctagtatatcaaataagtcttgcaaggtgaaggaggtaaatctctttagctttggaaattattataacaatttagtttccttaaagttactactggactgagcaccagggtaacttactctactcccagttacacacttcattttaggaaaaaaataaagtaatttaccactttaaatttggttcccttaaagttatcaatttcttccataaaaatagaatgcaacaatatattaaggagtactttgtaaataccaatgtgcaatactaacatttgattgcagttattataattaattctcaaactctggaatatgaaagatttctattgccagagaaaattattgcgaccatatgcaaatgtaaaagatatcaaatgattatactttattagtattatttattattcaaataatacattttggtggcagttaaacattatttcactttttcagatttaagtatgcatgtgtaactaatgattcagttttaggaatctcatgtgagaaactatacccagaacagtgtagttggctcactaaaatctctactaagattcacagaggaaaatcctttcatatgaggtcgattgggatcttccttattttaagaaattcatagtatttaggttacatcattttccgtaattaatgcaaatatttaagcatatttatatcaaaatgttaatcaaagtttctccttcaatgttaccctgtaccccaggccctttgccccattcaaaatttggggtcctctacctttatcatctcagagaaggggtgacatagcagaatatagagacaactactgttggcctttgtttccaaaatcttgatgttgaagatggggggcattaagaacaactttctgggcttgaataatatattttagagaatatttagtgaaggctttctgatcatgattcaggaaaattatcctagttggcaggattaagagttctggtggacagttttgaatattgaaaatatatttacaactgtgaatatttgggaaggaaatgtgtaatattcagtgcagagcactgagctttgtgcaagaaccctctgactccaacaagagtgtgaagtccaggtgtgtgggaaaggggtagtcaaatgccttggcatgtttagagaatcccagggcagaagtaaaatgaaacacctctccaaggcagaggctcagcagtgcagaaagaccccaatgaaggaatggctcgtggtatatccaagcagttatgacttcaaacattcaaggcttgagaagtgaagacagcttagaagtagcagagagacatgaagagatctcatgattcaagaggatctacagtaagttctacagtaagtataaatcagtggaaattcatgaagatggcctccttcccatctcttcactcttattattcttatacacagtgccgccaaaacgcttgccccttgtaagcctcctggaacttgacacaactctagagaaagggataaaggtgggaattagaaagtgacctattttaagtttctactatccctctaaatgggggagagaaatggaaataatgtttagttattgtagaagataattaagaatgctacttgactttgtgttctaagctacaaatttgttagtaataataaaagtaatgggtgcaggaaactgtctccgagcctgccagagggccttaaagaacatgactccatcatttagatcaaggttgtgaacaatagtccaacacagactctggtattgtgattgactctggctccttcagcagcaagctctcctactccctgatctagtgcttcaactacttcagctagtgactcagctctccaatttctgctctgaaaggtctcagaaattaccactgactgttatcttttttctgcctcatgatcctacttattatcttgcttatagatcccattttgctacttctctactttaatgtttgtatttttctccactcatctgatatttaatcttacttagaaattgggttagctaggttccatccagtatcgatttcattcctttcaggccatatctaagctaaattaccctctttgactaatcacgcagtggcctaggcccttaactcacattacaccaaggcaagtaccttctgcataggtgatcttcgggctgtactgtgagtaagacagaggcttcacagacaaggaggggttaactctcaaatatccatcatggtctacatacatattctagttcttatctgccagacagcaaggatcttcattgtagattaaacagcctcaaagaaggctacctaaaataatccagtaacagggacacatccttacccttgttcaccctcacctaaaagggttaacaatccagacaaggtactgtacccagaggtgaagcagagaagtcactatatgaggtgctttccctcagccagcctctgcaatttcaatgttaattcattcatgcatctgtttatttaactcttacagggctttgggtacatcaatgatctgagacaaacatcctgacccatgaatttcattttagtatgagaagaggtacatacccaataagcacactaaataagataacatacagtgcgtcagaaggcaatatatgctacaggataaaaagaaagtaagaaaaggcaaaggacatgggagttgaaatgtataaataggatgattggtgtgagcctcattgagaagatggcatttgagttctcctccagttctattttgattctatccagtgacttttgcagtgactactctatttaggagaggacaaggtgatgataaacaagaaccatctattcctgatttcttgagcaaatcagcctcggcttcagaacatatattacaaactaaaaaaataaaaggcagaacatcttggaaggatgtgtgtgctatcctccaaccttcccactctggtagattcagggtgaggcaaatctggcatgcgtttagtttcttggggcaagaatgcttcactatggctctaaaatatcactggaaatgttgggaaaagttgaaaatgtttttgacatcactcctttcttggggacgctgtatgttttcatgtgatcgattttgacaccctgaggaggtcaggagtctcatttggtctcacctagtgaggtaagagttctcaagtgatgctataatgcgtggggacaatttcttgcctttgacttttccagtttctggacaccagcagtggcatcactgtgacatttgtttccatcattgcatcacctcctctcactctgacactcctgcctccctcttatgaggatccttgtgattatattgagcacactggaattcaggaaaatccatcctcatcttaaaatccttaacttagatatatcttcaaaatcccttttgccatataagataatgtagtcacagttctctggattagaacagctttgggtgccattgttcaatctaccatagagaggaggccgatatcaagaaattcagcttacttccaccccatgccttactgaatgaattactcacttctcattctaaacaactgttgaacaatgtttaaacattttgaaatattggtgtgaaaaagcaccaaattaatggtctctttgggaaaccaactatcttagtccagagtaggagtaaagagctttttgaacacgggctcaatgcctgacatgtttttcctacgtggtcacctacttatcagtctactcatattggtttgaaagaagggagaacttatgaccagagctggaaaactactacaagagaactctattatggttgtatttctaatttacagcccttgaaattctttgcattatgctcatgaatagtctgattcttccccgtcttcctttaaaggccatgaccaactgaatctaattttttttatcaatgaatatcaagctaaaacctcaatcagttgcctatacttaacttttatacatgcaaacttactgtctcccaactaccaccaaaatgattaatgtagcataattttagcttatactacttggtaattttctaggaagctttaaaatctcagtccagccaacctattgatagttttaaactgacttttatttggtttgataattgtgtagtcttatattttgtatagttgtttattagacaaaatcatcaaaccaaataatttaaaaacgttagtgacagaggaaacgcgattgttcagtttaacttaaatgaagattttaaaattaattccattatcttatttctcattcatacattgctactttaaaacagtactttacatatgatcacatttgacaaaagagatctccatgtctattcacttgtaatcatttaaaaattcatttctagaaaaagaatgtacagtgtggtggtttattttatgtgtcaacttcactggaccacaaggtatgcagatatttggtcaaaacttatgctaggtatttctgtgaggtatttttgggtgagattaatatttaaattggtagactgagtaaagcagatgccctccatgatgtggatgggactcatccaataagttgaaggcctgaatagaacaaaatgctgactctctcccaagtaagagaattctcctgcatgatggccttggaactggatgctggctcttctgattttagacttgttagcctccataatagcatgagccaattctttataataaatttctatctatctattatctatctatctatctatctatctatctatctatctatctatcatctatttatcgtctatcatctatctatctatctatctatctatctatctatctatctatctatctatctatctatctgtcatctctatcatctatctcttcatcttcttcatcggtttctctggagaaccctgagtaatacataaagtctatttgagcaaagccttaagtaagatgttttaaagaatttattgctggtttcctgagttacttgatgtaagtcacagaagttcagtcaggtgccttatctgaaaggagttcgcttataacttagcattagttcttttgtctcacctatgcaactcaaaatattagatacctcttgtgtgccacctagtttccactgcctactcaccttttgttgtatcaaccaacttcacaaaggtaacctaacagatcttgtttcagatgcaccacatgccagtgactctcaacctgtgccttctctgatgctgcagcctggctgtccgtaggaaccagtctggcactgactttgtgcatatcaagaggtgtgaggaagttaattcctcgtgagtcagcccttaatcaacccaacgagggactgtggtaggcactggtaagtacaagctcccctttttatctcatggctagtgaattctgtgatgcattctacctgattcctcaaagcatcccagtagggtcaaaccccagttgccctcagtgatttccagcttgaaagacccaccattgtattggtttttccacatcctatttctttgtcttcccagttttctgcttctattacttctattcaattctcaaaagaaattactgatataaaattccttatcctagactgttttctgggggcaaactaggtgaagacatccattatctgtgtttatttcccattgtcttcttttgtgtcttactaattctttttatacagtcttaccattctcaatttccttatttttttttaatcttcattttgacattgtgccttttggagatagaaatgggctttgcagttattaaaggtcaagatgagggatgcttgtgatgatggaactgttctttaccttgactgtggtggtggatatggaagcctaccaatgtgataaaaatgaatagaaatcaacacacgtacacacacacacgcacacacacacacacaaatacaagtaacatttatggattggatcaatgtcagtataatgtttgtaatattatagttctgcaacttattattagagaaaactggcctagggtacatgaaagctctctgtattgttacttaaaactcatataaatctacaactatctcaaaaacaactttaaagaaacagctattttacattcttttgagaatatctcttaaatttacacacacatagaaattgcattcatttagcaggttattagccaggttaaacacttatgtacacatttgtaagagcaccttatttaaattatggactaatattcaaaagcccatttgcttttaaatataagccacctattatttctctgtgctttgaatgagctggaatttagtggaaatagtgacatattctataaaggattaagtcagaagaacattctcatttgctgctttcaatatttaagaataaaatcattcctaagctattataccagtactaagagagaatacttgttataaaggaggcttataaaagcatgttaacttagaggtttttatttgcactttaaaaatttttataagaatatctgtgctcagttaaacccttggtttttcaaatgaaagatatcattgaccatttatattagaataaaaaaatatatcatctggatggaacagctacctgcctgcttcctaaagccccagttagagactgaatttatattatgtaaaaattatgggttttctccctttaaaaattagttaagcatatactaaaacaaaaatgttacatgcaacgcattataattttaaagactcattttctttggaattattagcaacccaggagaaatttaaggaagaaaagaaatgacaaaaaatgatatgctgctttcttttattatcatttgtttaaaagatggcccgttacatttttctgtaaatggtccattccccacccccaccacatgtctaatccacaaagtttgcatctgtgtacatcactctccaatgctctctttccctgttttagttacccttggcctataccttgacactctgctacctgtctcaataaattcagaacacaagcatttacctgcaacaaatgcgaatggttcccctagaaatatagcatcctataaaaactaaagccgaagaaactggaagggtgaggtcaggtataattttctcatcacagcctccctcgtctttttcttttaggctcagacaccgtgttgacctttgtctatttttatggctggattaattctgctatttaaacgagtcggaagtttcagatcatgtcatttagatgacctcaagaagtgctgatctctacaaagatgatgtgaaaaaataatagaaagatgaaaaaaaagttgagacttgcagaccaacaagataccttagagatgatcttacacaaccttccaattttataaagagggagatgaggaaggggcagttgaatgagggtatgttaggcttgtatccctcttaggttggctgacctcaagtccaggctcaagtcctctgagcctgtttcagcggtagtgcagattaaaggccaatcatatcccatgtcagggaagtaggcaggattccaggctaagggttgaatagttcacattaaaatcagaatttctaatgcttgaagtttgaatatccatccacccatgtctgagtgttaggattttaacctgtggtcaaggccctgctttgtgcctcacaattgtccatgactgggtgacttttactcttgtctctcaagtgttcacttctttccctgcctcatgccctttaggacaactgtgcttctgacttgcctccttgtcttctcacgaactttgcatggcctctaaacagactcacgctcatcccaatggatgaaacaccccacctgcacccgactcttagatgttgatgatctaactaactgctttggggtctcttatctgaaaaggtctgtctgcctctgtggatctatttggggccaggattagccctcttgaatgtggctttctactaccagctaaggcgattccataaatgtcttatagtatggagacaatggtctttcaaaagtttgtctttgggtttagagatctacctgagacgtattttctactgttgtcttaacaggttactttctacccaaatcttggtcaaattcaaccttaaaattcaattttgggtttataagggaagagtagggaatgagaaaagcccatatgtgaaagtgatgctatcaaaatggtgaaagagaattaaagctatgataaaaacagaactattgtatgttcccaatttgattacagtcatgcaccccataacaacgttttggttgatggaccacatgcacaacagtggtcccataagattataatggagctaaaaatttccttttcctatcaccagtgacattatagctattacaatgtagtagtacaacaaattactcacacgtttgcagtgatgctggtgtaaacaaacctaccacactgccagttgtataaaagtgtagcacatgcacttatgtacagtacataatactggatgatgataataaacaattatgttacttgtttatatatttactatagtatactttttattgttattttagagcgtactcattttacattttaaaaaaagttagctatgaaagagcctcaagcaagcctttcaggaggtattccagaagacattgttatcataggagataacagagctgatagctacatgtgtgttattgcctttgaagtccttctacttggacaagatgtggaggtggaaaatagtaatattgatgatgttgacattgtataggcctaggctaacatgtgtgtttttgtattcatttttaacaaaaagtttaaacagaaaaaaaataaaaatagagaagactttacacctttatgcaataagaaaatagaatatattgtacaattgtacaatgtgtttgttttaagctacatgtaattataaaagagccaaaaagttaaaaaaataaaagtttataaaaaagttacagtaaactaagttaatttatttttgaagaaagaaagtggtctttacaaatttatcatagcttgagtgtccagtgtttataaagtccacagtaatgtataacaatgttcaaagcctccacattcgcttgttactgactcactgattcacccagagcaacatccagtcttagcaagctccattcatggtcagagccctgtatagatgtaccttttttaacctttatactgtatttttactgtatcttttctatgtttagatatgttcagatacacatgtacttaccagtgtgttataattgcctacggtattcagaacagtaacatgctgtacagttttgtagcctaggagcaataggccataccatgtagtaggctgttgcatttaggtttgtatactctatgctgttcacgcaatgataaaatcacctaaccacacatttctcagaacacatccccgtcattaagggacatgtgactgcacttctcctactcttctcttccaggggtgccttaatcatatttggctctgaaaactattttccttaaacacaataactgtaatagtaggtactgcacaagacccataagaggcactgaagaaataaccatccttcctgagttttatagattattaataaaaaatgctttattatctatcaaacatcatgtgaatgtgagatataaaacctctttttattttttttctttttcaaaaactgtatttatttatttatttatttatttatttatttatttttaaaatttcaggatacatgtgcaggatgtgcaggttttgtacataggtaattgtgtgccatggtagtttgctatcaacccatcacctatgtattaagcctcgcgtgcttcagctgttttccctaatgctatctccatcccaccctcccctgacaggccccagtaagtgttgtttccctccctgtgtccatgcgttctcattgttcagctcccacctataagtgagaacatgcggtgcttggtttgctgttcctgcgttagtttgacccagcaatcccattactgagtatatacccaaaggaatataaatcattctattataaagttacgtgcacatgtatgttcattgcagcactattcacaatagcaaatacatggaatcaactcaaatgcccatcagtgatagactggataaagaaaatgtggtaaatatacaacatggaatactaggcacccataaaaaggaatgagattatgtcttttgcagggacttggatgaagctgaaagctattatcctcagaaaacctttttatactgaagaaaaagacaaatttgaaatataattattttggatgtagaaattttaatatttactgtagaattagttaacagatattttaatttttttcttttatgctacattttcatctataattctctttaataaaaaagccacagaaaatcatagtaacaaaatagttctccatagtggaaaatgcaatatgcttttatttcttatttcaaaagcttgtcatttggcagatatagtcacactgtcttgaaacatacttatatagaatgaaatatatttattatatataaacaaaaactttgcaaaatcccagaatttttatcttgattcttaataaaagatatatcatgattcattttaaaataaaaagactcatactgggaattcatccaattaatattgatggccccacatggtacaagctaaatgtgatcttttcagtttgtgagataaaaaacatgacccaagtggaatgttggctcctcgagttagtaatatgcatggtgacatttatgtataaaataaacagaatttttacaccttaatttatagacagcagtatttttatagaaggatgattaatcttcaaattgtttaatgctacagataatgaaatagctttataaatcactgatattgatctgaataagttacttcacaaagaggttaaaaagataaaatagaatgaagtactagaacaaaactaatgttttagtttttcactttcagtgatgacaaagccagacaatcaaatgaagaaatacattttcaatcacttttatgaatctaaatataactttacaagaaaattggaggccagagtacaatattaaaaagagagtattggtggtcacttccaagatggccaaataggaacagctctggtctgcagctcccagcaagatcaatgcagaagacgggtgatttctgcatttccaactgaggtacctggttcatctcactgggactagttggacagtggatgcagcccatggagggtgagctgaagcagggcagggcatcacctcacccaggaagtaagtgcaagaggtcaggggatttccctttcctagccaagggcagctgtgacagactgcagatggaaaaatggtacaatcccacctaaatactgcacttttccaatggtcttagcaaccggcagaccagaagattccctcccgtgtctggctgggtgggtcccatgcccgcagagccttgctcactgctagcacaagagtctgagattgacctgcgaggctgcggcctggagtggggaggggcatccgccattgctgaggctcgagtaggtaaacaaagcagccaggaagcccaaactgggtggagcccaccacagctcagcaaggcctactgcctctacagactccacctctgtgggcagggcatagctgaacaaaaggcagcagacaactgcagacttaaacatccctgtcagacagatctgaagagagcagggcttctctcagcacagtgttcgacctctgagaatggtcagactgcctcatcaagtgggtccctgacatccttgtagcctgactgggagacacctcccagtaggggccaacagacagctcatacaggcaggtgtccctctgggacgaagttttcaggggaaggatctggcagtaatatttgctgttttataatatttgctcttctgcagcctccactggtgatacccaggcaaacagggtctggagtggacctccagcaaaatccaatagacctgcagcagaggggtcagttagaaggaaaactaacaaacagtaaggaatagcatgaacatcaacaaaaaggacatccacaccaaaaccccatctgtaggtcaccaacatcaaagaccaaaagtatacaaaaccataaagatggggagaaaccagagcagaaaagctgaaaattccaaaaaccagagcacttcttttcctccaaaggatcacagctcctcaccagcaatggaacaaatgtggacagacaatgactttgacgagtttatagaagtaggcttcagaaggccagtaataacaaacttcttcgagctaaaagagcatgttctaaccgagagcaaggaagttaaaaaccttgaaaaaaggttagacaaattgctaactagaataaacagtgtagagaagacctgaaatgacctgatggagctgaaaaccacagcaagagaacgtcgtgacgcatgcacaagcttcaatagcctatgcaatcagtggaagaaaggatatcagtgattgaagataaaattaatgaaataaagcatgaagacaagattagagaaaaaagagtaaaaagaaatgaacaaaacctccaagaaatatgagactacgtgaaaagaccaaatctacatttgattggtgtacctaaaagtgatggggagaatggaaccaagttagaaaacactctttaggatattatccaggagaacttccccaacctagcaaggcaggccaacattcaaattcacgaaatacagagaaccccacaaagatactcctcgagaagagcaaccccaagacacataatgttcagactcaccaacgctgaaatgaaggaaaaaatgttaagggcagccagagagaaaggtacagttactcgcaaagggaagcccatcagactaacagcagatctctccgcagaaaccctaaaagccagaagagagtgggggccaatattcaacattcttaaagaaaagaattttcaatccagaatttcatatccagccaaactaagcttcaagtgaacagaaataaaatcctttacagacaagcaaatgctgagagatttgtcaccaccaggcctgccttacaagagctcctgaaggaagcactaaacatgaaaaggaacaaccagtaccagtcactgcaaaaacatgctgaattgtaaagaccatcgatgctaggaagaaactgcatcaattaacgaacaaaataaccagcaaacatcataatgacaggatcaaattcacacataacaatattaaccttaaatgtaaatgggctaaatgtcccaattaaaagacacagacttgcaaattggataaacagtcaagacccatcaggtcaggaattcgagaccagcctggccagcatggtgaaaccctttctctactaaaaacatgcaaaaattatccgggcatggtggcacatgcctgtaatcccagctactcgggaggctgaggcaggagaactgcttgaaccctggggcagaggttgcagtgagctgagatcatgccagtgcactccagcctgggtgactgtgtaagactctgtcttaaaacaaacaaagcaaacaaacaaacaaaaaactacatatgcatttaccttttgactcagcaatcccacttctaatgatacacctctaacactacagaaactcatgtacatgaatttgtctatacatgttgttgtatgtttcttcaaacccatagaatgtacaatatcaagactgaaccctaaggtaaactatggactctgggtgattatgttgtgtcaatgtagattaatcagttataacaattgtaccactttggtgggggatgttgataatgagggaggctatacatgtgtgggagtaggaagtataggggaaatcttagtaccttccttttagctttgctgtgaacctaaaaatactctaaaattaataagttaagtaataaaatatatgcatatgtgaaaaaatctgccttcattaaatagcttagaaagtccataatggaacttggcatatgttttatccaatatactgtcttttaaccttgctataattttgaaagccaatagattgttttcttaggaggaaaaactgtagatagggtttcactttaaagtctactggtgtatcttgtatttggaattcaaaagatattcaaagaatcaacacttagagtaaccacactgtagagtttcttgggaataaaaaactcactacatttacttattgtaatttaagaaggactatttctggtaataacttaatctgtttcccaagcctctgtgaataaattcggcttcatatttaaaaatgaggtggaatatacccaggtcttgtcaatctagtcataattatggtatagaggacatgcacaaatcaaaaccctcacccctaagccaacacttggacacttcactctctctttctgtggctctgatttaagactcatatgctgatcaatcatagaacctcaaacaaacatttagatatgctttttttttatcagttttatacttatttttctcttttatctgaagttataaatggcttgcctaaattccttcttcacttttcatataaaaattagctacatttctaaaattgaataaataattcagcatggtaatgccaattcctcgataaaatactggcaaactgaatccagcagcacatcaaacagcttatccaccacgatcaagtcagcttcatccccaggttgcaaggctggttcaatatatgcaaatcaacaaacataatccatcatataaacagaaccaatgccaaaaaccacgattatttcaatagatgcagaaaaagcttttgacataattcaatagcccttcatactaaaactctcaataaactaggtattgatggaacatatctcagaataataagagctatttatgacaaacccacagccaatatcatactgaatgggcaaaagctggaagcattccctttgaaaaccggcacaagacaaggatgccgtctctcaccattcctattcaacatagtactggaagttctggctagggcagtcaggcaacagaaataaataaagggtattcaattaggaagagaggaagtcaaatcgtctttgtttgcagatgtcatgattgtatatttagaaaaccccattgtctcagacccaaatctccttaagctgataagcaacttcagcaaagtctcaggatacaaaatcaagtgcaaaatcacaagcattcctatacaccaataacagacaaacagagagccaaatcatgagtgaactcccattcacaatcactactaagaaaataaaatacctaggaatacaacttacaagggatgtgaaggacttcttcaaggagaaatacgaaccactgctcaatgaaataaaagaggacacaaataaatcgatgaaaattccatgctaatggataggaagaatcgatattgtgaaaatggccatactgcccaaggtaatttatagattccatgccatccccatcaagctacctatgactttcttcacagaattggaaaaaactactttaaagttcagatggaaccaaaaaagcacccgcatagccaagacaatcttaagcaaaaagaacaaagctggaggcatcatgctacctgacttcaaactatactacagcatggtactggtaccaaaatagatatatagaccaaaggaaaagaacagaggcctcagaaataacactacacatctacaaccatctgatctttgacaaacctgacaaaaacaaaaaatggggaaaggattccctatttaataaatagtgctgggaaaacaggctagccatatgcagaaagctgaaacttgatcccttccttacaccttatacaaaaattaattcaagatggattaaagacttaaatgtaagatctaaagtcacaaaaaccttagaagaaaacctaggcaataccattcaggacataggcatgggcaaagacttcatgactaaaacaccaaaaacaatgacaacaaaagccaaaattgacaaatgggatctaattaaactaaagagcttctgcacagcaaaataaactaccaacagggtgaacaggcaacctacagaatgggagaaaatttttgcaatgtatccatctgacaaagggctaatatccagaatctacaaagaacttaaacaaatttacaagaaaaaaacaaataaccccatcaaaaagtgggcaaaggatacaaacagacacttctcaaaagaagacatttatgcagccaacagacacatgaaaaaatgctcatcatcactggtcatcagagaaatgcaaatcaaaaccacaatgaaataccatctcatgccagttagaatggtgatcattaaaaagtcaggaaacaacagatgctggaaaagatgtggacaaatagggatgcttttacactgttggtgggagtgtaaattagttcaaccattgtggaagactgtgtggtcattcctcagggatctagaactagaaataccatttgaccctgcaatcccattactgggtatatagccaaaggattataaatcatgctgctataaagatacatgcacacgtatgtttactgcagcactattcacaatagcaaagacttggaaccaacccaaatgtccatcaatgatagactggattaagaaaatatgacacatatacatgatggaatactatgtagccatgaaaaaggatgagttcatgtcctttgcagggacatggattaagatacaccatggaatacttttttatgcagccataaaaaaggatgagttcatgtcctttgcagggacatggattaagctggaaaccatcattctcagcaaactatcacaaggacagaaaaccaaacaccgcatgttctcactcataggtgggaattgaacaatgagaacacttggacacagggtgggaacatcacacattggggcctgtcgggggtaggggggatgggggagggatagcattaggagaaatacctaatgtaaatgacaagtcgatgggtgcagcaaaccaacatggcacacgtatacctatgtaataaacctgtacattgtgcacatgtaccctggtacttaaatataataagaaaaataatacaaataaataaataaaaagagagtattaatataagtgtgtatgttcttactagtaaagtttttttaaaaaattgacacttattttctgtaaacataaaactcaggtagcagtaactatttttcacaaaataatctgacaaaattattcttatgaacaagaatcatgggtgccaagatggcctacaggaagtatctcctgtgtgctgaaaagagctaatgatactgaatctacaggccaatcatctgagaaaacacattgggattcatcaaggcagcaggggaagacagagtgcagatagaaatgaggctggaccccaacctgtccaggctcagggtagagccaggagaacctctccaacaccggaaagggtgagtggctgagtaagagtgcctgggagattcacactttccacagggacctgtgctggactggggatgagaaaatcactgcagttctagactgaggcaggaagatgccagatattttttggcagcaactctcgagtccaaggggacctctataatccctgggtcctggagccaaccggcatggttgccacatccccagtagaggttgctgttgtggtgcctgggaacggtaggattgctccaacccaccttgtcagagaggacttggctccagcagtcccacctgggcccaaatttggcctgccatgttgcccaccctcaccatgggtagctaggtgagcaacatctgctagagcctccagcccagcagtcttattttgtgtgtactcagctggagggtgtagcctcctgatcttctgagaaacaccctgacagcagggcaagtgactgcaccccaactgctccccaccctccaagccatggatagccaggagggcaatatttgctacaacttcccacccagtggcccacttagccaaggaacacagcttccatttgggccagtcttgattctgtgggatctcagctgatggacacagccttctgttgtcccaggaagcatctggactacagggtgaacatccccacccacccctgacactggtagccaaaggagccatgcctgctagactttctggctcagaggtccttcttctgcctaaatttgctgaggaatgcagcctcctgttgccatggaaacacatggatggtacgatgggcaaccctacccattcctgcctcctgtagccagaagggccacacccactagagcttccaatccagtgtcccacttccacttgaactctgtggacaggtgcaatcccatgttttcccaggaggcacacaaacatcagattagggttgacttcttaaggatatggcttatctgccaactgtggcccctgcctgagggagacctgtggaccagaacgctcaacaaaagaaacacaagcatggagagaataattgaagggggctcctccaagactcaggagatgactagaaccaaagccagtcaactgaatacatgttataacataatcaaaccaccaagggtatcaaagaagaaaaaagcaaaaaaaaaaaaaaaaaaaaaaaaaaagaaaaagaaaaaagaaaaatccatctgcaggacagaaacttcaaatattaaaggataatcagcccacacaaataagaaagaatcagcagaagaactcttctgattcaactcaaatatccagagtgccttattttatccagacaaccacattagttccccagcaaagtttcttaaccaggatgaaataacagaaatagaattcagaatatggatagcgatgaagatcatcgagattcatgagaacattgaaacacaattcaaggaagctaaaacacagtaaaacaacacaggagctgatagatgaaataatcattataaaaaagacaaaatgagctgataaagttgaaattcatactacaagaattgcataatgcaaatcacaaatattaacagcaaaatagaacaagctgagaaaagaatctcagagcttgaaaactggctcctgaattaatctagtcagacaaaaataaataaaaatgaattaaaaagaacaaacaaaaatcccctggaaatatgggattgtgtaaagagaccaaatctatgactcactggcatccgtaaaacagacagggagaaagcaaacaacctggaagacaagtttcaggatatcatccatgaaaacttccttgacctcactggagaggccaacatttaaattcagtaaatgcagaacacccctgtgaaataatacacaaaatagaccattcccaatacacataataatcagattctccaagttcaaaatgaaatttaaaaatgttaaaggcagctagaggtaagggacaggtcacctacaaagggatccccatcagactaacagtgtccctttcagtagaaaccctgcaagccacaagagactggggcctatattcaacattcttaaagaaaagaatttccaaccaaaaatttaatgtccagccaaactaagcttataagtgaaggagaaataaacatccttttcagacaagctaatgctaagggaatttattaccaccagacctgcctaaatgaggtcctgaaaggagcactaaacatggaaagaaaagagcattaccaaccattacaaaacatacttaagtacacagagtatagataataatacaaagcaaccacacaaaccagtctttataataaccagttaacaacatgatgacaggatcaaatctgcacctatcaatactaatcttgactgtaaatcagctaaatgccccaattaaaaggcacagagtggcaagcgggataaagaacaagacccaatggtatgctgtctacaaaagacccatctcacatgcaatgacatccagaagctcaaaataaagtaatggagaaaaatctaccaagcaaatgaaagacaaaagcaggtgttgaaatcctaattttagacaaagtagactttaaaccaacaaagataaaaagagataaataaggacatcatatcacggtaaaagattcaattcaacaagaatacatatctatgctaaatctatatgcatcaaatagaggagcacccagattcatggagcaagttcttagacacttacaaagagacttagattcccaaacaataaaagtgggagacttcaacacaccactgacactgttagacagattattgaggcagaaaattaacagatattcaggacctgaaccaacacctgatgacatgcatctaataggcatctatagaactctccagctaaaaacaatggaattgacattcttctcattgccacatggcatatacagcaaaaatgagcacataattagacaaacaatcgttagcaaattcaaaatggctgaaatcataccaaccatactcttggaccacagtgaaatgaaaatagaaatgaatactcagaaaatcacttaaaacaatacaatcacatggaaattaaacaacctgatcttggatgacttttgggtgaacaatgaaattaagacagaaatcaagaaattatttgaaactaatgaaaacataggtacaatatgccagcatctctaggacacagctaaggcaatgttaagagagaaatttatagcactaagcatcaaaaatgtagaaaggtctcaaattaacaacctaacaccacaagtagaagaactagagaaggaagtagaaaccaacctcaaagctatcagaagatgagaaacaactgaaatcagaggtgaactgaaggaaactgagacaagaaaaactatacaaaagataaacaaatccaggagctggctatgtgaaaaaattaataagatagattgctagctagacagataaaaaagagaatattcaaataaacataattgtaaatgacaaatgggatgttgcccctgaacccacagaaatacaaaaagaaaaaacatcagagactgctatgaacacttctgtgcagacaatctagaaaacctaaaatatatgaatacattcctgaaacatacaacctcctaagtctgaaagaggaagaaattggatttgtgaacagacaaataacgaattctataattgaatcagtaatgaaaatcctaccaagcaaacatcacccaggaccagatggattcacagctgaattttaccagatgtataaagaaaagctagtgccataactactgaaaatattataaaaattgagcatagacttctcttcaactcattctatgaggccagcctcatcctgacaccaaaacctggcagagacacaagaaaaaaagaaaacttcaggcaaatattattgatgaacacagaggcaaaaattatcaaaaagaaaaatactgacaaactaaatccagcaacacctcaaaaagctaatccaccatgatgaagtaagtagggtttattcctgtaatgcaagtttggttcaacatatgcaaatcaataaatgtgattcatcacacaaacagaactaaaaacaaaagccacataattatctcaattgatgcagaaaaagctgttgataaaattcaacatcctttcatgttaaaaaccttcaaaaaactagatattgaaggaaaaatcttcaaaataataagagccatctatgacaaatccacagtcaacatcatgctgaatgtatgaaagctagaaacattcccttggaaaccagcacaaaataggtatgccctctctctccacacctattcagcataatattggaagtctcggacagagcaatcaagcaagagaaagagaaagaattcaaagggatccaaataggaagagtggaggtcaaattatccctgtctgcaggggtcatgattctatatctaggaaaccccatagtctcagcccaatagccccttgatctgataaacaacctcaggaaagtttcaggatacaaaatcaaggtacaaaaatcagtagcattcctacacaccaacaacatccaaactgagagccaaattaggaatgcaatcccattcacaatttctgcacacacaaaaaaacacttagaaatacagctaaccatggaggtgaaggagctgtaaaacaagaattacaaaacactgcacgaagaaatcaggaatgacacaaacaaatggaaaaatattccatgctcatggatagtaacaatcaatattgtctaaatggccgtgctggccaaaggaatttacagatcaaatgctattcctatcaaacaaccaatggcattcttcacagaattagaaaaaactatttaaaaattcatatggaaccaaaatgagcccaaatagtaaaggcaattctaagcaaaaagaacaaagctagaggcagcacgttacctgacttcaaactatattacagggctacagtaaccaaaagtgtatggtactggtacaaaatgaacacatggattaatgcaacagaatagagagtccagaaataatgttgcacacctacaactgtacaatctgccacaaaattgacaaaaataagcaatggagaaaggactccccattcaataaatggtcctggggtaaatgactagccataggcagaagaccaaaaccagagctctaccttatcccatgtacaaaaatcacctcaaagtggattaaaagacttatatgtaaaacttgaaccataaatctggaagataacctatgaaataccattctagacataggacttggcaaagatttcatgatgaagacatccaaaacaattgcaacaaaaccaaaaattgacaaacgagatctaattaaactaaagagctgctgcacagcaaaagaaactatcaacagagtaaataaacaacctacagaatggaagaaaatatttgcaaactatgcattccccaaaggtctaatctccagaatctttaagaaacttaaaaacaaatttacaagcagaaagccaacaatcccttttagaagtgggtaaagggcatgaacaacacttttcaaaggaagacacacaaacaatcaacaagcatataaaaaactgtttggagttactaatcattagagaaatgcaaatcaaaaccacaatgggataccatctgacaccagtcaaaatggttattaataaaaaagtcaaaatatgacagatactgatgagaaaaagaaatgcttatatactgctagtgggaatataaattacttcagtgattttgaaaaacagtgcagtggttccttaaataacttaaaacagaattaccatttgagccagcaatcctattattgggtatataaccaaaggaatataaattgttctactgtaagacacaggtacacctatgttcatagcagcactattcacaatagcaaagacatggaatcaacctaaatgcccatcagtggtagacttgataaagaaaattggtacatatacaccatgaaatactacgctgccataaaaagggatgagatcatgtcctctcagcaacatgggtggagacagaggccattatcctaagcaaactaatgcagggacagaaaaccaaataccacatgttttcacttataagtgggagctaaacaatgaaaacacacggacactaggaggggaacaacagacacaggggcctacttgagagtggacaataggattcaggagaggatcagaaaaaatacctattgggtactaggcttattacccaggtgatgaaattatccttatgccaaatccccacaatgcacaattcacctgtataacaaacctgttcatgattctcttaacctaaaagttaaaagaggatataatatttactatcctattcattgaaaaaaatacattattttatttttaaccttacattaaaataataaaaattaataatttgaatataaaataataaaatacattattttattttaggtactgactcatactgatttttgcttctgctattctgtataaaatatttaaatatttataattttgattcaatttatttgtcttgtcaaattctaaggcattttttgctcttcttttatattttctgtactgttgtgttttatgtcagttaattattgttgaataataagccaccctaaaacttagtggcttctaataagaagaagttattatttcactcatatcaatgttgatttgatggttttacagattgacctggacttggctgggctgggatcatgatcatttagttatctatggtcatatgttgggttaactgggaatgggctggtctgggaagaccttggctgagaggcttctacttcattaacctgagtttttgtctcatggtggtagagctccaagcaagatggcacaagtgaacattctaagggctaagggaagtcacagtgtcagttcagagtcaaaggaagaattgcaaagtgatgttgctaaggatgagatgacacaggaatgactggagaaaaggggccattttttgacatcagttgaacacatatattgtatacttttatttaaatgattacaaatctttcaggtattgagaagggattttaaaatatgacaataactactggttttaaagaaaacaaaccattattttaatattttttaattattgattattgttggcagttgcaaattatacaatgtcttaaggtaagacagttttcaggcacaaagatgaagcatcacctactttactttcagtgagtttaattaatcacgaagacggtagagacacaaggaaaaaacacatcatggtttttaaaatgtgaaataaaatttatttaggaagtcatgaataaaggaacagttaggcctttctgtgggagttagggaacgtttcctatatatgggagagctgatccttagctgaagagatgaataggtgttcatcactgtgtgcggtggtgggcaggatgtgccagggcaggaaagcatgaggaaggtgttacaaatgtatgagcacatgtaagtcagtgtaaagagcagttgggaggagaggggctgagagtacagttggaaaatgaggtcggactagactgtgaagagccttagaagccctagcaaggaatatggacttacgagaattggcaccgcctgtgaatgcagattcctagcaatatccagaaagtagatcttttccaaccccactgggcacttttttttctcacaaaaaatttgctaatcatgatttggactctaagcaaatgattgagccatttgcctctttaaaaaaagttttttaataaaaaaaaaaaggtagaagttttgcggatatctgtggcttctctctcctctgtctgccacaaccagccaagcagcaggatgagtcagatggacccacttatggcctgtgacttcctcaagtcagtcttctatgcctgcccctgggcagaggcagtcagacccaaattggattgggggtttagaagtcaagcaaaagccactgtaagcctataaacgtattttacattctacaatccagcttccgccagagtatcactggggtttcagcattagttccattaatagaaagtgttaacttgtttcaagtttttcatttctttagtgtgactagctctgggaagcttgtagtggaaagctgcctgcaccagtgcagatctgaggcccccatgcagcaggatgctatgcctaatatctccctcaacatcaccattgccccaaacatatgaggtagcagaattttagagctggaagggacattatccctatattgtgagatctctgacaccaaaggtagagtcttgtttactttactatgattattttagctctaaatttattttctggcgggatagttttcaataagtgactatctcatgaatctagttcaaccttcttatcaaaaaggaaaaattggtcacaattttacaatagtgtcacgtgttgagttgtgattgctgtaatatttcctaaatattttccctcagattcttttgtaactttatgcctctttcctccactatcatgaataatatctgttgttctaagcctggtcagtgatatcatttatatctcactattttcaaaagctttttataatcctaaaaaaaataaggcaatgtaatatagttaatccacatgtattttcagaattggagtgtttatcgtggagattacaacacagccccttaaaactggcttagattggtagactgagaatctgttttctaacctaaatttaccttactaatttttgtagagaagctaataattgcttccttatttattctccctttatagataatttgcagccaaccaaagtttcaactatcttttatttctacctcttatggtttgtgggggtgttttccctcaaataccataacaaaagtggaattttgaccccaggaactttacccatatgctatgatgagtgagtctttccggctctataaaaatttgatatagaaaccttagagtctaggctaactagattctgttaggtgtgaagattgagtggttattcaaatttgaagccagagtggatgcaaaacattggaggacagaacagaattcatcagcaaacttgtctttggagaaaaataggagagtgttagacatacagtgagaggcaaaagtgaaaacaataaatggtttcagcatctaactttccaataacagatctatgtgccatggaagtgcatttttttctagttccacaaatatttttaaaatcatctatgagctttaacaaaaataaacacctatatgtatatcagctggaatgccttcctgttcttacaattaaacaataactaatatgttacagccttttgaagtttctgagttaaataaaccattataaacgccctttcagaaatgtttgccaaaaatatttttgtgtatgtttctctatgttcttttgtatctaagattagtactaccgaagatgactttcttcaagcagttctcttttccagttttaacatgacctttggttataaagggcacctgttccattagactctgaaatattgataaagagctctgtttagctggtgaaccaccaagcattgttaggtcagcgtttgaaagtgggcttcctgctcaattttccattctgcgaatgtgctttggctttaaaggtcaagaatggtaccatagggacttttgattgcattatcctgatttctcagctatgaatcactttctttccaaagctgtagaaggagaggctctaaaataaatttagtcattaccccttatgatattacctccacttctttgcctgtctggcaaaatgcctgatattggctgacactggaaatgagctttttaattctgccttggaagaaaggggaagaaaaaataaaattaacaagatacaaaacagcttcacaatcctcatttcaaccttctattatttgccagtgactaattttctagaacattgattatacctgcttttaaagatcacatcatagcttctatacaatttattctgttaataaatcaatccatttattcatttattaaggggtatataacattgcactatttctttatttcttcagggtaaattacttacttgcttttaataaatttatattttgttacattaaatatataagcctaacttgaaaatagtaaaatacgtgctcttaatatgcctgtgtatactacaaaatagttattcaaagtatttgcattgtttagtatgactttaaagaaaatggaaaacatgcaaccatggttaaggtataagtaattatctcattttttaatccataataatgtgattatttattttgcttaatgcagtcatgactcatgtaaaatctgcatctttgattgacttcttacaaaaacttgtctatttgcaattttgtttaagtttcttttgtgttcaaatattaaaacctaatattctgggatatcttgtgtacacagtcatgctggtcccccataatatctttctaggcatatatatatatatatatgtatatttttttataagcattactgttcctttccctcatctgataatttcctgactttaatgcaatctgtcatggtctgtagctctcttgtcaggccactatctctttctctttgccatttatagctaatttttagtataataagatctacacccttacagaaacacttcttccccactttgtgtattcctagtagaagaatcaccaataattgctgtttgctgcccattgaccaaggcgtagacacctaatccaagttgggacaatagttcacaagcaggaatttgaaatggacttggagaaacaaaatgtcagaggtggcagctcagttaaatcccatactattttagtcattttcagtcattagaaaacccactccatttctgatttaattttgatttatttttattcaactccccattccacattgctgacagttttgagaggcatgtgacctcactggttgagtagagattgtagtagagatgaagatatggacaaatgccttcctctccctcaaattctcctagagatgcatttcaggaagaaggaaagcaaaaggagggactctacacatggatgtgaattgaatattcatctgttggctttgttctgaatcattgttatcctgtgaaagagagaaagtttaacagaaacctacccattccccacccacccatggagcagaataggggaaaaggggaagggaaccctaatacattgtcaaccctacattctcaaagaagagggtccatatctgccacctgccttcagaacgttattttaaaggagatagggattttgtttctaaactctaatgtgtgttaaataccttgagtgactctctaaattaaacaatatgctagataagaaacattaaaaatgaatttattgatggatgattatgaaaataagaaatctttagaatccccagatagagttaaaacagaagtcctgagaagaaggcaagagccagaatggacttacattcagagggtttctgccatactctggaaaccttgagtttttacttgaataaccaagtacatgacatgcggcaggcaataatacttatgatttccttacagtagtgatggtaataggatgaataagaattagaatcagcctcccagcagacaaactaaacttgactatatcaaacttatgggtgggtgaaggagcaaatatctcacttgagaatttatcacttcaaacaggctgtcatatagatgtttgacccaaatccatgccaccagtaaggtccctagtccctgaaatagagaatttaaagtagtctagatggataatgcccccagaaactggtagacgtaaacacaaatactgaaagaacacaacttcaacattgacctcaatgcattcttacaaataaagttcaaagagaacaattggctcaaattcagaatttaaaattacaggagagtggtaacattagtaagaattagctgaaacagagattagaaagagatctgcaatgattttaaataatgaaattgtcagataaagcatagaatataactatattcatatgtttgaagatgctagaaaaaatgcaaaatatttgaagaaaatacaagattataaaaaaagaaaagttgctgatatggtttggctgtgtccccacccaaatctcatcttgaattgtaactcctacaattcccacatgtcatggaaggaacctggtggcaggtgactgaattgtgggggtgggtctttcctgcactgttcttttgatagtgaacgagtctcacgagatctgatagttttaaaaatgggagtttccctgcacaagctctctcttgcctgccaccaaccacgtaagacgtgacttgctcctccttgtcttccaccatgattgtgaggcctccccaaccatgtggaactgtaagtccattaaacttctcttttttgtaaattgcccagtctcgggtatgcctttatcagcagcatggaaatgaactaatacaatgactaagcatatgtgaatgaaaaaaaattcgagaaatagattcaaaattaatttaatgctaatttaaatttaattgttaaattaaaaatgcaatgtacatcattatttaagcaccacatttactcaattgaagaagtagtttgatagttcttatataaatctgatgatattatctcaaatgtagtccagaggcatagagatgtaaaacactgaactaaatcttggaaatttgcataatatttggatacatacaaagaagttccataatgatctagatattcaagagtattaagaagctaagatttcagaaaatatacataaaaaatatatcagtcttgacccctttcagaaaaactgcagaacacaaaagcaagagaagatcttacaggaagtggatgacgttggagaggtggccaccttcagggtaaaaatagagtaactgcaattagcaacaatgaagatagaacctaatggaattctatctgtattgagttagagaaaaatagcctaaaattccatttctggcaaattgtcttttagaaaaggaggaaaataaggacattttcagatgataaaaccagaatttaccaccaaccacatttctcacaggtgaaaattgtctcaaacaaatggagaaagggtaagaaaaatgtttgtgaaaatgagagtacagcttagtaaacattgattgcataaaaacaagaaaaaatgatgactaaagccataatttccatgtaagttaaaatttaaaaacatatcctaaaatagatagtatatgcacttaaaaactagagcatgtaacaccccaaaaagtagaggggaaaggagtgatgtttgaaaacacaacaaaccaattcttaatggaaatagaagttgggaaaggtacagaggttggaggggaggttttatcctggtcctgctgaaatgacagatatctgcaagcccctagagcgctgtgaggtaccacatcagctggtcctttgaaattagaatatggtctgattaacaccttagaactcagaggttacttcttgctgtcaatgcaagaaaactaaaataatttacactaccattcttcacatttaattgggaaggggtagagttcatcttgaaaataaaagtagttttgtgaacactatttgattagctgtaaatttcataattatgaaacatggaggttgaaatttttcttcttattaaacacagactaaatgttttaaaattaaagacttttatattacaatgatgcataataatgagagtattctcttctctgtagtattttataaaataaaaattactgaattttattttgttatacaagacaaatattatcttctaatgcaaaccacatgacctttcagtatgcttcaacattatttttcttaaaatgaagaaatactgtagaaatactgtcctcagaattttttctttggtgttactatttctaaacgtggattctctaatatcaacaaaaaattatcagaatcaagaacacagtaaagatttccttcaaaaaatttagaattaatatataattctgctcttagcaaactttctaacatcctcatttgatgaacacatgataatatctttagtgaaataagcttagaaaactgttctgtcatatttatttgcttttgtaggcaggtgacattaattggttagataatgaaaaagctactttataattgaatgatctaatcaaagtaatcagatctctgagtgattcagttatttcatttgattaatttgatgcattataacatttttatttatggaaatcaaaagcttaaaaggtaaaactgtaacaggtaaggtaaaggatatagtaaaagtaaaacatagtttttagggaggcgaaattaaaacatttgatatctggatattacattatatttgtttttcaaattttctttttttaacaagaatactgattttatatttttccaattttgaggcataatcgacaaatgaaattatatatatttatagtatatcacatgatgttttcatagatgtatacattgtgaaatgattaccacactcaagctaattaacatatccattacctcacatacttatcattttttctaatgacagcattttagatctactgttagcaattttcaagtacacaatacattattattatctgtagtcgacatgctatgcaattaatctacagaaattactcattctatctaactgaaatgctctacgctttgaccaatatttccccacccaacctcccctgggccccacatcctggctgtattagtctgttctcacactgctataaagaactgcctgagactgggtaatttataaagaaaagaggtttaattgacttacaattacaccagctgtacaggaagcatggctaggaggcctcaggaaacttaaaatcatggtggaagggcgaaggggaagcaagcatgtcttcacatggtggcgtgagacagagagagaaggggtaagatctcataataacccactcactatcacgagaacagcaagagggaatctgcctgcataagccaatcacctcccaccaggtcccttcctgaatgttggaaattatggttcgatgtgagatttgggtggggacacagagccaaaccatatcaccagccatggcaactgccattctactccccccttttataagtttgactttttaattgtagtttttaaaacattttgttacatgggtatgttgtgtagtgatgaagtctgggcttttagtgtagccatcatccaatattgcgcactgtacccattaagtaatttatcatctttcaccaacccccacccttctgagtcttcaatgtctattattccacatggtatgtatacatgtacacattatttagcttcaagttataaatgagtgcatgtggtatttgactttctgtttctgagtggttttaagataatggcttccagttccatccatattgctgaaaaatacatgatttctttctgtttttatggctgagtagtatcccagtgtatataaaccatactatcttctttcctttctctttctctttctttttctctctcccttcctttccctccctccctttcttctttttttcttttttctttctttctctttctttcttctatctttccattctcttctctctttctctctctttttctcttccttcctcccttcctccttctctccctccctcccttcctccttctctccctccctcccttcctctcttcctctttctttctctttttccttccttccttccattcctccctccctcccttcttccttccttctttccctccctccctccttcctttcctccttcccttcttccctctttctttccttccttccttccccataccccctccccctccctcctcctccatccatcctcctcctcctcctccttctccttcttcttcttttttctctctctctatttcctttctttttgagacaaggtttctttctctgtcaccctaggagggtgtgcagtagtgcaatcatagctcactacagcttcacactcctgggttcaagcaatccttttgccttggcctcccaaagtgttgtgattacaggcaaaagccatctgcctgaccctaaaccacgttttctttatccattatctgttgatggacacataggttgattctaaatctttgctaacatgaagagtgctgacatagacatacacgtacaggtacctttttcatataatgatctttttttctttcggtgagtacccactaatgggattgctggtttaaacggtaattttatttttagttctttgagtaatctctatactgttttcctaaaggttgtactaatttacattcccaccaagagtatataagcattttcttttttaacacatccacaccatctatcatttttcaactttttaaataatggtcattctggctggaataagatgacgtttcactgtggcccagttttactcttctgcatatggaaatccaacttttcctttctttattctattccattgatctatatgtatattttgttctagtatcctacaattttttctgttccattggtctctatgtctgtttttatgtctgtactatgctgttttcattactatagctttgtaatatattttggggtcaggtaatgggacacctctggctttgttacttttgctgaagacttctttggctagttggagcattttgtagttctatgtacatttaaactttttttttttatttgtgtgacaaataactttggaattttgaaaggaatttcatagaacctgtagactactttggatagtatggacattttaccaacacaaattcttctaatccatgaacatgagatatctatttatttgtgtcttcttcaatttatttcttcaatgttttacagttttcaatgtgtaaattggttaaatttcatcttggttaaatttattcctaaatattttataattttttatgcttttgtgaatggaattactttttaaatttttttcgtgtgggcatagtgggtgtatatatttatggattacagaggatatttcgataccgatgtgtaatgtgtaataatcacattagagtaaatgaggtatctaacacttcaagcatttattccttgtgttaaaaacaatccaattatactcttttagttatttttaaatgtgcaactaaattttttttactgtattcaccctgctgtgctagtaaataccgggttttattcattctttctctttttcgtaggcattaaccatccccacatcctcctcaaccccccacaacccatcccagcctctaataatcatttttttagtctctatatccttgagttcaatcttttaatttttagctctcaaagaataagaacatgcaaaatttgtctttttgttcctggcttacttcactgaataattaatgtcttccagtttcatccatgttgttgaaaatggtagaatctcatttttttttaatggctgaaaatactccattgtgtatatgtaccatatttggataaaagccattttaactgaggtgagattatatcgcattgtagttttgattttcatttctctgatgacctatgatgttgagcaccttttcaaatacctgtttgccatttgtatgtcttcttttgagaaatgtctattcaaaattttgctcctttttaaattggattattgcattttttccctatggagttaaagttgtttaagttccttatatattccagccattaatcccctgtaagatgagtaatttgcaaatattttctcttattctataagttgttctttttttcactttgttgattgtttcctttgctgtgcagaagattttttgacttgttgtgatcccatttgtccatttacactttggttgaaaatgatccatgtgcagaggaaaataaagtgtgttctgcagtcattttatgaaatgtgggtaaacatttattagatccataaatgggatttcttagcttcattttgggatagtttattattagcatacggaaactattgattttttatgctgattttgtatcctgcaactttactgaagctgtttattaattgtagcacttttttggtggagtctttagggttttctgtatataggaccatgtcatctgcaaacagacaattttacttccatttttatttagatgacttttatttctttttcctgtgtaattgctcccactaggacttccagtaccatgttgaacagaattggtgaaagtggacattcttgtcttgttcctgatcgtatcagaaaagctttcagtttttttactgtagagtgtgatattagctgtgagttgtcatatatggctctcattatgctgaggttcattccacttctatacataatttcttgtgaatttttatcataaatggatgttaaattttgtcaaattctttctctacatctattgagatgatcctataattttaatgctttattttgttaatgtgtacttcacatttattgatttgcatatattgacccatccttgcatcccagggataaatcttaacttggtcgtagtgtatgattctttaaatgtgctgttaaactgagcttgctagtattttgtgttttttgcatttatgtccatcatggatattggctggtaattctcttttcttgcagtttacttgtctgggtttgacacatggtaatgttgggcttataacatgaatttggaagtgtttcctaatcttcaatattttggaagaaattaagaatgattggcattaattattatcaaaaatatttggtagaattcaccagtaaagccacctagtcttggattttctttgcatgtttgtgattactgacgcaatctccttactcattatttatctgttcagattttctatttcttcatgattcagtcttggtaggttgcacatttctaggaatgtatttactccctgtaggttacttttcactttcaagtgtgcttaattatctgaaataaaaaatgaggattgtgtttgttgatatttctgaaattaaattaatttcttctttataaactggatttctttggtaattcttccagtttttatattatgctttatcaacagtaatcgctttttgatgatattcagtgtgaaacatttttctctacatatgaaggctcatgtgaagaaatatatctgattaattttagagtgtttaagaaacatgtaatcacatactgttttcctcagattaattttcattcttttcaagcttctaattctcagaattataaccatcatatagacatgacttcgatgaataaatagacaataaaaatttccttttaacaagtcatttctcaatttattgttgattctaaatagccttggtctaattcaatgagtaagtgactcatttgcttatttctggcaaacaagtctgaaattctgtttctttttttttttttttttttttttttttgagacggagtcccgctgtttagcccaggccggattgcagtggcgcaatctcggctcactgcaagctccgcctcccaggttcacgccattctcctgcctcagcctcccgagtagctgggactacaggcacccgccaccgtgcccggctaattttttgtatttttagtagagacggggtttcaccgtgttagccaagatggtctcgatctcctgaccttgtgatccgcccgcctcggcctcccaaagtgctgagattacaggcgtgagccaccgtgcccagcctctgtttcttatttgactataggtgtcagtgaaaaaaaaggagagaaaaatgctttgttacaattaaaataacaaattacattttagccagaacactcaaaataaaatgatctgtgctggttcaacttatgatttttcaactttacagtggtgtgaaagtgatgcacatccagtagaaactgtactttgagtacctatacagccattctgtttatcactttcagtacagaatttaataaattacataagagattcaacattttattataaaataggcttagggttagataattttgctcaactgtaggctaatgtgttttaagcatgtttaaggtaggctaggctaaggtatgatgttgtcaaggagcatctatattacgatttaattaaagatagtacacagaatttttcttcctcaacataatttttatttgattaagttctattacccagtctatgcaaataaactagaaaatctagaagatacaaatatctagaagaaatggataaattcctggacacatacatcctcccaagactaaaccaggaagaattcaaacccctgagtacaccaataacaagttctgaagttggggcggtaatgaatagcctaccaaccaaaaaaagcccaggaccagaagaattcacagccaaattctaccagaggtaaaaagaggagctggggccattccttctgaaactattctgaatagtagaaaaagagggactcccccagtctatttgcttaccagtttaaaatggttttatgctttcattttttggtattttatatatatatatatataaaattcttgtcattggactagaaatcagtagtcataaaattatgctaataagatcactgaaatatttactgtatgggatatacatttgaaacatatgtaagaatctgagttcataaatacttctagtccagttaaatctttgggcaatgctacattaatagtactggtttaaaaatatctatacgtcctttccctaattttgtcaactctggaataaaatgcaagaatggtatgttaatttttgtaatgcttaattttatttttcttatagaaaatctcattattttgagctttctaaatttcctatattgtttttgaggggtcatatagtcatcattgtttccacaaattatttaaaattatgacaatacagtcagatttaggattcaatactaatattgtttggaagtgttgccttctgtgaccatcagttaaagttgaatatcatgtggaatcttttcctccacctacgctatttgagtgttgtagactcttgccatttcagtccataagtcacctcaactgctaattgtcaggccctctgtttctttgcctgaaggttttctcttgtcactggagcctgttttgccacacatgtagctggctggaagagtcagggaattgatgctctctgggaaaagccttcattcaatgtctgacaggaattgacgaaaaaacattcctgggcccaacaggaacagctccggtctgcagctcccagcaagactaatgcagaaggtgggtgatttctgcattttcaactgaggtacctggatcaactcactgggactggttagacagtgagtgcagcccatggagggcaagcagaagcagggttggatgtcacctcacctgggaagcacaaggggtcagggaactccatcccctagccaagggaagccttgagggaccctgacttgatgtccggcccaggtactacacttttcccatagtcttcacaacccatagaccaggagattccctcagatgcctacacaacaaaggctctgggtttcaagcacaaaactgggcagccattttggcagacactgagctagctgcaggagttttttttcatacctcagtggcacctggaatgccagtgagatagaaccattcactcccctggaaagggggctgaagacagggagccaagtggtcttgctcagcagatcccacccccaaggagccctgcaagctaagatgcactggattgaaattcttgctgacagcacagcagtctgaagtcaacctgggatgctccagcttggtgggggaggggcatccaacattactaagacttgtgtaggcgattttcccctcacagtgtaaacaaagccacctggaagttcaggctgggtggagccccacctcagtgccacaaagctgctgtagccagactgactctctagattcctccactctgggcagggcacctctgaaagaagggcagcagccctagtcaggggcttatagataaaactcctatctccctgggacagagcacctgggtgaaggggtggctgttggtgcagcttcagcagatgtaaatgttcctgcctgcctgctctgaagagagcagcaaactcccagcacagctctcaagttctgctaagggagagactgcctcctcaagtgggtcactgacccctgcttcctgatggggaggcacctcccaggaggggtcaacagacacatcatacaggagagcttcagctgtcatctcatgggtgcccctctgggataaagcttccagaagaagaagcaggaagcagtctttgctgttctgcagcctctgctggtgatacccaggcaagcagggtctggagtggacctccagcaaactccagcagtcctgcagaagaggggcctgactgttggaaggaaaactaacaaatagaaagcaatagcatcaacatcaacaaaaaggacgaccatgcaaaaactccatccaaaggtcaccaacagcaaagagcaaaggtagataaatccacagagatgaagaaaaaccagggcaaagaggctgaaaattccaaaatccagaatgctttttctccaaatgatcacaactccttgccaacaagggaacaaaactggatggagaatgaatttgacgaattgacagaagtaggcttcagaaggtgggtaataacaaattcctctgagctaaaggaacatattctaactcaatggaagaaagctaagaaccttgataaaagtttagaggaagtgctaacttcctctaagtttagagaagaacatgaatgacctgatggagctgaaaaatacagcacaagaacttcatgaaacatatacaagtatcaatagctgaatcaatcaaggggaagaaaggatatcagagattgaagatcaacttaatgaaataaagcatgaagacaagattagagaaaaaagaatagaaaggaatgaacaaagccttcaagaaatatgggactatgtgaaaagaggaaacctatgtttgattactgtacctgaaagtgaccgggagaatggacccaagttggaaaacatgcttcacgatattatccaggagaacttcccagacctagcaagataggccaacattcaaattcaggaaatacagagaacaccagaaacatactcctcgagaagagcaaccccaagacacataatcatcaaattcaccaaggttgaaatgaaggaaaaaatgtaaaggacagccagagaaaaaggtcaggatatccacaaagggaagcccatcagactaatagtggatctctctgtagaagccctgcaagccagaagagagtgagggccaatattcaacattcttaaagaaaaaaattttcaacccagaatttcatatccagccaaactaagcttcataagtgaaggagaaataaaatcctttacagaaaagcaaatgctgagagattttgtcaccaccaggcctgccttacaagagttcctgaaggaagcagtaaatatggaagggaaaaactggtaccagccactgcaaaaacaaaccaaaatgtaaagaccatcaacagtatgaagaaactggatcaactaatgggcaaaataaccagctagcatcataatgacaagataaacttcacacataacaatattaaccttaaatgtaaatgggctaaataccccaattaaaagacacactgacaaattggataaagagtcaagacccatcagtgtgctgtattcaggagacccagctcacatgcaaagatgcacataggctcaaaataaagggatggaggaagatctatcaagcaaacggaaagcaaaaaaaagcaggggttgcaattctagtctctgataaaatagactttaaaccaacaaagatcaaaaaagacaaagaaggacgttacataatggtaaagggatgaatgtcacaagaagaggtaactactgtaaacatatatgcacccaatacaggagcacccagattcataaagcaagttcttagagacctacatagagacttagactcccacacaataacagtgggagactttaaaacctcactgtcaatattagacagattgagacagaaaattagcaaggatattcaggacttgaactcagctctagaccaagtggacctaatagacatctaaagaactgtccactgcaaatcaacagaatacacattcttctcagcaccacatagcacttattctaaaactgaccacataattgcaagtaatacactcctcagcaaatgcaagagaacagaaatcataacaaactatctctcagaccacagtgcaatcaaattagaactcaggattaagaaattcactcacaatcacacaactacatggaaactgaacaacttgctcctgaatgactactgggtaaataacaaaattaagacataaataaataagttagttgaaaccagggagaacaaagacgcaatgtaccagaatctctgggacatagctaaaggagagtttaaagggaaatttatagcactaaatgcccacaggagaaagcagcaaagatcgaaaatcaacactgtaacatcacaattaaaagaactagcgaagcaagagcaaacaaattcaaaagctagcagaagacaagaaataactaagatcagagcagaactgaaagagatagaaacacaaaaaaaccttcaaaaaaatcagtgaatccaggatctggttttttttttaaaaaagattaacaaaatagataaactgctagccagactaataaagaagaaaatagagaagaatcatatagacactacaaaaaatgataaaggggagatcaccactgatctcacagaaatacaaactaccatcagaaaatacacgtctatgcaaataaactagaaaatctagaagaaatggataaattcctggacacatacatcctcccaagactaaaccaggaagaactcaaacccctgagtagaccaataacaagttctgaagttggggcagtaatgaatagcctaccaaccaaaaaaagcccaggaccagaagaattcacagccaaattctaccagaggtaaaaagaggagctggggccattccttctgaaactattccgaatagtagaaaaagagggactccccctaactcattttatgaggccagcatcatcctgataccaaaacatggcagagacacaacaaaaaaagaaaatttctggacaatatccgtgatgaacattgaggtgaaaatcttcaataaaatactgacaaactgaatccagcagcacattaaaaagcttatccaccacaaccaagttggcttcatccctgggatgcaaggctggtttaacatacccaaatcagtaaatgtaatccatcacataaacagaaccaatgacaaaaaccacatgattatctcaatagatacagaaaaggccttcaataaaattcaacacccattcatgctaaaaacactcaataaactaggtattggtggaacatatttcaaaataataagagctatttattacaaacccacagccaatatcatactgaatgggcaaaagctggaagcattccctttgaaaactggcacaagacaaggatgccgtctctcaccactcctattcaacatagtattggaagttctgaccaggtctatcaggcaagagaaagaaataaagtgtattcaaataggaaaagaggaagtaaaattatttctgtttgcagatgacatgattgtatatttagaaaactccgtcatctcaccccaaaatctccttaagctgataagcaacttcagcaaagtctcaggatacaaaatcaatgtgcaaaaatcactagcattcctagacaccaataacagacaaacagagagccaaaacatgagtgaactcccattcacaattgctacaaagagaataaaatacctatgaataaaatttacaagagacgtgaaggacctcttcaaggaaaactacaaaccactgctcaaggaaataagagaggacacaaacaaatggaaaaacgttcttgctcatggataggaagaatcaatatcatgaaaatggccatactggccaaagtgatttatagattcaatgccatccccaccaagctaccattgactttcttcacagaattagaaaaaactactttaaatttcatgtgaaaccaaaaaagagcccctatagccaagccaatcctaagcaaatagaacaaagctggaggcatcatgctacccaacttcaaactacactacaaggctaccataaccaaaacagcatggtactggtactaaaacagatatatagaccaatggaacagaacagaggcctcagaaataacaccacacatctacacgcaactgatctttgacaaacctgagaaaaacaagcaatggggaaagaattccctatttaataaatggtgttgggaaaactggctagtcatatgtggaaaactgaaactggaccctttccttacaccttacaaaaattaactcaagatggattaaagatttaaatgtaagacctaaaaccataaaaaccctagaagaaaacctaggtaataccattcaggacaaaggcatgggcaaatacttcatgtccaaaataccaaaagcaattgtaacgaaagccaaaattgacaaatggaatctaattaaaccaaagcacttctgcacagcaaaacaaactatcatcagagtgtacaggcaacctacagaatgggataaaagttttgcaatctattcatctgacaaagagctaatatccagaaatctacaaggaacttaaacaaatttacaggaaaaaaacaatgccatcaaaaagtgggtaaagaacgtgaacagacatttttcaaaagaagacatttatgcaccaacaaacatgtgaaaaaaagctcatcatcattggtcattagagaaatgcaaatcaaaaccacaatgagataccatctcacgccagttagaatggtgatcattagaaagtcaggaaacaacagatgctggagaggatgtggacaaatagggatgcttttacactgttgatgggagtgtaaattagtttaaccattgtgcgagacagtgtggcaattcctcagggatctagaactagaaataccatttgaaatacccagccatcccattatggggtatatacccaaaggattataaatcattctactataaagacacatgcacacgtatgtttattgcagcactgttcacaataacaaagacttggaaccaacccaaatgcctagcaatgtaaggctggataaagaaaatgtggcccgtatatgccatggaatattgtgcagtcataaaaaagaatgagttcatatcctttgcagggacatggatgaagctggaaaccagctttctcagcaaactaatgcaagaatagaaaaccaaacaccacatgttctcactcataagtgggagttgaacattgaaaacatataggcacagggaggggaacatcacacactggggccaggcaggggttggggggccaggggagggatagcattaggataaatacctaatgtagatgatgagttgatgggtgcaggaaaccaccatggcacatgtatacctgtgtaacaaacctgcaagttctgcacatgtatcccagaagttaaagtataataataatttaagttggttttaagttggtttaaaagtaatttttatttggatactttctacaggagatgaaaattcataaagagagaaaactgaagtattcaatcagtcacaaagcaaagatttgcttacattttcttgtctataccaaaacatagtaaattataaatgagagtgtggattcagtgtgatacatgagttgcttataatatgattaaaatttgtatattttaaagctgatattttatgttcacatattttaagaagctgaaggtaaaagcatattctcatttttaatcaaagtaatcttataaacaatgaagagaaaaaaattagctcagcataaaattgttctttaacagaaacagtgtataccagtgcattctgcctagagaacagatgttcatatctcattacaacattctcatttcctgagaactttttaacttactgtgtttttgatatgaattttttcatgttattgaatcatctttaataaaacttcctggcttctgcaaaagataaaatttgtaataattgtttattttcttcatttgaaaactattgtctgacagattaattatgtaaacaagactgcaatcatttctggtcctgaggcatctacaacttatatgttgctgtaataacaaatctcctctgataactttttgatattgccttttaaaaatcaggccttgaactgaaaagaaagctgggtagcgccaaaggctcagttagtaacatgtacctgtgagacatggcactcatgaacaagtaggaatggcaaaaaaaaaaaagtagatatggaaaatatttatattattgttgagggctgaattgtgtcctcctcatatttttattttaaagtcctaaccacagatgtcgtatttggagatggggttgttgggaggtaattgggttagatgagatcaggagtctggggccctcatgattggttaatgaccatgtgaagacacagggagaaggtctgcaacacagaaagagggcccttactggaactgaattggccagcaccttgatctttgactttccattttctagaaccaggagatataggcgttgcttccatcatccagtctgtggtatttcgttatagcagctcaagctgactaatccagattttggtactgagatgtgcagtgctgcttcagcaaatacccaatcacggggaagtggctttagaactgggccgttggtagagattggaagagttttgacgtgcatggcagaaatatgcatgttaaaactgattctggtgagttctcagaagaaaacgaggaacaggttattgaaaactagataaaaggtgacattgttataaagtggcaaataacttggctgaacggtgttctacagttttataaaagctaagacttgtgagtgatgaagtcagatatttagctaagactatttctaaaccaattgttgacggagtgaccttgttccttttgagtgctgatagtaaaatggcaaaagagagagataaattgaagaagaaactgtaaagcaaaaaggactcagaagttgaagacttggaaaactctcagcatgatgcaaaaaataagaacgtttgttctgaagagagcggtaagggtatggctgaagaaggatttgataaagagatcattagtgtgacccatggattaaatcagccatttcaacaaaagccaagaatagagatggggtcataccagcaaagacactactagtttgaattaaggggaaaaacagagactaaatgaaataagaatgacagacttcttctattccatagcctacaccatagagctcttcggctgagaacatgtgctattcttaaagaaaagaagtgtcctaaaggtgtaatacattagggctaatgccatagtttcaacaagccaaacagcctctagcagaagccttggagatgaggcttcccagagctttgggaaaacaacccttgccctgcagagctgtggaggtgagactgctggctgcctcagtgggtccagaggtagagtatccaagcaaagaagattgtttttgaaccttaagatatagtgggatttatcttgctaagatttagacttgcttgggaattatcaaccttttctttttccctttttatcactttcggaatgggaacatctaactgcccctgccccacaattatatttggaaagcagataacttgtctggtttcacatgctccacactggagagaagttttgccttaggatgaatcatacctagagtcttactcatatatgatttggataatatttagggaaaaaaaaaggactttaaaagagttgatgctggaatgggttaagactttgaggctattgggatggaatgaatgtactttgcatataagaaaaatatcaattttgaggggctgggacagaatgctagagactgaattgtgtgccccccaaattcatacactgagtcactaataaccaatagagcctctggaagtaattagggttagaggagatcacgagaatgaggccctcataatgggatttgtggcattataagagacatacagacagataactctcttttctaccatctgagaacacagtcagaaggccatctgcaaaccaggaagagagccttcaccaggagccaagttaactggaccttgaccttggaattccaagctcccaatactatgagaaataaatgtgttgtttaaaccatctggtctataagtattttattatagcaggctgagcaggctgatataattttccatatttatccataaagtagctcaacaaggcaatgaaaagtctttttatccagaccataattataatgtggacataattagacataattatgtttaagttatagtttacaattcatcataactcactgcagactctagcaaagtatttgtcagcataagttttaagaaagttttgtttctaggaataaaatacacttgtcagtgttgaaaatcttaacatgtgttgtaaaatagattagaaggtctgggaaatttgcaaatgccctcactggtcataatattttctgaatctcaaggtaaccattgattgattacatataatatagttgtgtattacgccacaagtagagattttactccatcctgaccctgcataggtggttagcattattctcttatttatctaaagttcctgccacaagttacaaagcagaggttggatctcctaggagaaataataaataaagctcgtttctcataatcttggtagaaaaggttgtaatgagcactcttgattgttgatgcagagttatggagagtcatgagctcaggttctcggcaccaagatgacatggtctatgaaaacagatgtctctcatatataactgagtcaggatttccatgtttattgatgaagcagatgatttcatgaagcaaactgctgactcaggaccaaaacaagagttagttatgtgggcccaaatgaaactaaagaggggagattaacttcaatgatttgtcttgaaatattgttcttttaaatgttctattttctgatagacctgggtaaaaattgcttttatcttttttgtctaatgatcaattttaaaagacttaaggaggaaaattagaatgacagaactttttaatggcatcttgctctaactgatatatcaaagttcatgaaaaatatcttgtgaaaaatcaagtatgttttgtcagttaataaattaacaatacctaaggaagatggttctttaaaaaatgacacatattgataaatattgtctgataaatggtcaaatattaacccaagtgattttttggtctaattttgcatcctaattggataggttaaaaaatattttttcaaccatatccatgacagatatgtcaaatttaagggaaaataccacttgattaggtaggacaatccataattaaagacataaaggctatgttttgcatatggatatcatgactcaaaactccttccatttatggagggaggaattttgagtcacaatctccatatacaaaacatagtggaattccataatttccatatacgaaacatttatggaattcctccttatagaaagcatagtctgctgctgctgtgaggcttctgaaatcagccttagaagtggaatacaatgccatttcttggcaagtacgttggtgaatttgcagattctgattttcagacttggaatagatgacaagaaaaggacaatgaacttatgcttcccatgagagagagagtaagtaactctagatgctttaaaaatcctccaggcttagtatattatagttccagttttgttaaacataatatgaggatattattatacatttgcccacatcatcatctgttgcccttctacaaataaaatagacaaaatagaacatgttatcaaattaatggttctggttcaggaaagttgctatttaatttaatacatactgcagtagatgactactacaaggtattagaagggccaatctgatatcttgaccttagtctcatagtctcatcacagactttggctacaggaacacaaaaaataggtcagaaaaagctcataattctcagcgtctgaggtaaccagtgaaacttcctgaaggccatgaaaattagagcattcccaaaaccctaaattatgagatgggccttctaagaagaaagcacctttttcattaacattggctcaagcttatcctaatggaattattgttgatgatataataatttgaactataaataccactttcactctttattctgggaaccagttctgaaagctgattcccttgcatatgccttcctgtaactagaaaactcactcattgctcaaaatttatctacaaactgcttttttgaacatatgtaatatgctatcacatgtcagagagtaggatattggtaaatacctgagacagatcacagaattttccaatccaggaaaaatctcaaacatgccaagatcctatgtatatggaaggtttgtcatttacaatcttactttatgctggttagaggattaatttcactcagtagaggttaaatggacactgattttattccaataatttgttattcagagaagggtcagaggaagagactcctgttttactaagtaggaaattcaaaggaaacaccacttttcctcttcattcaggaacgtcaatgaatatctacatatttgtatctgacagcaaatatcattgacttactttttaatggctagtggcttcattaaacagcatacagacacaacttgtttcattgtgcttcattttattgaacttcacagatatgacatttttttatgatttacaggtttgtggaaacccgctgttcagcaagaccatttgcatcaattttccacaagcatgcacttacttcctgtctttgaggaacattttggtaattctcataatatttgaactttttcattgtaattacatctgttataatgatcagtgatgagtgatgtttgaagttactagtgtaaactgtttttggacaccataaactgtgctcatgtaagatggcaaacctaatcaatagggtgtgtgttttgactactccgatctacctctccttgggcctccatattctctcagacacaagaatattgaaattaggccaattagtaaccctatgatggtgtctacatgttcaagtgaaaggaagagttgcatgtttctcactttaaaaggtagaaatggttaagcttaatgagaaagtcatgtccaaagctgagacaggctgaaatctaggcctcttgcaccagttagaaaaattttgaatgcaaaggaaagcttccaagggaaattaaaagtgctatttcacacaaaaaaattataagaaagtgaaacatcattattgttgatgtggggaaagttttagtggtctggatagaagatcaaacccaccacaactttcccttcagccaaagtctaatccagagcaagatcctaactctattcaattctatgaaggctgagagatgtgaggaagctacagaagaaaagctagcagaggttggtacatgatgtttaagaaaagaagttgtctccataatattaaagtgcaaggttgaagcaacaagtgctgacggtgaagctgtagcatcagaaggtctagctaagatcattgatgaaggtggctgcactaaaacaatagattttcaatgtagatgaaaagtctggcttcaaagcttcaaaggactggctgacttcctggttaggggctaatggagaagaagactttaagttgaagccaatgctcttcaaactaacattttgaaaaaatatttaaaagacgtgagagatttaaccatatggcttctaaggtgcaaaataattcaggcaaaagaaatagctagagaaatgtcctaagttaggaacatgatactagttttcagtaaacagcaagattactactgtggtggggatagcttcagtaagagcgaggccactaggagagagggtcaaagactgccctggaaatcaatcaggcatttatggtgaaatggacggtcataattggttgatatcttaaagggctgattccagctgatacgttaagataatacaattaggaggctgggccgggtggctcacgcctgtaatcccggcactttgggaggccgaggcgggcggatcacgagtttaggagatcaagaccctcctgagcaacatggtgaagccccgtctctactaaaaaaggaaagtacaaaaattagctgggtgtagtggtgcatgcctgtaatcccagctactcaggaggctgaggcaggagaattgcttgaaccagggagtcggagtttgcagtgagctgagatcgtgccactgcactccagtctggagacagagcgagactccgtctcacaaaaaaaaaaaaaaaaaaaaaagaagaagaagaaaaaaaagaaaagaaaagaaaatacaattaggaataaggaaagcagggaaaacttttaagagaaaatgacaataatgcagacagggggtgatgtgagatgagtcatgaaccatggtggggttattgcaagcaggaaaagaaaaaaatacatatacatactttgagttcaaatcatataaatatatttttaaacatttcacatggaacatttatatagtcaatatttatattaaagtttaattgcacaaattgcaaaataaattatttaaaatataagtaatattcaagaattttgtttaaagaggaaacataattaaaaattttgttatgttaaaataagtagtgaaatgacaacatctccaaattcagtaaaagctcttttccaggaaaagactgctatattaataaaaatagtaagcataaatttactaagtaaaacattcaaacttaaaattctaaaaaatgaataccagagtaagaaaagaaagcagataaaggcaactaatacaaataaaacaatttaacaagttggaaaacaaaaagtgtaaataagccaatagtaagttttttgaagaacaggcaagataacagttaaagtaaaggaaagttaaagtaaaggaaagcaaaaaatctaaaccccagaaggtaacaaattagtttcatattagtaatagcaaaataagttaatgcacagagagaaagtgattactgtgctctaccataaaaacccctggcccagaaaaattcatgcaggaagaataccaaagctcagacaatcctaaagcaatataagttgtcccacagtatagacaaggaaggaaaatattcaaatatgatttatgaaacgagaataactggaatccttacccccaacaaagattgcactgaacaggaaagctaaaggccaacctaatttatgattagtaatgcataaatcttaagaaaatggtagcaaacagaatcacttagctcatttaaaagtgaagccatcatgacaaagtgggattaattccagggatgcaaggatgatttcaatattaggaaatctaaaagcataattcactgtattgatagaactaaggagaaaaattatacgatcacatcattgatgcaggaaaggcatataacaaagtgcaacagtctttggggattaaagaataaattaaaaaagaaaatcatagacactttcttaatacaaagtttgtgtatagaggccaacgggtaaaaatgaactagtattaaggaaatatatagcttctacagctagagcttacagtgtgaatgtgatgaaatgaaattagttaggtagtcagagaaagatcataccgggctttgcatgatatgtgagaacatttggttttatcttggtggtattaggaagccataaattatggttagcaggagatttgaatgaacaatttgggattttgtagagctcactgtttctgtatgtagactagacaggagtaaaagtgaggtagattgggaggctggtgcaattgtgttgacctgaataataagtatctttaggcaatggagtgtgggtagaactcctgagcacacagtaggactttgacaaatacagtctggaattcacaggcatttaaaaaaaataactggagaataatttaatggtctgataattttaaaatccttaaagatcttacaataacttgaggtcaatgtttttgattacaaaaatattttgtaattacagaaattaatataacattgagcaatagggaattcatcttacaacttctgtctcttttatattccactaaggtgtaagatatgttttttgtttttgttgatagtttcttattttttaaagatgttttatttgcatagaggtgtttatactattctctgatggttgtttgtatttctgtgggtcagtggtgatatacactttatcattttttatagtgtctgttcgattcttctctttattctgctttattagtctagctagaagtctattttattaaccttttaaaaaagccagctcctggattcattgattttttgaagggtttttctgtctctatctccttcagttctgctctgatcttggttatttctggtcttctgctagctttggggttggtttgctcttggctctctagttcatttagctgtgatattaggttgtctatttgagatctttctagctttttaatgtaggcatttagtgccataaattcccctcttaacattgctttagctgcatctcacagattctggtacattaaacaaagagacaagctagatactatctcacaccagtcagaatgatgattattagaatgtcaagaaacaaaagaggctagccaggctgtggagaaataggaacgttttaaaactgttgttgggaatgtaaattagttcaaccattgtggaagacagtgcagtgattcctcacagacctagaaccagaaataccatttgacccagcaatcccattactggatatatacccaaaggaatataaatcattctatcataaagacacatccacacatatgttcgttgcagcactagtcacaatagcaaagacatggaatcaacccaaatgcccatcgatgatagactggatcaagaaaatgtggcacacatacactatggaatacaatgcagctataaaaagaaatgagatcatgtcctttgcagggacatggatggagctggaagccattatcttcagcaaactaacacaggaacagaaaaccaaacaccacatgttctcacgtataagtgggagctgaatgatgagaacacacggacacatcatggggaacaacatagactggggcctggtagtggtggtagggggaaggagagcacctagacaaatggctaagggatactgggcttaatacctagatgatgagttgataggtgcagcaaaccaccatggcacatgtttacctatgtaacaaacctgcacattctgcacatgtatcccaaaacttaaaatataattaaagtaaatttaaaaatatatatatattttaatgtaattttttatttgtgtggtttaaataggggcagaaacaacatatgaaagaagctcttttaacagagattattgcacttagatatgcaaaaaacaaaatttataatgtgtgggaaaaatcttctcaggggcacagattgtgcaacatgatttttctctagcatttgtacagtgttattttctacatcctgtatttaatgacatgaaagaaagaaatcacatatgcagtcgcatatatttacatttttaaactgttcttaccagagttagcatgttgtcactctccactaaataaatgatctcatttttctttgattatgagcaatgtacataatttaaacttcaattttctcactctcttagtggtttctactatcatcaaagtctttaaagaatgcaattagagacaaatacaagaatgctatgtctctttaaatgataaatatagtaaatatactggaattttaagcagggaaccattggatgtatggaagtgaggcagttatattgcgtcttgaaagacatgaagtatttgtctaaacagagattaactgaattccgatcctttcgttcaagtccagcttaagttattccaaagataagtaagatttattttaaatcaagtgcaagtaaggatcccattttctaattaatatttctgatattgaaggttttattattcacatagtctcagcagcacaaaattaactgtttatgaatgcttggggcttgttactactgaattatattttatgtatcaaggctcaccttttgatcatcgttctttttcgattaatgaaagaaataacttagagatcacctagtacctccagctcatgttttgagaggaaacaagtttaggagagagctggtggctaaggcagaagctcacagtttattgaatcaaaactgaggatagaactgagacaataccagggtctctggattcctacctagaagttctcttactcccctttctttcagccatccatttacacagacctttggtactttctcagagattttaaaatttgaacacaactgtcaaagaaggctatctgaaatagtgcaaaaacaattttttttttaataaatagctatgagttagcagaggttcatatctggcacactgtggggattcaaaaatacactttgaaacttaattttattgtttttctaagtgtgacttttgtggtagatcttgtttcagtgaagaaatattttgtaattggcaaattgaaatacaggcttaagcagtttttcttggccaatattaataggaatttgtatgtgcatgcaaattattaagaagtttgaaaatttggtgtctaaattgtaaataatgggtatcagtaaacatttaaaatacacttttaggggctctgtgtggtggctcatgcctgtaatcccaacgttttgggaggccaaggcaggaggatgacttgaggccaggagttcaagaccagcctgggcaacttagctagagcctatctctacaataacaaacaaacaaagaagtaaatgcatacataaataaatacatacatacataaaattagccaggcatggtggcacatgcctgaggtcttagctactcaggagactgaggtgggaggagaacttgagccataagtttgaggttgcagtgaggtatgattgtaccactgcactccagcctagacagcagagcaaaaccctggctcctaaattttttttaaaaataaataaaatgcacttttaatatagaatcttgtcaacacttgaaaatttcctacaaaaccaataatagtaaccttcaattttaagataaagcaattgaggccagagtaaccatgtaattatccaagctaatataatccagtagtggtacatctggattctaaattcatatgttctggctttcaagtaaatattatgtgcattaatatttctacaaattaatgaaaactcaatcaactagattaatattattattattactatttatttattttttttagatggagtctcgctctgtcacccaggctggagtgcagaggcacaatctcggctcactgcaagctctgcctcccagtttcatgccattctcctgcctcagcctccagagtagctgggactacaggcacctgccactatgcctggctaatttttttgtatttttagtagagacagggtttcaccgtgttagccaggatggtcttgatctcctgacctcgtgatccgcccacctcggcctcccaaagtgctgcaattacaggcgtgagccaccgcgcccagcccaactagattatttttaatgtatatattctaacattttcaaatgaagagattagacggtagggtacttcataatagcaataacgggaaaaactgtaattatgtttatttacaaaacaattgccctaaaatcttaatcagtttgttttatttttcccgtagtttactctggagtataaaaaactgtgttcctggatttctcaacttagtttcccctatggagctaaaaatttactgtaatttttattctaccaaaacttagcataattttactacagcaaaagttgaaacattatcagaactaataaagaaaatattaatatttccaatacactctaggacttgtctggatatatctatcacctgtatggttgactgattttatacaggaagctaaaaattcatttaggtgccttcaatgaaacatctgagtgattcactcagaaatggaaaattattttctaacccataaaactgctagaagttttaatcaatcaacagttactagttgaactccaataaaaataacctccacttctacagaatttgatagataagattctcttctataaatcccaccttgttaaattatcatctcaacgactggaattagtgagataactacattttataggtagaaaatattctgcaaatgatcaagattacgtacctttggtctttgcattctaaaccaatttgggctttttctccccccactttttactgcatggtataaatgcactaactttcacactgtgatgaaagtcagtaacttcaagatgctttttaactaatgagttaggtctaccaaacaagaaacaataaagtaaaaaggagattttcctagtgattgcactgcttagagaaagcttaatatacaatgcaaacctgtaggctaagtcttacatttcctcaaagaaacttttggagattcatttagctcagattactgtcaccctccactgtactgctgcatcaatttatttaaatggtaacattttattcattgtaacttgccctctgtctgatacatatgatgtcatttgctctcacttgaaattactaaggttccagaaggccagaactattatctctttcacttttacatttttcttaatacttatcagagtgactctcaacaaatgtttgttgaattaaaaaatatatggaagttggataggcaggagtggtactgatttcaatggaggaggaaagatttatgtgtttgggcacctattgtgtgtcaagcagtgggcaaagcacttttcaatcttctgtagtcataatcacttaagacagatagtctaatcattagcatatttaaaattgagtaaactaatggtctgcacaattaagaagatttgctgtaggttataggtgacaaagtcaggaagtggtccagttttatttgtcatcaaaacacctgctgctttctgctcccaagtaatgtcctccatctgaggtatcctttaataacagacaataactcacagcccaagtgggcacatcacatttgtgattctggttagaagtgtaagaatcttacttaaactgttttcacacaattctgggcttgacacttcaggtggtttggctctgtgtcctcacccaaatctcatgttgaattgtaatcccaagtgttgggggagggacctggtgggaggttattggctcatgggcccggatttcctccttgctgttctcatgacagtgagtcaattttgacgtgatctgtttgttcaaaagtgtgtagcacttccctctttgtgctctcctgctaccatgtcaagacgtgcctgcttccccttcaccttctgccatgattctaagtttcctgaggctttccagccatgcttcctgtacgatctatggaactgtgagtggatcaaacctcttttctgtataaattacccagtcttaggtagtccttatagcagtgtgagaaagtactaatacaatacacatttccacttgtactttttgaaatttttttggagtttcacaacagcaaatcattctgcagtccaacagcaaatcattctgcttttaagaaatgaatttccctccatacatttaccaaagtccagttctggctcttaattttgttaggtaaatgaatgagatgtcttgagtgccttgggcacagtcttcaaaaatgatttgcattaaccacttatcttgttttgttgcccaggctgatcttgatctcctggacccaagtggtccacctgcctccgcctcccaaagtgctgggatgccacgtcataaccaacaatgcctggccaaatttttctttacagtgaaagatacaatttcccgacagagtcagcatacctaagtggtccaaatgcaccagaaaatcttgagaaatcagtgaattagaaggaaccttgattaaagcaataatttagaatggcttcctgtgtattccttcacagtcatttttaagtacttcctgtgagccaggcaacttgcttagacattgagatacaaagctcagtgatgctgactgcttcaggcagttcacattctagtaaagctgcagttatttaaacaggtttttataacacaatgataaaaactcaaagaaacccaaagaagagcagaagaattatagactatccaatgatgtgaggctttgcttgcttaaaacattcacctctccaaaccacatggaaaatatttcctcatcaatgcctttcaagtgtcatattactatgtttctattaacttttgcaatcagagatgttttttggcatgtgccaggtgatcaataaatgtgttcaccaggcttgctaaagatgacaaatgggcttggaggaggttggtagatttgaagaaagcagcttaatttgaataagaacaaatggagagtgagatgtaactagggaaaacagagacaattctagctttactgagctttatcaatgaatttcttatacaatgcaacctactaaatatctacaaaatactttgcaaagcctttgcatttgttagtgattccaagaagttctaaaccaaaagatgcaatgacagtaatgcctacaattgcaaatataaaatagtttccctagtgaacttgtgctattgtcatggtaataaagattaagtactcacttaatgagtggaagcaatgtgaaaaactttcattttattttagtggggaatccaaaaataaatgatagttaaacgtaaagacattttcaagttctctcgagtgacagcataagaaagataggtgatatataggatttcatctctagaagctggcataaaaataggtgagaaataaagtaaaacctttggatttaagattctcaagactatgttttctttctttctttttttaaaattcaagtcatttaatataccttcttgtatattgcaaaccctcaaggggaaagatacagtttgtgaaaacaaaaacgaataaataaaaaagaaagaaggaagaaaaaaagagagagagtaagaaggaatacaatttgagaatagtttggagaggcatcatgatgaagccagtcctcaactgagtcttgagagggctcaagactcaagttgacatcttgaatttcaaaataacagattattgactttgggaataccatgctgcccctcttgagatttttgagaaacacagcaatatttcttttgctgtttgaatggcaccattctttatgtgtacatctgtgcctctcattgcaggatatttactaggcctggaacttctacaaactccaaactccatgacctgaaatactaagtaacaatggcaactgccccccatcaccacaatttcattaacaagcaaaaatattgccccctcacctcccacccctcattcacatatgcttaggagcctggcttttctcctgattgaaactatttacatatagaaagggattagatggaaagaaaaagacagatttccatctcaattaaggttttcttttggttgttaggttatttttgttttgttttgtttttatattcacgaaacaaaactcaattctggttaattgaggaaaaacatagtcaaaaggtatttatcagaagaactagggaagtcacctgaaaattgaaggatggttagaaatcaatgacttcctagagttttgggacctttcttactatttttgccgctgccttataggatgatttgtacccaacacagtggatatccgagtatcttttatcagatttcaaatctccagtaaggaatgttgttggtgcagtttggatcatgatgcttacataggagtctctcagatggagccaaggagtgagcccaggatgggccactgggtaagtactgctgtgtaaattgccttatgcaactaggcatattctattaagccttgacaatattttgaattgtttgacttaggtttaaaaatcagaatgtgctgtgaaaacagttgaacatccctttgaaatgtaatactcaagccgtattgagactttatttcctcatctctacaaatgactaaaagccaagaggtgttgccctttagatggggtatacactccctgaatgtcagataatgaatgtcagtcttttaagtcaccaagctggcccttgccaattgagtctgtgagtcccacatatgttagtgaggtggttcttagaagtgttattctcctgggatggaccaagaagtacacgaagagaaattcattttaaacttcatattcagagcaataccaatttaaaaagtaaaaaatatgtgcagatatgatgcataaaatgtgtagctttaattttttccttgttactattattttccaagacagaaaaaaaaatctaacaatttcttctcaacgtagaagtgaaagaaaaatatgtcaattttcaagaaatagccatgtactatttataattccttttaaaaagcaagtgagttcctggaacgtgctgactctcctgtttttggaaacttctctcctgctcattagctatttcacataaagcaacaggacagttccagaggtacctattaattcaatagagaactgattgaattttcaacttcacctttctgtgatatctcatgcatatttattcctcataaaaatgtcttcacttctgtatttcacttttggcttttgttttttggcaaaaatactgtttttccccttttagctacattttaacttgctatatgttccaatcagcaaagtatactttttttgttcttgttttctattttttaaatcaagttcaaaatagttgataaagacaagtcttttgagaaagaaaacaatttgttttggggatttttatttccaagtaaaatagaatttctatttccaagtgaagtagaaactcttgaaaatttacccctcagttaaaaacaatgggggtgataatatttctagctctatctataataactagattttaaaaaggtttttaaaagatagaatggctgcattgattttcattgtgaagaaacattacaattaggaataaaaaagggaaataaagctaacatctaaacttagtatgtgtttctgaaaatcagagtacactcaacataagagagatttctcatagtgaatgcttagtcatagtagtcagtcatagtagttattcatatacctggacacagttttcaaattgcaacaatatgctgaacttatgaagtgtagtttaagccatacagttagaaatatggatgaaataataaaacaattatagtcatatggttaatttgtgggaatgaaataatggacagtatgattagaatctttgttttctttgatatgctgtattgatacagaattaactgcatccaccaagttactttgcccctttctaactaatattaataatttactttatatcatatcaaacagttatttcttagggtagtcttaaatagcttagttagcaagaaaatacgtccatcacaccaggacctgacacagtgttgaacttgatttctgtttgctaacaattacttttctatgaaatcttgcaatgagtctcaattaatccttcacctactgaaatgatataaatacagtttagtaatcagcataaaagtgagttttctgtttgtattagttaatgattgctatataacacatcactacaaatttagcaactttaaattatttacatttttggattaaagtccagacagaaagctgggcacagtggcacatgcttgtcattcaagctactcaggacctgaggcaagagggtcacatgagctcaggagtttagggctgcagttcagtatgatcatgcctgtgaatagccactgcactccagcctgggcaataaaacaagaccctcatctccttaaaaaaaaaaaaaaaaaaaaaaaaaaaaactaaaaaaaggccaggcctgtcttagattagcccactttttaaagtctctcatgaggctgtagtcaaggtatcaacctgggttgaggtatcatctgaacactcagttggggcaggatccaattccaagttctcatggttgtaggtaaaattgatttcttcttgggctgttggaatgagggctacagtttctagctgtctgttgttctcaggccacctcagttctttgcctcattgccattcccaaaataaaaactcactatggaggtacaattttatgtaacatcttcatggaagtgacatctcacacctttgccatattctattgattaagagtaagttgtagatcccacccaaagtcaaggaaagataatatataaaatatgaataaaaaaggtggggaccattggggcctgtttttgagtttatttgccatgctgttgtacatactaaatgctttagtcctttttagtttctactgcaccattccagataaaagattaaagcagaggtattgcaaaaagtatgttttcatatgttattaaaatttaaaccaaataaatagaatagtgcactagataaaatttgctattgtatttgaccttatgatttattttagtaatacctcatttgaactacatgatatatggagaagtgtgagactggtaattgtatctcaaaggctataagaagcaaaacttacatgtaaacttctttgtgactatgcccatagtatctgtgagaaaaaatttacaagagattttccagtttaggcacagacttatacatattggaatggataattttgatcaaagaagaaggcttcattttgatcaatgaaggctgcccaacctccagattcaatgggcatcttcagataacttgggaatgtcgtcacaatgtaagataaacttgaatgccatatggcatattctaaatatgtctggagtgatatatttagaaatatatgtgcattaaaagaggcacttctgattcccaaggggaatagctgtattgtgaagattaaattaagtatcatcatttgagggacaaatcagctacagttaaaggaagcaaattagagaattttctacccaatgaacaactttccttagttgtcatgctgtttggtattaacacagtgatatcagctgtaatcaaaaacaataagtcctgcctagataaatcaatctttctagaaaacatgtaatcttgttttatatatttttacattagatacagcataaaccaaaaatctccctatttatgaaatttcctttttaaataatgagctctgctaaccaactggtatccacttttggaggcacttccaacagaaatacctccttatgtgaactggaatttaaacatttcagtccacttgtttcttgattcctttatttgtagtcacctgaacttatataacttaccctattcataggtttatatttttgaggcttatctatacaattttaagcccatgttaaaggtaaatgggtgacttaaaagcaaattttcccagccttttatccaggtttattgtcattgtatccagtgttgcttattgtcatttaatccattgtgttcaattgtcgtcatatctattatatagagaaattgctaggaaattgaaatgctgatacaattcaatatagtatcagtaattcaatttttgaatgtaccttaggacattccactgcatcgactttggacttttttgagtacctttctaccaataagttttttacccttagtaagaattattaatatagttttttatccttagtaaaaattattaattaatatattaatattaagaattattataattcaatataaactatattgaatatatcagctacatattgaattgtactatatattgaattgtatgtcagctatatagtgaattgatactatattgaattgtatcagcatttatacaatttatgtaaggaagctatttatagctcttagagtggtaatatgtgatttaaacaacacacattcacacttctatataaaatacagaatgagaaatttctggaggatgagatgattataaacacatatctaattttcttttcttattgtactgcagtgattttcatacccagctttaggaatctatatggtaagagtataataataatgactggtgcaaagcaatggtgaaaatgttggcataaagagatatattaaaaaaacaaaaattggtaattaataattttaattcaacataatgaaaaaacaaagtgaagtcaatttatattatcccaaacctattgttactcagttgctttgaaagtaataattagaaaacaaccaggggaaaattcagtattttatatgcaactgaagaaaactttaaacccatttgaaataagtgactagacttcattggtttgtatgtttccaataagtgcattatagtatttggtatttactgaaatacaattacttaagaaacaggtccaatccaagtacaagaaagctaaacatttacttcagaagttttgctgtataaaatttaaagtttaaaatacaaaattctgattaacaaatcacaataaaagagttatttcttttggtaataaattttaagttaaaaaaagtgttcttatgtaaaagataaagtgattattaagaaaatttagccaacttctataaaaatataaaaagtatagattggttcatttgctattcagaagagaggacacaaaacagtatagatattttcaatcatatttgtgcaatttaatacagttggtcaacatgttgagttagttggcacatcttttgctaaggtcattaatttcaagttgtgccttatgtccaactttgaagcctgtgctttatttctccatatgaatacatttgcattaatctaaaacttcttcatcttaaagctccaacagaagttatttgttttcctttaggtcttatccttcttgtttaaaatgcttactctgctcaatgttactgtcagacattttgccattgaaatatgtgctgccttgctctgaaatgtgttttcataggttcatgcaggaaacttctagggctataggaaatacaatgtcatctttggttcattgattctggccctgtaagactttgtcatatgaacgtcattatatacatgattattattacacttctgctaagtgaaattgtaactctggcatttgccttaccagaagtagagactttgagtaggcaagtaccattcaaaggcttccatggacttgacctatgtcacttgttggcctacatatgaccattttcaatcagaaactctttactgttaagtaagagtatatttttatgatgaaatgtaaagataatacttcaagattattgaatattcattttggggattacattagcttggcaaattctttttggagagtgaattttgaaaacagagagcttgagagagagagaacattgcaatacgtatatgggctacagtactagttatcactagatatcaccaaagtttaagaacaggtctgaaaagggggagacgagcatgcaaaatatgtattttaaatgcaaactcatcaacttttaaatgcttaatattcttccacttaaaaatattatatcacttagtagcatagagtgatagatgattacataaccactctctgtgtaatttgtatacttcctttctaaatagagttcaatcctttcaatttacttgatcctgagcaaatctgagggttgataatgggtatagattaatccaaatgcccatgatttttgaagctatgtaagttacttagtctatgtattagtagttgtcaaaaggacattgagatgcctagtgctagatgatagtccacaaaactggttttcttatctagtgagttttaaacagcaacttttgctagggtatctttgttattttggagaaggaaaataatttcattcaggatagtaaagttctggctttaaatggcaatccaaattaccagatgacctttaactgaatccaaaattaagtcagaagtaggagaatcatgggtatttgaataatatttcacatcagtgactattaatttattcttcaaacttggaaaataagacttcttaattttggattttatagattatttgccttctcacaaaatcactgacctaaacatggtgtgaaaattttaaaaacaagttttgatgaactaggaaattcacaatgtttttgctatgtgatgatttacttcctacaaaaactggcctgtgttttataattttataaaaccaacattcattgttattttaactttaaactttggtctatacaggaactgaaaaactgtaaaaagatattcacattttttaatactaagaatatataccccagagaagggggctttcacttccgcacataactaagtgcaatttaagcagaatgtatgcttttaatttaacacatatctaactttgcaacttaaatatctgactaaaatttgtctgataaatacaaagtaatacttttgtagcatcatacttggggtggcttaccctgtgtgataggaatgatctccctgtcctaaacatgcagtaattcagggtcctgatccatatttaataagacattattaatacaagagtttactctttataatgcagtttatatgtttaagatttgagtcctacaatctagattacatgcaaacaaattgtagaatacatgtatttgcttttccagacttatctgtgtagtttcaaaatgtcagatacatctagtttactgtgattcagtgaactattcttataggctgaacaatgcagttaaagaaaaatgcagataaaacactgccacttaacacatcactatactggttaaagtttgaaacattaatcaaagcacactaaacacttaatttggaatgtgtggaaggacaaaaagatctctaaaaattgattgaaggacgaagagtctagcaccggagacctataatcatgatggcttgcgctgcaagatgctgatcattgccatagtaacagactgtgttttgttacatcatggaaatcaggaaaatgtgagttatgagtgcaacatcccaccgaggggacaaattcaaagctattataagaaagggtaatataagatgtagtcataggtaaagatgagcattttgaaaagggtaattacaaaatcacacgaagatagatgagcagctcatgaaaattcgagtctacttttgtaagtgaggcttttatttgtaaccattcttaatcattgttatcactggcttattttcttcttccttttgtgaaataagacacaagagcaaacagctttgaaaagaaatttcaatttttttacttgttttaaatcctaggagactctattttctactgttatcaattcaaagagaaatataaaagatttttaactttcatgtattgtaaatattgcactcatcaaatattcaactgtacttatactgtggggttatagatgtcacatatgaaaggtccatgttccaagcatatgtacatgtattccattattatgaagcatgttagactcaaatgtgttgatacgttactaagtacagtgttgatttgtataggaaacccacactgaaaaaataaaaccttaggatattcagaattacatttctaatagtggtggtataatgtcaaagtggactgatgttgccacagatagcaataataaaatctaaacataatacaataagcagatgcctgaaggcactggggaatgaagagaagcaggcaggtgtggaacacaaattctggtggaagctgtatggtgtattcccctgtagtttcagtttgagggacaggagcaatgaacacacatagagttgggatggaggtagcaggggaaagagcacagtttgcctggcctcaggagccacagttagaagtcagggaaattcagcctaattgaaaatagggtgagatacctatgacaacatcttgtattacatcttgtattttttttcctgtaaaggccagagaaaagatcttagatttctgcctggccaagtctagggctgatccttgaatcatgcatgagtggaacagaatgagagaaactcagagataaaagatctgaatggaaccaggagctactctccaagaaacattttgcattttgtagttattcaaattaattgcctgctaaaacaaaagaaacatttcttacagaaaataacagatttcagaagttccagttgttaatattcatgatgtctaagatgctgccaatagataagtttcaaaaaatggtaaaatcatgggcttcatagagatgaaagtgaacacaaatgattttacttattcatttattctattagttagatattatatctagttcaaaaatatatcaggaatcttgaaataaatgttcaaatggaggcaaaacagattttttcccccacagcagagagtgaagtcaattgaaattttaccagacaggggagaattcacaggtttatagatcacttatgctttgcagagctatgaaatagctcaaagatgatgaaaggttaaaatcagaaaactatgcaaactggttgtattaggctactctcacattgctataaagatatacctgactgggtagtttatgaagaaaagaggtttaattagctcatgattctgcaggctgtatgggaaacatggtgctggcatctgctcagcttctggggaggccttggggaaacttacaattactgcagaaggtgaagtgggggcaggcacatcacatgaccagagcaggagcaagagagagacagcagggaggtgcgacacactttcaaatgaccagatcttatgagaactcagtcactattgtgaagacagtaccgagggggatggtgctgaactatttatgaggaatttgctcccatgatccaatcacttcccaccaggtcccacctccaacattggggattacaattcagcatgagatttgggtgatgacacacatccaaactgtagcagtggtttagccagtttggaaagaagtttgcaaggttgttttctggagacagagccacctaggctggagttcagtggcatagtctcggctcactgcaacgtctgcctcccgggttcaagtgattctcctacctcagtcccagtagctaggactacaggcacccgcaaccacatcaggctaatttttgtatttttagtagacacagggtttcacaatgttggccaggctggcctcaaactcatgacctcatgatccacctgccttggcctcccaaagtgctgggattacagaggtgagccaccacgcctggccacaattttcttttataaatttaaatatatacttactttatgacctatgcatgtcattctgaggtatttatccaagagaaatgaaaacacatgtttacacaaaaacaggcatatgaatggccatgtaagttttatttatagtagccccaaactggagagtacccaagtgtccatcaaccagtgaataaataaacccttctgcattcatacagtgaaatgaaactcagtaatagaaagaatgagcaatggaaacatcaaacagcacagatgaatctcaaaattatttcgctaaatgaaacaatctagacacagaagactagatactgtataatactatttatctcaaattctataagaatcaaaatttgagttactataaacagattggtgttgccaagaattgggaatgggagagtattcattgcaaagaagcatgagagagtcttcttgggagatgtaaatgctctatattttattgtggtagtgaattcacaaccatatatacttgacaaaattcaacaaagagcactgctatggtttaatgtgcccctccaatattcatgttaaaacttaatccctactgtggtggtattgaggtagggcctttggggaagtgatgaagtcatgaggattctggcctcatgaatggaattaatgactttaaaagatgcttcagagagcagtttggcccatgcatctcatcggcaatgtgaggacacaatgtttggacccttatcctttgtagaactcagcaacaagccaccatcttggaagcagagagcgagtcctcactcaacactgaatctgatagcaccttgatccaggtcttccctagtctgcagaactgtgagaaatgtatttccattatttataaattacccggtctgtagtattttgttctctttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgaagtattttgttcttgcagtaagaatgaactaaacagaaattagtagtgagaagtggaatgctgctgtaacaaaatgcctacaaatgtggaagcggcttgtcgtggtgaatactgagtgtcaacttgattggattgataatacttcaatacaactagatttttaaaaatacttgcatttttaggttgttgatgttgaaacaacatacaatttaattttaactttaaatacacataaattgatgtactgcatttatggaaattatagagaagatgaatttgtactgattataaatgagatgatctataacattacaaaattgttatttagtacataaaagcagttttaatgttcatcccatcatttcagcaatgtttgtctgaaactaaacattctgcataaattagcaagaaaactacaaagttgtactcatatgttgtataggtagcattttaattctactaaattcagccagaaattattgaaacaaaagtgttatctgaagcctcattcattttaatcattgaaacatactgaaattcatttaattgctgtcttgtattttacttaaaatgaataaagtaatgcaggaaacattttagcagcacatagtccagttttcacacaattgtcttgagaaaataactatcataattgagcaaacctaataaaaataggcagggtttattgtcagaaaaagtctaagtttgaatcccgaatttattcccatgtgatgtaagaagatttatcttaatgtattaaatcctagtttacaacatttaaaaagggggctgcaaggaatgcagacggcattgtgaagctggaagagacaggtaccagaatgtcccttggagcctgcaaaagaaaccaaccctttggacatcttgactctggtacagtgagatagtttaaaatttctgatctccagtcctccagacttactggcatattatttttcaattgcttctgtaacaaataccacaaatattgatgtaaaacagcacagatttattatctgagagtctagaggccagaaatttaaaatcagttgcaatttacagcaggtaggtgtccatagggctggtttctcctggaggcttcaggaaagaatctagtacctgtttatccagcttcatgaggccacctgcacttcttggtgcccttgtttctaccttcaaagccagcagtacagcatagtcaaatttctttctctctcattctgaatttcctgcttctctcttatcagaaacattgtgattacactgggcccagtgggataatccagaataatctcttcattaccaaatcctcaatttaatcagatttgcaaattttgttttgccatgtaaggtagcatattcccgtgtctgggaattaggacaggaacattttggaggtgcagtctcagcctaccaaccaccctgaattgtgctatcagttgagctttctgtggtgactaccaaagacaagggccttgacctcacgaacttcacagtagggcaggaattttaataaatcctagcaaggtgatgtaggacaataaataatgtatggcaagtggtagacacaaaacccttacctagttagtaatatttaaagaaagaaaatgagaaatgcaatgctttgcatagtccacattaaaaagtaatattaatttaaaaatggaaagtaattaaaaatgtttctgtaaaacttatatggagagatgagaacaatagcagagaatgccattccagtagtaatttttataattttttctggttaagattaaagcaggaatgtgtttatgtacaataaaattaaggaaatatatgtagcagatttttttgaatacgttttattggcagaatctattatttacccaaacattggtatgtaaaagatagatctacaatttggaggataagcccatgagcctgagagagcctactcaaaatggttgggaaccagcactcagcatgagttgggccacagtataagctttctggggtactgctcttttaagagcaaagtagtttgtgatgttctgggtgaagaacatggaagaaaatgttaaggcccaatgaaacatcaattagctgacaaatacatgtaatcaggggtgtcatggtgacggtgctaacaagaggaaaacaagagtctccaggagtgccactgccgtattcaacatttcagttaagtcatgatttgaacagctttgctgttaacattgaacaaagtgattttctttaccagagattttttttgacagaaatctgtgttttcagccaatttattcaaatatatagagataattgcacctgtactttttaagatatcttgtgatttcttaagagtaaactccaaaaaaattttattgcattgaagggtcatcgttttaatgagctttcaaattattctgacactttttttttctttttaacaaattaagaattttacaagtatcttggaaaatttgatgatacatacattttattctgctttccagttggtttttgtgtgttatgaagcctggataaattgtcctaagatatttagtagccctagaaagaatttgagttttttttatctacaacttattatattgaaaatttcagacatatagaaacatttaagtgaatagcttgtgtccatgaatgctttacctaccacagttatttatattttgtcgtatttatttaaccttttgagatattatttaagataatcttctgaggtattttgagataatcgtatttttctttggcaaacgattggagaaaaagtaagttgtagacataatgacatttcacctcttaatactttagcaataattttctaagaactaggatattctctctgatgtagccataatacaattatcacattcaaggaatttaatgttaataacatattcatgtttgttcaactttctttctttttttttttttgagacagagtctcgctcagtcacccaggctggagtgcagtggctggatctccgcttactgcaagctccacctcctgggttcacgccattctcctgcctcagcctcccaagtagctgggactacaggtgccctccaccacgcccggctaattttttttgtatttttttagtagagacggggtttcaccgtgttagccaggatagtctcgatctcctgacctcgtgatccgctgtccttggcctcctaaagtgctgggattacaggcgtaagccaccgcgcccggcctgttcaactttataataaaatattttatagtatttttgatactgaattcacttaaagagtaaacgctatcgttaatttttacatttatttaactttctttaatttagaataattatctaggcttattttgttcattgcattgataatttggaagtaccgaggtcactcgctgcacaactggatttttctctcctcattattcaattcatacagtgtgagtttgtgccatcattagcgatgttaagtcggatcccttggttttcttcattgttaaaagtgtcattttctctttgtaatgactaagtcatctataggatgatattttgagattgtgattatcttgtttgccaacaacatttttactcaatggtttagtatccattgctgattcttccctcattaatcattacttggatatttggcatttatcatgctgcatctttctgaaaaaagagagagctttactgtttctcttttttatagtttttattataattatggattcatgaattttttaaaaaatgcattgtaacccacactgtcatgacttctttagatcctggaattttctcatattttgtgagcgggtacccctgtacagtggttcttgcgttttctgaaatgcctgcgttagtttttgagtgctttcttttttcccagcaaaacagaatctttcagatgcatcagtgattgttactgccttacatctggaacctgttatttctccaaggaacccttcttgcttttattggggaatgatattacagcccaacatctaggcactaggtgtgctcacttgtactgggatatcagtgcctctatgtcatttcagtcaactgagctagaaaaaaatactaaaaattgttaagttcacactgataccgtcttggtcaatttaacaacacaggattatttatctcctcttttcaacatttatatgatatttctcccacaataatctctctacttccccaaatgacagtatgttcattagtcaacattataatataaacaatacatacaaaatcgtttgaatttagtaaactaatgtcactaaaacaattttaaatttagttcaaggagttttttttttttttacaattagaatgtttctaactgatatcattttgtaagatcactgtgtaaaaattaattttttctttgttgttctcttttcaattttatgtacaattagatttttatttttatggttatatttaattgtattcctcctattcttaatttaattttgttttatgaatatgtaaaacaacaaaatcaaaatcaaaaccatagtaaaacatatccttataaaggttttacttcactttttagaattagattgtgaatctatttcgggtcacttcattatgatgtaaagtaaggattaaaattcacctattatcaattagctatccttttgttcaagtaccatttattgaaaaatccaactttttttgattgattgcaaactattcatatacatgttcatgtgacacttttctgaattggtccatatctgtatactactagtacaaacatgcttagtttattttaacagatgagtaaaaccaatgtaaatttattgacataactgatatctttaatctgaaactagtctttgtctctatatatatttaaatatatatgtataaatgtacaaatattctcctttgatttctccatattatacttttaaaaatgtttctatattgttttggtattcagaaaggtttcatgttttttattctaatgcttacctttatattaagaccttatataatactgtaagtcccagttattattaactagttttctactctatggatttctgttttatcagatattctttgacacaaacctattagctatggtgtagtcagtgaggttatcttactatacaatttttctaaattttctgctcatatcttgtatttcttttcagcttgagcatacaatatttgttattattccactttatctccactttgttttaatcttatatctgctaataaatacatgaattgcttactgttagtctttttgctaaaattttccccactaacattggggtgtcaaagtttgttctctaggaaattttttaaaaaaaacggtttcagaatatggcatttatggagttactgcatatataaaactcatttgctaagaccttggtgcttgaagtacagctttgtctaatacatagttcttggcttacccttttcatgttttaatttcttgcaaatctgcctcatttcattcttgcaaaaagtctgataccaagttgatttttattttctcctcctctaatttcatttttcttggtggggtgataaatgacttagcatctttttcctggtggacctgacagtttttgtttgcttgtttgttgttagctttaaagtctgatcattttattagggtaggatatatcactgagatgaccatttaagattaatttccctagatatactaagaacgcattctatatggaggttcaagtcttaatttatttgcataaagctttcttagacagttttaaatatatgtcctattccattattttgtttttaatggactctatgcatattacatagcatatattcttaacttgcatatcgatcaataaatcttttcacttctttgtttcacatttttttaacctcgttatttccttctcattgtctcaactgttgactttcttcactgacccccataatttagtcattatttctaagattatttggagttatttaaaatttcttaatttattatagacagttgttaatttatatcatcttatttcttctattatcagtttttgacaccgtaacgcaaggcgttctatagtatgcaaattatttgaggagtttttttgttacaattttcttctgcttcatgcggaagacttttaccagctgaaatgttatttatcattttctgttttttctcgcaatgcatttgtacgaatgattttcatcaataaaagtgatgtgcggttatggtgaggatttgggttagtttatttcccaggttatgcctgaacaacaaactctgaagtagtttcacctgcagaatatttattaaggggcactcaagattaacatctgggaagtagtgaaagaaagccgtagtgggtggcagagagagaaagagatatgtaattcaggctcaaggacagctttggctgtccccatggggagatttggagctagaatggcctttcagagttgcccgaagttgaaggaaatggccaggtctttatactcttgcttcaaaatgtcttggatgggagccactgggaaagaagtgtgacctttcatgaggaatctctctgcctctggacactcccgagaagctgacacttgaatccatctgccaataacattgatatagccaagtataattttgttgaactgattatgctcactggagaagggtgaagtgttttagtatgtctatggctcagcattctttattgtttttcataagagattcgactttgtccatctgcctttttttccatttaccaccacgtctccaaagagcaactcacgttacaacttacattcatcccctgaagcacgtcttcctcctatgaactcatgaatttcaagtttctttctttgaattcccccagaagctagttattttggcttggattctccagaaaatatatatatgcacacacacgcgagcacgcccgcatacacgtattcccaaggaaattggcaaggaagtttagaaagcaggacgggaataaaaaggaagccaagcaaacttgtgataactggcaaagtcccatgatactcagaaacgtcctcatcatcagcggcagggctgggctggcacactccacagtcttcaattcttggtgaagggccacctgtagttctgtgtgcccgcaagcaaagagggatccagaagtctgagagagtctctggcaaagcatctataaagatgttggctgttggatggagtgagataggggtaggagcacataaaaatgccatcagaaggaagctaagaggatctgggaggagtgctgccattatccaatgacattattcactaagctcagccaagtctgagaactgttctcagattttctgtactcattctgggattttcaatgttttggggtgactgtgttttttctctcgaaggtgtctctccctttttgtgttttctacaaagtgccttagtccattttctgttgcttgtaacagaatatcaaaaacagggcaatttatgaagaaaagaagtttatttcttacagttatggaagcagagaaatacaagagtgagaggaagcatctggtgagagcattcttgctggggaaaactgtcttcagagtcctggagcagcacaggacatcccgtggccaggggtctgagcatctcatgtgtcagctcaggtctccttttgtcttcttataaagccactagtttcactccagtaataacccattaattcactaacccattaatccatgaatgaattaatctattcatgagggcagagccctcatgacccaatcacctcttaaaggccccacctctcaattctgctatattggggattgaatttcaacatgaattttggaagggacattcaaaccatgccaggtttgaatgaactcctacaacggctctgctggattagtgtgtttgatccttatttacacattattagaagtttgaatcttctctgtctcttagctgtggtatttaccttgattaaatatgcctttttgttttgctttgttttgttaggtgagtgaatttataaaagataatccgtataagtgtttggagtttgaaaggaaagacgtggatttaggctattatcagtattttagaagatttggggaattgttttcttagtgtcttcatataatagttattatttcttacataaatttactgctttatgtaatatgcaaacatttaaaattcattattttcttcaatacacatgagcaaatttttatatttttattaatcctacatttttgaaataaggaacttgtggatcaataagcttaaattatttgctctaggaagtatgagtgaaactcaataattcaggatttattacctaaggggttatagtaatctaccactgagttaaaacctatgtaggcaaactcatatgtcatgaatctagaagtttagcattcttattaatggctctagtttaagcaaacatgtgaaaacctccagttagtttgaaacggacatcaataaattcatcaattcaagcatttattgaattttttattaattatagttttttatatttctaaatttctcaaggatttttctagccttacatacttccaaagttttactaaaaatactgctatatatttagcttaattttgaaacatcattggagctctggttacatcatttcttcctacatggtccttggatttacccttgtaagaataccttagggccaagtgtggtagctcatgccttttaatctcagcactttgtaaggtagaggtgggagaatcacttgaggccagaagttcaggactagtctgggcaacatagtgagaccccatctctaaaaaaaaaaaaaaaaaaaaaaattagctgggtgtggtcacgcacacctgtggtctctcaggcggctgaggcaggaggatcacttgagcctgggaggtcaaggctgcagtgagctgtgatcatgagactgcactcccacctgggcaatagagaaagaccctatcttgaatatatattagtttcatgaagtatttataagattatttcgcttaaatagaatccattatgtaaccagtctttgaaattgttagcattaataatcaaactcgatatgttattatatttttgtatcatatgttcttatgatttttccagtaaccaaaagattttagtcctcccaataaatccattattttaatgcagccaacatttttcttattgtagacaaaaattgaactcagctttaaatataatcttagctctattgaagttggcagatcctctgctggtttctaaaatttaaaggccacattttgggggggggttaagttttctgctatagatttcaatagggtgggttttataaaaatgtaggacaaagcaataattatcttgttatattcattttccctttccattgagtcttctctcaggtattataattcctaccacagttttctgggattgcttcatttcacagatccttgatgaatccctgctaaactgtcaggtgctaaccaccaataaagacttaagttatgctctctccgaagtatgtgcaaaataggcaaatcctaatgactgaaaattttgaaagctcaaagacctaaatcatcattatgaagactccacgctagtaaaacttttcttatgaaatgatgaatgcaaaaggagtgtttttatagtaccattgtactatcaaaagtgtgaatgtctgcagagcagagacactgagttacatttttgcataaacctgggactaatacaagccggactgggttgttgaataatttattggataaataacttcattaatacatccagattctttattgagtgagccctgtcttccaatatttcacgggaaactgatttttcttctgttttaatcagtttcaataatattaatgagatctaaaatctgccaatatttcaagtggagttaaacataaattaatagtaatgactccattttcattttattcatttattaatgatcctttcaatcacatttttgaaaggattttttctctaataccatatggcttaaacatctgcaattaaccattttattatatcaaatgcacagtgtgaagtgaatatactaaccaaatctaaatgcaactattcaggggggaaatgtattatttacaaatgttttaagcaaatttcctcgaatattatgcaaagtattctgttcaattcaaaaaccttcagttctctttgactttttaaatatgtattgatattttcaagattctagaaatatggtttagttttccatctcaaatctccatatatctgaaagaaaattaattttatttgttgggtatacatatagctgtttcaacaaatatattttcatttatttaagaaaattaaattcaatggaataatcttatttaatttttagtcttctggattgatttcaatttcatccattatttattcctaagtcttggtccttctgcttctgtggcaataacattaaaattctttaaaatattaaatagcaatctaagctattatgaggaattcagcatattgcataagagacagttcctagaattagatcattctgccatcaacaatcatcgccaggtgaacattgggataaatcaagtgacagagatccaaagcttatgctgtaagtctattgttcttgaacatctgatgtctgtgtacattcgaatcacctggagtgcttttcttttttttttttttctcatcatccaaatgtattttattttattttattttattttatttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttcaaaagtacttttcacagatgacagcctcaactccagagcttctgacttggtaggttttggttggaactcaaagctttatatttatagtatgtttccaggtgttgctgctgacgccaccagtccagggaccacaccatgggtaaaaactctaaatccaggtgctctaaataagcccccttttcacctttgcagtaattatttgaagggggcaaagggagactttggaactctgtgctcctggcaagtgtccactgcacactcttcaccagtcagtcatatgcttactatctcgtctgccacagagagaccacgaagattagtcacatgagtgtcacaatgataaggatggctcaggactccaggtcacctgttatttcttgcattccagttcccctgcacctctacgctttcctgtttcactttccttattctatctttccctaatttctgaaacctttcaaatgcatcccccggaaccgaactttgaacatcagaaaagtaccctcggttctcaagggctccacttttactttttgctttaactaaaattgggcttttcgctgaagccattggtttctctgtagtgccttcaagtaatatctgttttttctcccatacctcccactatgtggcctggaggtggaatagctaccttagtttctcttcattgccatttccaaattattttgccctcctttttccttaattccatttccacttgtttatgacactgacattacattttgtatatggaaaacatttgatgtggcttttctgttgagccagcgtaagaatcaggatgtgaaggactatgtaaaaacttaaaaaaatagatcattataacctgtgtcacatccagagtacttcatacgaagtgtgtttgcatgtgagcacacacacccctctctgggtatgggtatatgcctgtgtgtgtacatatgggtggacatggtgacagtgattatttatctccagtgacacagaacattatccacaaagtttcttgccacccagtttttctttccacaatgccaaatcaatagcccagttttacttgtttatttatcgtgaagttgaaatatctgtgtatctgcacgtttcctattcagttccggatacctagtcactattgtcagtggagaccttttatgtttatacactgctttaccatttagcgtaatgctcagcagattaggcccactataaacatataataattgaataaatacacttccaaaaattctaaaatgttgaaaagttaagataaagccagaagaattttgtaacttttcatagcatactttacatacgtgctttcatttcacctaaatgttttcatttgaaaactaaaattttaaaaatattttttaatttaattttacaaatccatgaagttattgaaagatgtttaagatacctggaatgtaggatcaactttttgggactttcggctattaatctcattcgatatatacttgataccattttcagaataaaaccaatcaggcaaatggaagatatgtgttattctatgtggaatttacaatattcttataattccaagggatatgtaaaccaaattgtttaagctctgtatttattggcagatatttatatctcattgcttccggaaaaatgtttttgcattctctaggaaatacctcatatagcatattaaagtaccatatttaaatatactctcaaatttataggatttttcttaccaatcatgtataattattttcatacatttttcaattaatgggtaatagatttgttcctataattatgcctatctcatggcaatagctgtttgatctgtattctgttttgcaggtgttttattgacaaacactttaaaatagcttcatcaaatataaattacagtgattaatttaatgcagcatccagagtgaaataggaattagcatttacattaaaaaaaattgttgtaattgaacacaaggacaaagtggtttccttggcaacaagagatagtaaaaatttatttgtgaatttaaaattatattacctcataatttgatgcacattctcattgttttagttttattatagggaaattcttttgtaataaacaaaatagataaaataactctgtctttataaaagaaaaaatgttaaatttacccagatccagagaccacaaaagaaatgttgttaagcacaataggcttggttcaatttaaataaaaacagtcataaaaatattaactgactatttttgaaagcactcaacagttttatatgaataagtatgtaatcaaatgaacctgagattaagattatttaaatttgttggtctccagacacatgctagatggaggttctttcaccaaagaaaaaataagacaatgaactttaattattttgattatcagttatcattattaactttcattggaaaataatattactggcagcgtgcggtggctcacgcctgtaatcctaacactttgggaggccgaagcgggcggatcacgaggtcaggagattgagaccattctggctaacacggtgaaaccccgtctctactaaaaaatacaaaaaaaaaaattagccgggagtggtggtgggcgcctgtagtcccagctactcgggaggctgaggcaggaaaatggcatgaacccgggaggcagaggttgcagtgagccgagatcacgccactggttgtagtgagccaagatcgcgccacgctgcactccagcctgggcgacagagcgagactccgtctcagaaaaaaaaaaaaaaaaaaaattgcaaaatagaactactgtatctgtgaattagtcaaatttcctcagaaaaacagaaccagtaggatacatatactttaaaagatttattttaaggaattggctcacaggattgtgtggactggcaagtccaaaaatctgtagggcaaactggcaggttggagattcaattaagaattggtgttgtagtcttgagtctgaagactgggaactcaggcagaatttccacgtttcagtctagaggcagaatttattcttcctggagaagcctcagtcgttatttttgaggccttttctgattgaatgcagcccactgacattatggagggtcatctactttacttagagtaaactgattgtaaatgttaattacatctaaaaaaaataaaatattttcacagcaacatccatctagatacgtgtcaaacaagtaaatactcaccaaaatctagtcaagttcatacattaaattaatcatcacattaataataaggatttcaatttcaagtaactgaagcacaaactcaaagtgacttgaatagaagggatacttactatctctcataaaagtgaatccaacatgaccccggtattggtataaccagattctttctttcctccaaggcttggattttttttgacttcatcttcagacttatgacaagatagctaaagcattttgaggcttcacaatccagaagcagaagaaaaagactgtttttttgttctttgtttttcctatatctctttcttaggattaagaaatactttccactatcagacttcctcccacatctcaatggccagaatcaggtcacatgctgatttctgctcaacactgtcaagaagaatgacaaaactctgcatggcttagactgatcatctgatgagtaataggtattttggagtcatccacaatgtcttccataatcaattatattttaatttacaccttcatactttttggtggtacacctatttgcagctcttgctgttgatctaaaataaatgctgataactcatagacacgagttgcaaatcttggactttcttctgtctgctaagcatttttacctgaatctaacatactttctgaaattcaacattttgaaataagctcttagtcttcctctttaatctagtatgactttttgttagtgggtaggatcactatcctctcagttacttgacagagaaagtttagagtcaacccagacaacatatattctcacacacctatacctaaccatttactaaatctagttgattttgccccaaactattgagtcagtcttctcctctctattcccattactgctttcctggtctagaccatttcattctaaatgctgaagaggcatggtattttcaaatgcctcccacctctgaggcatatatatatatatatatatgtgtatatatatatgtgtatatgtgtatatatatatgtgtatatatatgtgtatatatgtgtatatatatatatataacaagaggctgtaaataatatatacacacatatataatgtatataaacataaaatgcatgtacacacaaatatgtgcatgtgtgtattttatgtgtatatataacatgtgtgtatacatatattctttgcagcctcttatctcattactgactctcatataaaatagtgcttgaaacatataaactactactactaattccttaagcgtaatttgtgtcagctctggcttcttcttatgttaagtttcagcttacatgaaaattcccttctctggaattgtcaatgttcttattagtaaattttatttacacaatccaaatagataatagataagcttcaggtcacttgctaaatcttcctagattctttgccttgctcctcagagaataaagaactactatttctctttgttatctgtacatttctacttcatctagtaggctgtggcaaacctgagggcagaaacgaacattcaactttgcatctcagaggctaacatagcgtctgccacatgcatatgttttattgtatcgtaacttttacttaaggttcaggggtacatgtgcaggtttcttatataggtaaactgcatgtcatgggggtttggtgtacagattatttcatcccccaagtaataagcgtagtaccccatagatatattttttctgatcctctcccttcatccctctactcttgaggatgccctggtgtctgtccctcccctctttgtgtccatgtgttcttgttgtttagctcccaactcttaagtataatttagaacatgcagtattgagttttctgttcctgcattagtttgcttaggattgtggcctccagttccatccatgttgccccaaagaacttgatctcattcttattttatagctgtgtagtattccaaatgtggaatatgtaccacatttctttacccagtccactctgtgtatatgtagcacattttctttatccaatatactctgatgggtatttagattgactccatatctttgctattgtgaataatgcttctatgaacatagcatgcatgtgtctttatggtagaataatttatattattttggatatacacccaataatagaatcactgggttgaatggtagttctgtttcgagttctttgaggaatgattacacttctttccaaaatgaatgaacggatttacagtcccaccagcagtgtataagcatttctttttctccacaacctcaccagcatctgttatttcttgccattttaataacagccattctgactggtgtgagatgatatctcattgtggtttttgacttggatttctctattgattagtaatgttgagcttttatcatatgcttgttggccacatgtatgtcctcttctgagaagtgtctgttcacgtgctttaacccacattttaatgctttttttttcttgttaatttgtttaagttccctataggttcaggatattagacctttgtttgatgcacagtttgaaaatattttctccaattgtgtatgatgtctgttttctctgttgatagtttcttttgctatgtaggagctctttagcttagttaggtcccatgtcaatttttgcttttgttgcaattgtttttggcatcttcatcaagaaatctttgtcagatcttatgtccagaatggtatttcctaggttatcttccagggtcttcatggttttaggtttcaaatttaagtctttaattcatcttgagttgatttttgtatgtggtgtaaggtggggggtccagtttcaatcttctgcctgtgacttaacagttctcccagcaccacttattcaatagggattcctttctccattgcttgttttcacaggcttttttgaagatcagatggttgtaggtgtgcacccttatttctggattccctattctgttcctttggtctatgtttctatttttataccactaccatgctgtttgggttactatagccttgtaatattctttgaagtcaggtaacaagatgcctccagctttgttctttttgcttaggattgccttggctatatgaacttttttggttccatatgaatttttaaatagttttttctaattctttgaagaatgtctttgattttttgatagggatagcattgaatctgtaaattgctttaagtagtatggccattttaatgacattgatgcttcctatccatgaggagggaatactttttcatttgtttgtgtaatctctgatttatttgagcaatgtttggtaatcatcattgtagaaacctttcacctccctggttagctgtattcctggttattttattctttttgtggcaattgtgaatgggattgcattgctgatttggctctcagcttggatattgttgctgtataggaatgctactaatttttgttgttgattttgcatcctgaaactttgctaaagctgtttatcagctaaaagagcttttgggcagagaccatgggattttctagatatagaattatgtcatctgcaaacaggtatcctttgacttcctctctttctatttaaatgtcttttattcatttctcttatctgattgctgtggccaggacttccagttatatgttgaataagcggtgatagaactcttccttgttttgctcctgttttaaaggggaatgcgtccagcttttgcccattgaatataatgttggctgtgggtttttgatagatggctcttattattttgaagtaagttccttcaatgcctaaacatgaagtaatgttgaattttatcaaaagccttttctgcatctgttgagatgattatgtggttttcatttttagttctgtttatatgatgagtcatacttattgatttgcatatgttaaaccaaccttacttcctaggaataaagcctacttgattgtggaggattagctttttgatgtgctgctggatttggtttgcttgtattttgttgagtatttttgcatcaatgttcatcaaggatattggcctgaagttttcttttgttgttgtgtctctccaggcttttggtatcaggatgattttgacctcatagaatgagttggggaatagtttctcccttccttccttccttccttccttctttcctccctccccgactcccttccttccttcttttttttttgacagagtcttgctttgtcgcccaagctggagtgcagtgggatgatctcggctcactgcaacctctgcctcccgggttcaagcaattctcctgcctcagcctcctgagtagctgggactacaggcatgtgccaccatgcctggctaatttttgtatttttagtagagatgggggtttcatcatattggccaggctggtctcaaactcctgacctcatgatctgcctgcctcagcctcccaaagtgctgggattacaggcatgagccaccgcgcccggcctagtttcattttttgggaatagtttcagcaggaatggtatcagttcttctttataaatctggtagaatttgactgcgaatttgtctggtcctaggcttttgttttgttggtaggctttttattactaattcaattatgaaacttgttactggtctgatcagagattcaatttatttctgttttagccttgggaggttgtatgtgtccaggagtgtatccacttattctagattttctggtttgtatgcacagaagtgctcatagtagtttctgagggttattttttctatttctgttgaggtcagtggtaatgtctccatgtcatttatagttgtgtttctttatatgatgtctctttttttctttattagtacacctagtggtctatcttgttaatttttttcaaataatcaactcacagattagataatcttttgtatttttttgtgtctcaatttcctgcagttcatctctgattttggttatttcttatcttctgataactttgaggttggtttcttcttgtttccatggttcctctagttgtgatgttaacttgaaatttttctctctttttgatgtgagtatttagtgctataaatttctctctcaacactgccttagctgtatcccagagatgctggtatgttgtatctttgttctcattagtttcaaaaaactttttgatttctgccttaatttattatctacccaatagtaattcagaggcaggttgtttaatttccatgttattgtatggttttgagtgactttcttagtattgatttctatgtttcttgcactgtggtttaagagtatggttggtatgatttcatctttttaaaaaaatttgctgaggattgttttatgcctggttgtgtgtttgattttagagtatgtgtcacgtggtgatgagaagactgtgtattctgttctatttgggtggagaattttgtagatgtctattaggtccagttggttcagggttgagttcaggtcctaaagatctatgttaatttgctgcatcaatggtctgatactgccagtggggtgttaaagtctccctttattattgtttgggaatctaagtctcttcttcataggtctctaagaacttgcttcatgaatcagggtattcctgtgttaaatgtgtatatatttaggaagttaggtcttgttgcattgaaccctttatcattatgtaatacccttctttgtcttctttgatctttgctggcataaaatctattttgtctgaatttagaatatcaatccctgaattttactgttttccattttcttggtagatttttctcgatccttttattttaagactatgtatgtcattgcgtgtgagatgggtctcttgcagagagcatagcattgggtagcacttgtttatccagtttgtcactgtgtttttattagggtgcttagcctgtttccattcaagattagtgttgacagatgcagatttgatcctgtaatgatattactgggttatcatgcagacttgtttgtatggttgctttatattattactggtctgtgttcttaagtatgtttttgaagtggtctttcctttcatatttagtactcctttgaagacctcttgtaaggcaggtctggtggtaatgaatttccttagcatttgcttgtgtgaaaagaatgttatttctccttcacttatgaagcttagtttggctggatataaaatgcttggttagaaattattttctttaagaatgttgaatatgggtccctagtctcttctggtttgcagggtttctgctgagagatttgctattagccagatgggattcctgttgtagataatctgacccttctctctagctgctttaacatttttaatttcatttcaaccttggagaatctgataattatgtgtcttggggatggtcttcttctgtagtatctcacaaggattctctgcattttctgaatttaaatgttggcctctctagtgaggttgagaaagttttcatggatgatatccagaaatatgttttccaagttgctttctttctccttgactccttcagggatgtcaatgagttgtacatgtggtctctttatgtaatcccatatttccagggggttttgttcattccatttaattctttttctttatttttttctgactgatttatttcagagagccagtctttgagctctgaaacattttactcagcttggtctatttgctgttcatacttccaattttgcttataaaactcttgcagtgtgtttttcagctctgtcagatcagttttttttataatagctattttgtccatcagctcctgtatgattttattgtactccttagattccttggattaggtattgacactctcctggatcctgatgtttttctttattattcattttctgaattcttttttctgtcatttcagcccaattaacaaccctttctgagggactagtgcagttgattggagaaaaaaagctgctctggctttttgagttgccaaagttcttgtacttgttctttctcatctgtgtggactggcattcctttaactgtagcataatttgagtacagtcagtagacctcttttctggatgttttcagaggaacaaggctttgtgctgggtcattatttgcagctgaattcttattctggatttcccggtggtcaggtggtatatttgcaaagtgtttttgatgttgacgttttggtctgtgatgcagtacatggtacttaagcataatggccagtaggcaagtagtatcttactcagccactttgctcctctgtatttctgatcgttgcagccaagctcccacttagtgctccatgttctgagagtgtgggctcctctcccactcaagggctggctgtagatttcatcttggcactcccaggctgtacactgaggctctggggtgagctcaggctttatgttccctccccagtttggaggcagcaggggaagggaccttagcaatggttgtggcagagagtctttcacttgtctcttgtagtccttgtagtccacaatgtgcttgtaccgtagacttttaaagtcatttcagagtagccatttagtatctctccaaggttttactattgcaaacaacaacatagggaatgtggctgtacaggtctctgtgcacattgcaagtagttgctttggatatatgcctagaagatttgctaaatcaaatgacacatatactcaacttttgctagagatgtgacattgccaaccagaagaaattcagtatcaacttaagccttttgccaacaatgtatgaaattatgcactttccatcaccatgttccataatgaattttatcacattaaaaaattttgaaagaaaaatgatgaaagaaaattatataccatattttcttgaaatgcacactttctttataaatactgaggttgaatatctttttatacacgtattggccataaacacatcttgtgtatttaatctgtaaatttgttttcatattccttgcttgttgtttttacttatcattaattaattacttaaaattttaggcaattaaaataccaaaaaagaggtaaaaatcaacccaaatcccacaaggaaagataaaatgattttcatcttgattttaaatgtcatttttatgcaattgcataaattaaaaaggatcttattatgcatgtaatttttcaagagccttttattttattcaaatgtaagatgtggtcctttattatatgaattaccatataaattcaactattttaaaatggtaaactattcaccctttgtatggatgtacttaatttctttaacgaatgtcctatggatgaacatttcaaatgtcgacatttatttgataatatgggcagcatttcattgacaatccttaagtgtgtgtgtatttgtgtgtatacaagcacacacacacaccctttctacattatcatcttaggatatgttcactgaccagaagcagctgaagcaaatgatatgcacatttttaaatcggcatatattatagaactgccttttataaagcttgcaaaaattttcaaattactacagaactggttttcacgtcgaaataaaaaatttccaaactacagagttactttttctcattcaatgatcagttacaaagctaaagtatttcattattgcttttgcttgaactgatttgttaatgtagttaatatatgttgaatatttattggacaattgagttatatttatttctttatgagttatttattcatgttctttggctacatttctctttagaattgatctttttaatacatatttatgagagtgcttaaaattttaccagtgataagactggatagatatttctcagtttatcatttttaaaacatatttgcaccatatagaatttggaatatttacatattttcatctagagtagcattactaataggtccaattagtattttcattacttggacaactaatttttctggctcagcattttaaaattaaatagcaattatttgttgctatatttccagattaattacatctataggtcttgcactagtacactattatttaattaaatttattgtaatgcattttgagaactgggtaaaaacctttattagtgtttcagacttatttttattagtctatattttatctctacttttgtcttcttatattagtctttattagccatattatttaatgaaatttattaaaatgtattttgataaatggataaatatctccctatattagtcattgttttagaaatttgaggctattttatatattttgctttcaaagatgaatgttaaaatcatttatgattgaaaaatggacaaaggatctgaacagacatttctgaaaagaagacaggcaaatggccaatacatatatgaaaaaatgctcaacatcactaatcatcagggagctgcaagtcaaagccacaattgagtatcatctcactccagttaggatggttattatgagaagcaaaaaatattatcagaagcaaatggtagtgagaatacggagaaaagggaactcatatgctttcagtgggaatgtaaagtagtatgggcactttggagaacagtatggacattcctcagaaaactacagatagaattaccatatgggtccagcaatcccactcctgggcattcatccaaaggaaaggaaattagtgcatctaagaggcatctgcacccccatgtttattggagcactattcacagtagccaagatatggaaatgaacctaggtatccaacagcagatgagtgggtaaagaaaatgtggtatatgtacacaatggagtactgttcagccataaaaagtaatgaaatcctgtcatttgtggcaacatggatggaactggaggatgttatgttaagtgaaataagccaggaacagaaagttaaacactacatgttctcactcagatgtgaaagctcaaacaagttgatctcatagaagtgaaaagtacagcagaggatacgaggggctgggaagggtagggggaagggagaggatagggggagatttgttaaaggatacaaaattacaacgagatggaaggaataagttccagtgttctataccactgttggatgagtacagttaacaataatttattgttttaaatagctagaaggaggatatttaatgttcctaacacaaacaaatgacaaatggttgagatggtggatatgctaattatcctgatctaatcactatacactatatgtatggaagcatcaccatgtaccctacaaatatgtacaattattatgtgtcaatttaaaaaaataaaattaaaaaaacgtatttgtaaagtaatcaagcaaatctaaaactcatgaaagcattttaatgtagaaaagtattattgggccaggggtgatgtaatcctagcactttgggaggcaggcagatcacatgagatcaggagtttcagatgagcctggccaacatggcaaaaccccatctctaccaaaaatacaaaaaaattaggtgggcgtggtggtgggcacctgtaatcccagctacttgagaggctgaggcatgagaattgcttgaacctgggaggcagaggttgcagtgagccacgattgtgccactgcactccagcctggttgacaaagtgagactgtctcaaaacaacaacaacaaaaatattattaacaaattcaatgaaatctcaatgaaactacaacagattttctggatagaaatccacaaacaaattcaaaacttatgtgaaaatgcaaagtacctggaagagcagaaacgattttgtaaaaaaaacaaaacaggaaggcttatgcttcattaacttgtcttaataatgctaagacttgttataaaacaaaatcattgtggcattagtgtaaaatagacaagtagagcgatagacagaatatattgtctagattggttcatgcctatatggtaaactgatttttgacaaaagtgcaaagataattctatggtgaaaatgtaatattttcaataaatgattttatttattaataaatgtttattaaaataaaatacagggatgctggatcatccactgaatatcctttaggaaaaaaataaaattttacccttacttcacagcatgcacaaaaattaacttttaatgtgtcttatgatgatccttggacatacacttagaagcataaaactttccaaagattatatttgcaaatttagggtggccaaagatttcttgacaaaacataaaaagctcaagcagaaaaaaaaaaatgataagttaaacttgatcacaattagaaacttctgtttttcaagagctactgttaagaaagcaaacagggggccgggtgcggtggctcaagcctgtaatcccagcactttgggaggccgaggcgggcagatcacgaggtcaggagatcgagaccatcttggctaacacgctgaaaccctgtctctactaaaaatacaaaaaattagccggcgtggtggtgggcgcctgtagtcccagctacttgggaggctgaggcaggagaatggcgtgaacctgggaggtggagcttgcagtgagccgagatcgtgccagtgcactccagcctgggcgacagagcgagactccatctcaaaaaaaaaaaaaaaaaaaaaaggcaaacagggaagccctagacttggagacaatatttgttacacatgtatctgaccaagggtttgtatccataatacataaataattattttttaaaataaagaattcttaccagtcaggaagtgaaattttaaaaattgggtaaaatatctgaacagaaatttcacaaaacgagatatagaagttgccaataagcacttattattctccaggaaaatgaaaattaacataatgaaataatactgcacagtgattagaatgattaaaatgaaaatgactggtgaaatgttgtgattggtagatcttagatgacccctaagtgttctcacattttcacgtaaatgctcttgcgtaaactcctactcttgaataacttccttctaatcaatagaatacggcaatggggaagcaatacaactttcaagttgtgaggagaagggcttataccattgtagtctttgtattagttgcctagggctgccataacaaatgatcacaaactaggtcatttgaaataacaggaatgtatgttctcacggttctggaggcgagaagcctaaaatcccagtgtcgcagggccccgcaccccctgaaggccctaggggagaaaccttccttgcctctcccagcttcggtggttgctggtcactcttgatgccccctggcttacagcagcatcatccaatcctggtgtctgccatcatatgatgttcccccttttggggatgtgtatatggctaaattttcctctacttataagaacaccattttttgaatttagagtctactctaattcagtgtgacctcatcttaactgacaacaaagaccctgccaggaccctatttgtgagtaaagatccaactcacaggttccagttgaatgtgaattttgctaggattctattcagcctgttagaatctcctttcaataaacctatgatcccagtttaataatgagaaaaacatcaggcaaactaaaactgagggacattccacaaaatatgtcaccagtactcctccaaactgctaaaattgtgaaaaacaagacaaaataaataaataaataaataaaaataaaaaataaaaaagctgtcacagttcagaggaaggaaagaaaacataatgactaaatatagtatggtaacctggttcgaatcctggtacagagaaaaaggatattagtggggaaattgacagactctcaataaaccctggagtttagctgatagtaagtttttaaagtgtttgatagggagccgcagtggctcaggcctgttgtcttgggacataaggaggagaggctaggcgtttgaggccagcctgggcaatatagaaacctctcatctatataaccaaaagtttttgataaatatattatgggtatggtgagggttatatgggaacaatcttattctttcttttaaacacatctaaaatgattccaaaagaaatgacttatttttttaaatgcaagctataggatagacttgagaaatttaatttagattggacagtttcagacagcttttttgtgagaagtttgagctgcaaatagaaatacaaatccagccaatcctaccagtagtgggggatgaagtctcctgggcagaacacatggccagtgaacaggtactgtgagtgaaatatgcttgcagtattggagaggatgaaaaaaactcagagtgacagaagacaagtaggtgagacggagcctggcataaaattaaactgagcagcaggcttcaaacaggccacataaaaaattagaattaaaaagaaagaaagaaagaaagacattgctatagcacttcctatgtgccaaaactattttaagcatttttcacacactagcacttttcattcttgccacaactatatatggtgtgtactcttattatcttccatttctctggtagaaaaactggttcagagagttagtcacttgtctgaagtcattccattactaaaaggcagagctgtggccatctggctccacagtttgcatttatccactacacccttgccctgaatataatggaagccatgctgactcattcttccttaaaagactgacctatcaattcagaggagagatgatggtgattggggtgagatggagagaagcagatgggctcgaggaaacttccaggtaaaatcaaatgcaactgatgatatattagaggcaggtaatgagagagaagaccatatcaagaatgaccacccaacttctggcttgattgggtatttactaaagtaggaaatggcaaaagaagatgtttgctgagggacattatgttggcagtggcaaatccatatgggtctgcagcaacctcaattcttgactctcagaggaaagaatttgaccaagggggcataaagcagagggggagactggaacaagttttagagtaggaatgaaagtttattaacaagttttagagtaggaatgaaaggaagtaaagcacacttggatgagggccaagcaggcaacttgagagaatcaagtgcctggtttgacctttgacttggggttttatacactggcattctgcatgtgtggtggcatgccagcacttaggagaggctgcatgtgcattgtgtttactgaagttacctgtatgctcacttgaggtgttctccccttaccagttgagcattcctagaggaagttcacataccagtcaaactccaccatcttgcctcttagtgtacatgcttgagtctgcttgcccaaattctgagatcttatcatcttatcaagaagctactgatcatcagtttcaggtgttttctagtgggagactgcctttctgttgcacaggttgcaaccaattattattttggagagaaagtttaaccaaccacctgaccatcgcctgatggtcacctgacattccttgaagcagggtggggagttgggggggctctctcttgcccaataaaacttatatttgacaacctacctattctaacaattacagatttcttttccattaagtttgagatgctaaagaaacatcaagatagatgtgtctcaagcccaagtattggatcattttcaccctactttcccaacaggaagtagaagtaggtgagaagtgttgtctgactgcccagaggatgggaaggcagccacagtcccatggacaggtgctcagactgctctccaggtcaccacaagtcactgtctctggtagctcctcaggtgtattctctgagagctctgtctatagtggatatagtgaattctttgccttgaggctgggttgctttttctctctgactaggtcacatctcccttattgtttgggatgcagttcctcatgaatacattgcaagtatgttgatttatgcatgaggtcctcctgtgccctatttaggaaagagcatccctttcttggatgtaggagtagagagaggttccatatacataagaattttccagacaaacagaaccaggccaggtgcggtggctcacacctgtaatcccagcactttgggaggctgaggcgggtggatcatgaggtcaggagatcgacaccatcccggctaacacggtgaaacccccaccccgtctctactaaaaataccaaaaattagctggccgtggtggtgggcacctgtagtgccagctactcgggaggctgaggcaggacaatggcgtgaacctgggaggcggagcttgcagtgagccgagattgcaccactgcattccagcctgggcgacagagcaggactccgtctcaaaaaacaaaaacaaaaacaaaaaccaaccaaaaaaagcagaaccgataggagatagatatggattgatagatcactagatcggtagagaatagatcgttggggctgagcgtggtggctcacgcttgtaatctcagcactttgggaggctgaggcaagcagattacctgaggtcaggagttcgagaccagcctggccaacatggtgaaaccctgtccctaccaataatacaaacatttagctgggcatggtggtgtgcccctgtagtcccagttacctcagggaggcaggagaattgcttgaactcgggaggaggttgctgcagtgagccgagataagccactgcactccagcctgggtgacactccatctcaaaaaaaaaaaaaaaaaaaatgttggacagatagatagattcattttaaagaattgactcatgtaattatggaggctgagatgttctaaaatctgccatctgaaagcaggaaactcagaaaagctggtgcaattgtctgatcttgaaaaccagggaagactatggcgtaaatcccagtctgatggcagaagatgacatgacctgtcttagttaaagctgtgagggaggaaaaaagggataaaggtctcttttctctgtcttttgttctattcaggccctcaaaggattggatgacgcccaactgcattgaggaaggcattctactttactgaatttactcattctaatgctaatctcaaaggtggctggttctcaggatgggaggggaaatgatggggaaagagaaaatattgataaaagggtataaagttagaattagtgtggaggaatgagttttagtgattgattgcactgcatggtgaccacaattaatttaataatatattgtatatttttaaattgctgaaagaatagatttttaatgttctcaacacaaaaaagttaaattggtgaggttatggacatgttaattagcttcattgactctataatgtatatgtagatcaaaacattactttgtgtcccataatatacacaattattatttgtcaattaaaacaacaaccacaataacaaatgctaatctcacctggaaacatcctcacagacatacccagaaacaatgtgtactctgggcaccctttggccagtcaagttaacacataaaattaaccttcacaggttcagagttgcttaatcaggtcctcccattagacacaaggccattattaaactgtgatgcaggcaacccatgtgcagagagccagggaatgagaccatttgttgtcagctgtgcgctcaacctattttcactctgaagggggaagtcagaacacatagtgaactgcctgacttcccttcctctttactctggaatcagagagaatttgtttctcattccttaatgcctgggacttcactgtaccttatgttcttttcttcaaagctcataaccctcatcccttctctctgggttactgaatgctgaaatatctttaggagaacatgaattactgggagaatgaaaatacacatctctaaaaatacagtttaggctgggcgcggtggttcacacctgtaatcccagcactttgggaatccgaagcaggtggatcacctgaggtcaggagttcaagaacagcctggccaatgtggtgaaaccccgtctctactaaaaatacaaaaattagctggacatggtggtgggcgcttgtaatcctagctactcaggaggctgaggcaggaaaatcacttgaacccaggaggtggagtttgcagtgagccgagatcgtgccatttcactccagcctgggcaacaagagcaaaactcaatctcaaaaaacaaacaacaaacaaacaaacaaacaaacaaaattaaaaaaagtttaattatttcaaaataattttttcattgcactgattattcacaaatgagttttcattatcataccttcatactcagcaggaatttagatgttatattagaaagatggtttctagccattgttactactgctcaattttaggtacaaattagaaaattggatgagtcttttaacttcccaaatgagagaatgtttaaaggagtccagtgaatttagagagtggatgtacttgagtaaaaaggtctgtagtttacagactgaagatgagatgaaacaaatggtatatatcttgggatattgagaagttaaatttattcaacacaactttttgatgtttgacgattgctatatttaactcagcatcccactgtgctttgattgagataccctgtaagaactgctgtttcaaaccataaaatacaaatataaaatttattttgttagtttgtgaaacttcaaatcatgcgttgaatttctgtaatttgatatgttttcagatttctctgtcaataaggtatcctagaaatctctacagacagactgattcaatcttggcttattcaacacaaattatattttatttctattgaattatgttttacacccaaacagtaggatataaggcacctttgtaaataatctcctaaattctgttttcatgaatctattaaaatctgacaaacttcctgagatcaacattcacgggtgtctgcctatcctctagttttgcattattttcattatgttttttggcttcagcctccttcctcatttttagtaaaaaagaaatcttccttaggctcatcatgctacattatcttttttgaggaaagaaaactatatttattttactgaggagacaaatagaagctagtgaagtaatttgtttacagtcataggtttttcatgctaggaatattatttcttagttcctctggtaagtaaattccattattctttcttcgtcaagtttttctaaatctaaaacaactctcatgctcctttaccttccttttaaaaaatatttttaatttttaatttttgtgggtacatactaagtgtatatatttatggggtatgttagatattttgatacaggaatacaatgcataataatcacatcaggataaacagggaattcattacctctaccatttattctttctttgtgttacaaacaatacaattgtactcttagagttatttaaaatatacaataaattattgttaactgtagtcactctgttatgctatcaaatactaggtcttattcattcgttctaactatatttttttctaactatatttttgcacccattaaccatctccacttccccccaccattacccttccctgcctctgataaacagccttcctatcaccatgtgttctattattttagtgtttagctctcacagataagtgagaccatgtgatgtttctctttctgtgcctggcttattttatttaacataatgatctccagttccatccatgttgttgcaaatgacattctttgttatggctgactagtactccattgtgtatgttaccacattttctttatccattcctctgttcatggacgcttagggttacttccaaatggaggctattgtgaatagtgccacaataaaatgggaatgcagacttttgggggtatatgagtgggattgctgaatcatatggtagttctatttttagagtttgaggaaccttcaaactgttctgcaaagtggttgtactaatttacacattcaccaacagtgtaggcaggttccctttcctctatatcctcaccagcattcgttattgcctgtcttttggataaaagccatgttaactggcgtgagatgatatttcattatagtttcaatttgcatttctctaataatcagtgacattgagcacattttcatatacctgtttgccatttatatatcctctttggagtaatatctatttaggtattttgcctatgttttaattggattattagatttttttctatagagttgtttgagagctatatgtgtgtgtatatatatatccttgtatatattaatatatatatatatccttgtatatattaatacaacgttattaatcccttgtcagatagattgtttgcaaatattttctccgattctgttaattgtctcttcactttgttgactgtttcctttgctgtgcagaagctttcaaatgatgttatttcatttgttcatttttgctttggttgtgtgtgcttgtgaaacattactcaagaaatctttgtccagtctgacatcttggagagtttccccaatggtctcttttactagtttcagagtttgaggtgttagacttattctttaacccattttgatttaatgtttctatatgacaagagatacgggtttagtttcagtcttttgcatatggatatccagttttcccagcatgatttattgaagagactgtccttttcccaatgtatattcttggcaactttgttaaaaatggtctcactgtagacctgtggatttgtttctgggttctctattctgttccatcagtctatgtctcggttttgtaccagtaccatgctggtttgtttactatagttctgtagtataatttgaggtcaggtatgtgattcatccagttttgttctttttgctcacaatagctttgactattctgggtctgttgtggttttgtataaattttaggattagttttcctatttttgtgaagaatgtcattggtattttaatatggattgcattcaaactgtagattgctttgagtagtatgaaaattctaacaatgttgattcttctgatccataaatatggaatatctttccatgttgtgtgtcctcttcaatttctttcatcagtgttttacagttttcattgtagatgtcttttgtcagttaactcttagatatttaattttatttacagctatttaaatgtgattactttcttgatatcttcttcagattgttcactgttagcatatagaaatgctactaatttttgtatgttgattttgtatcctgcaactttactacatttgttctaatagttttttggtagggtctttaggttttttcaaatataagatcatatcatctgtaaacaaagataatatgacttattgtcttccaatttggatgcctttcatttctttctcttgtctgattactgtagcaaaggcattcagtctatgttgcataacagtggtgaaagtgggcatccttgttgtgctccagatcttagaaagaaggcttttagtttttcctcattcagcatgatactagctgtggttctgtcgtatatggcttttactgtgttcaggtatattccttctataaccaggtttttgtgggttattatcacgaagggatgttaaattttatcaaatggtttctcagccttcagttgaaatgactgtatgatttttgtccttcattctattgatatggtgtatcacattgatttatttgtgtatgttggatcatctgcatccctgggataactcccatttggtcaagatgtgtttttaattgttttgtggaatttagtttgctagcatgagaatatttgcatcaatcttcatcagggatattggtatatagttttcttttttggatatgtctttggttttgttatcaggtaatactggcctcgtagactgagtttggaagtatttcctcctctatttttcagaatagtttgcataaggttggtattagtccttctctaaatgtttggcagaatttaacagtgaaaccattgggtcctgggcttttctttgctgggagactttttatcacactttcaatctcattatttgttattggtctgtttgggttattgatttttttcatgcttcaatcttgattagttttatgtgtccaggaaattatcaatttcttccaggatttctaatttattggtacacagttgctcatagtagccactaatgatcctctgaatggttgtaatatttcatttttcatctctgatcttatttacttgggtcttctctattttttttattatttaatggcaaaaaccacaattacttttgcaccagcctaatagtctggctacaggtttgtcaagtttgtttatcttttcaaaaaagcaacttatctgttccttgatcttttgtattgctttcttcattccagtttcatttatttctgctctgatttttattatttattttcttcttctaccagtttaggttttggtttgctcttgctttcctgattctttaagatccatcattaggtggtttatttgaagtttttctactttttcggtatatgcacgtatagctataaacttcccacttcgtactgcttttgctgtatcccataggtttccattatcacttggttcaaaatttttttaaatttctgcttaatttcttcattgattcagtagtcattcaggggcatattgtttaattcccatgtgtttgcatagtttccaaaattcctcttgttattgatttctagttgtattcctttgtggtcagagaagatacttgatataattttaatttcttttgaatttgtaaagatttttatgtggcttaatgtatagtttacccttgagaatgacccatgtgctgaggagaacaatgtgtattctgtagccattggatgaaatgttttataaatatctatcagttccatttgatctgtagtgcagattaagtccaatgtttcttggttgattttctgggtcatctgtctcatgctgaaaatgggatgttgaagtctctagccattattggattggagtctatctccttagctcaaataatatttgtgttatatacctggttgttttatcctcttgttgaattgaaccctttattataatataatgacctttttgtctctttttatgttttgtcttgaaatctattttgtctgatacaagtatactactcctacttttttctggtttccattgacatggactatctttttccatccctttatttttagtctatgtgtatctttatagctgaagtgtgtttcttgcatgcaacagattgttgagtcttgttttttattcatttagccacctatcttttgattctggagtttaattcacttactctcaatgttataattaataagtaatgagttattcacaccagtttgctatttgtttactggttattttgttgtctgtcttcattccttccttcctctgttctgtgtagtgaaggtcattttctctagtagtatgttttaatttcttgctttttattttttgtgtatttgctgtatgttttttatttgatattaccatgaatcttgcaaataatattttattttttttgcaaataatattttataacccattattttaaacttattttaacacttattgcataagcaaacaaattaccacacaaacaaagaaaaaactaataaaactctcactttatccctggctttttaactttttgtggtttttatttatatcttattacattgcctatgtcttgaaaagttgttgtaattttttgatatgttcatcttttagtctttctactcaagatatgaatagtttatatataacaattacagtataataatattctgtttttcatgtgcttactgctaccagtgagttttataactttagatgatttttttgctcattaacattcttttccttgagattaaagaactccttatagcatttcttgtaagaaaaatttggtgttgatgaaatccctcagcttctgtttctctgggaagtctttatttctctttcatgtttcaaggatattttcactggatatattattctaggatgaaaggctttttatttccttcatcactttaaatatgccgtacccctctttcctggactctaaggtttccactgagaagtctgctgctggacatactagagctctattgtatgttatttgtttcttttctcttgctgcttttagaatcctttcttttttcttgacttttgggaatttacttattaaatgtcttgagatagtcttatttgagttaacttttcttggtgttctataaacttcttgtgcctaaatattgatctctttctttaggtttgagaacttctctgttattattcctttgaatgcactttttatcaatatctctttctctacctcctctttaaggccaataacttttagatttgctcttttggggctattttctagattttgtagatatgtttcattattttacaatttttttttcttttttctcctctgactgtgtattttcaattagcctatcttcaaatttactaatatttatttcctttgtcaattctgccattaaaataactctgatgcattctttagaatgtcatttgcatttgtcatctctagaatttatacttgattctttttagttattttaatctctttgttaaatttatcttatagaattctaaatttcttctctgtgctatcttgaattttattgagtttcgtcaaaacagttattttgaattctctgaaaggttacatatctttgtttctccaggattggtccctggtgtcttatttggcctgtttggtgaggtcatgttttcctggatgtttttggtgcttgtggatgttcactgatgtctgagcattgaagagttgggtatttatcatagtcttcatgtctgggctttttatacttgttcttcttgagaaggcttttaactgcttgaagggatttgggagttgtgatataaacttttggtaattacagccatatctacattagggggaaccccaagaccagtaatgctatggctctttcatactcatagggataccaccttggtggtcttggataagatatggaagaattatctggattaccaggcagagactcttgttctcttctcttactttctcccaaacaaatggagtttctctctgcagtgggctgcctggagctgggggagggatgacacaaacactgcagtggccactgccactgggactatgttgggttaggcctgaagccagcacagcactggttctcaccaacgcctgcattaaccactgctgtctaccacctatgtttgttctagaacctagggctctacagtcagcatatggtgaatgaagctagccaggcttgggtcctcctcttcagggtggtaaactccccctggtcctgggtagatccagatatgctatgcaggagtcagggcctggagttggaaacctttggagtctacctgattttctattctattgtggctgatgtggcaacgaaaccacagaaggagctccttcccagttttctatatcctttccacaagaagagtccaccaccatcccaggcctgtggcaaatactgcctggagatgaccgatgttcacccatggcccaagggctcttcggtcatcttgtggcgaatgccgccagacctaggactctcccttcagggaagtgggctcccctctggcccagggtaggttcagaaatactatccaggaggcaagacctggaatcagggattccaattgcctgtttggtgctccatcctactgtggccaagctggtacctatactgcaaaaccaagttctctttactctttcctctccatttctcaagcagaaggagtttttccccatagttactatagctgggaatgtgttgggtcaacccaaagctaacacatatctgagtcccacacaaagcccttattagtaccatctggctactgctgcttcttattcatggcccaattgctccttagtcagcaggtaataaatcctgcaaggactaggctcttccctccaaggcaacagatcacattttggcccagggtgtgtctagaaatatcatccacaagctatggcctggaatggagtccccaggactcagcctgttgtcctatcctactgtggctaaagggctatctaagttgcaagaccaagtcctctttactcttccatctcctctccttaagcagaggaaaggggtctagcctggagcggcgagctgtgctgccttgggttgtaggagtggtggtgcaagcactcccttggcttccccggctattgtatcactagtttgtgtgccccccaggttgactggctctcagtctgatacagcactaggacttgccaaggcatcaaagttcttgctctctagactgcctctcaagattatctgggactccagaacactttggttctcagctgagttcttcctggtgttttttccactgtgacaggcagcactaagtaccaatgcaaagtctcacaatcactgtgctctccctccctcaagcatacagattctctctgcatgccacacagctactcccagggaactggtggggttggcaattgaagactttctttcgtgtcttcttcagtgcctctttttcatatatatacaaatatttccattaaaaaaaacaaaaaggatagaaatatagaataggtatttaatttatatttattcgattgctgttagtctcaattgctttccctggctccttaatgctgatgggactgatatctacctcctcctatgtggcaacatgcttaaaacaatcttagttcctgaggcagcctcaaatgatgtagaacctgtgtcaatgggcttgctgaccctgactccctctcaaaatacaacaaaaacaaagagaacagggacctaagatcaattcattgtgtctggatatagattaatgaaattgctataggtttgtttctatattgcttcttgtgtctactttgcattcaatcattccaagttccctcttaatctccttttcccctttgtgatggtcaaatgaaaatatgtagttctagaatagtttttactctgaagactgtcaacccactctgtatgaataggcaataacattcatttgaggcaattttattctctattaaatactttttatataaaagagaaatatctcatttttgtttggatggctatgattatgaatgagagtatattttaagcagtttgaatgcccttagaaaattatctctctgactttcatccatccaaccctagccatttctgggaacttttccaaagggtttcactgtactgtgctcttcacattagaggacgttttgctccaagtgataattgcttggctttcttcaagcttgcattgtcttgatgtccaagcctgtgatagatgcatctgaatggctaactctagcaattagggtctcagaggtgcttaaaaaaaatgagtggttgataatttcaggtaaagcttctttttctcttcagcttgcaggtgattttttttccaacattaaacaaatataaataaagttccttatttaatttcaagcagaaagtcacttgttttaatcaaatatacagcactacaatataaacagataaatacagaatgaatatttggggacacagtgagtactctagatggatgtctgaaaagagaatacataattcttaaataagtgatttacgtggtaatttggaatatatactcaagaggagaaaatggacacatctattatagagctattagtttctcaatatggccaattttacttgaaaatcactttttgtcttcattgatctgtgcctgtggctattaattggatatagaattctttgagaaacacagatatctaaactgtgtgattgttcataaaattaatacattttttgcaaagatattttatatactcttccactattttatagttaaattagatccttacatgagaaaattggttaaatggcacagcaaagtcttttcattgttaagtcaggggaatcgacaacatatgctttttatgatttgaccagaatgtggttttttaaagttttaattcatgctctttctgctttgaaaacagaattgtaatctgtgcttttgctgagtatatacaattcttgcttactgtaaaaattttaaatgccctaaaatgtattctgttgtttatcctctagaaataacaagtgttattttattatttacaatgctcagactttggcaattatgtgtataacatacacaagaccatgctaaatattctttagtgttttacatttttctttaaataaggggcaattttaagtgccaacacaaatatttctaccttataatttcaatggctactaagtattccattgaaaaatcaatcataggaaaacagcatgtcatagtttgttatttttttcttcttaatgctacatcaaagaatgtgaccttgtaaaatgtatgacatgttatattaggtgaattatcatattgccatctactctttcaagttatttatgcttttcagtgccttgtatatttccccatcttccttcctccaggttcaatttgggttggtgtcttagcaaagaaatgtgagctctccatctgggaatgagaaaatatatctattttctagatacaggtcatttagcaagttgaggactgtctacaaacagcatttatggagtgagaaattcgggcaaatggaaaacctagtaacaatcattccaatttgctacttttctgaattcacctgcccattttttttgtgtgattcttttggctactatggcaaccttctctctctgacttcttcaactatatgtcagttgttttctgtagtatttataactgcaagggataaaatttcacatttggaggcttatatttttcagaggcattttgagttcagtgttgctaatttctctactcttttacaacagatctcatgatttttctcctcatgttgaattacagaatttgcacttcccatgtggtctgaatagctggtaacaattctccaagaaaggtttttccttttgcttacctgtgttcagggcagtgtggtcatcatgtgaccccaccacgtttttagcttgaacttaagtcgtgcaaggagtcttcacttgctgaactctacacaaaactctatacattagaaagcatttgcatttttagtgggtgattcttgttgattgaagaaattgacagatcaatccagaaattatgtttcagagaatttcttaagccaaaaatatttttcatatattgggcttcattattgctgtttggtgaatattttgtaatacagtgtattttgacctttaatatatgctgatggatgccttttattttatccccaaactttaaaattgatctacacatcgtatacagtgttgaggtaggtagggaagagggagaaaagatgaagataaattacatttctgtttatcctttccccctgggaagtctaatgtaggtgaaatttttcatactatgatgtcttattttgaggaattctgcataatcttgatattatgtattagtctgagtcataataaattgctgttttgtaggtcacagatgatcagaaatggtcatttcaaatggttcaacataacacaaaggaagaaaagttaaattctgcaaaaatgtaataaagaaaaatgataaataccaatgttttaattattatgatagagaactagaaattaagagactatttgttattcatgtggatataattttttctcttgttatgtgtgtgtgtgtgtgtgtgtgtgtgtgtgtgtgtgtgtgtgtgtgtaattagcaattaggttaatacctctaaagtaaagaaatatatttatatagctaagtaattactgtcagagttgaatatctataacattggaaaattcacttaactctgcagagcttgttttccatttttagtaaaatgatgaaaataaaactctactttcctactgttgatagtagatgataaaaggaaataaatcgaagacatacataactcaatagataattagaattgtgtcctccctaacagtttatttaaagaagtaagataaatttgtgaactttttgttgctgttacttggagaaaacatttgaagctggctaagatttatttatcactattcatgtgtcagattttgctatagatgattcatttaatttagccctcacgataactccatgatcattatgattctggtgctattaagattccccttttatagatgagtaaactgagtctcagagtagtaagcaaatttcttaagactacacagctaggaaggcccagactgtcgtcaagcctggacggtctaactcaggagataggccctttaatcccatgtcagacagatgtccttcctgccttgcaatgctattgccctccatcccttataattttcctttacaattttaagttatttttctgttcttaacgtttccttcccttcccatataccctaattcacgcagaaatatttgaattcagttatcaccagaccgaatgtgggataccgggttgaagttttgcctgtgtcaccaccccagcgcatctgctgagattgttgcgacgggcggagcttttgcccacgtgactgctttccctgtggtcaaaagtcaacacagagatttagaccccagactaaagaaaatggtgggagagatacagcatatagaaagaattagaggttagaaggactgcttgtgatacaagctactcccctctatacttgtacaagacaagtaacccttaggggaaaggtaaactgacattggaatgtatgtatgtaaagaagaacctttccatggcttgaaagctttagtgaaaaaacatttcaagaaagacgaagtggcaaacttccaaaaataaaatcaaacatgttctgtgaatttttctttctcattttagatgattcgatagctgatccactaaactgatgtataatgtatttttaatacttaaaaatcatttttttcactacttcataattatcaggctaaatataacagaataatttactttattgttaaatttcgtatcttgtaactcatggtcttttccaccagcagcctcgcaagagattttcatagcttccttctgcatgtgaagcttattcagtataacaaaagctacttctttaaacttgacaatcacaaaagggcattgcaaggttgagatcctgggtgtgagagtgtctttgacttgttatgaaagaagaattaatgtcttggctgagatcgtcattctcagatactcttacttttcttggcttttgaaagtctatagctgatttgtgtttccaagtgtaagccatccaaagccataacaaagatcacaggacattgcaagcttaattagaatattttctctctccactctggaggcaatctcatttgtgcctcactcttgtgatgcaatgttttcagcaacccccagtgccaacccagcatacactaagtgaggtcacaggatttcattttactttttatataattttcagctggaaaaatgtctattcctaatctgcagaccctcaaaaatgttaccttaaattgcattttagttgggtttttttttttccacttggactctttgtaaccagtgttgggtgctcttttatttactgtgtagcttttagataataagaacacttttttataggcactgcttcctgcattaattaatgtctatactcactctcttattgctttttctctactatggtgcacttaatttgtggtggtgagattgcctagattcatattaggtgttacatgagtattacctagttaaggacgttaaacttcctttcagtttgtctccaatgataagggtgtctgtgttaaacctcctttatgtcatcacctaagaatattataaaggtaaaatagttattaatccaactcaggtattgtatatagatacaggcaaggtcaacagtcttttcaataaaatggaaaaaaaaatgatggtgcatacacctcttgtgattacattcaaatatttattcaactttccaaaaataattggtgagcagcttctatgccccagtcacctgcctggggaatcaggattcaatcatagacactagagattaaaatcagtcccttgacagagattagtgacataggagttcactgtcctagaagtcaaagaactgtgttagatgtttcctatataccttctctaaccataggcaaatattaagtaataatattactaaaattttggaggaaaacataaaaataaacctgaatattataaaaggtatcaaagagtgatattatttatccaatatcatcataatgtgacagatgtatgcccatttatattttaaaataatttatatttggttaaaaattaattttaattataaatggatgtatgccatttttaaaaactgtaataaaatagagaaatatagttgctggataatattttgaaataatattccatggttttgcattctcagtaattaattttagcttataaaacttccattattatgattggattatggagttgtaagcttctttaggaaaatgttgactccctaaatcttgtgtcaaatttgtggcagagcatgtacatgtctttcagtttatctagttgcaatactgccacctgaatgtatttagttaaaataattaagttacgttaactggtatctagatatcagaattattaactatgacaaaattgataccttggtggctataatatgaggctaaagaatggaaggtgtagcttgaaatcatctcttgccatcagtggcatcccatgtggttgttggtggaggacagagtttagagcttatacctgatatttttcaagagcttctgaggcatctgcttttggttgtgtgttcttttgtctgcttcgtatcttttacagttaaataaactaatgtctggaatatattatgtcatataaatttttttgtgtcatataaaaaattttgataatttcaaaccaaggactgaaggatagcaggtcagtggtcatgtaacttgtaagtaaattttccaaaacattcacttcatccatatataataattgtatctaatccaagaaaataagatattacaaaaaaataggaaataagtgtctacaataagaagaaaataggatatgaaaattaaaatacagtagatgataaaaattctccataaatgtaaatcacaaagaagaaaaaaaactttaccatctctgaaaccaaattacataattttaaataagcagttgcagatatgataaaattacttattcattactacaaaaacaaaaacaaaaccactggaagcatatatgaacaaaatcaaaataaataagcaaattaaaagaaatgaaatgaaaaattaaacaacccaagacataaattggaaaagaaggccaaatcattatattgtgctaaattacaaaataaccaaaggagaaataaatttgaccaaaaatgtgataaagtcactgaaaaaaaaataagtggaataaattatcttaaatgatataaaatgtatcagaaagataattttctatgtagaagatgagttcaaaaatccattatattttaaaagaaactttgaaggaaaaaaatgcttcatcaacatttaatactttaatcaaataattacttagggaagcaaaagatgtgaatctacattttattttatttttaatttaaatttttgagacaagctctttgtcttgttctgtcgcccaggatggagtgcagtgacttgatcatagcttactgcagccttgaactcctgggatcaagggattctcctacctcagcttgccaagtagctaggactacaagcttatgccaccacccccagctaatttttaaaattttttgtagagacggggtcttgctatattcccaagctggtcttcaactcgtgttctcaagtgaccctcccatctcagtcttccaaagtcctattacaggcatgaatcactgcactcagccagaatctacatttttagaagactatccagtaccttcaaaaatgtgtccagagttttacagtcaagacatatatttataaaattattggatgttaataatagatagaaataaattatcagggccctacacaaaaagaccacattttcctcaatggaaagaaaatcaagttggcattacactctaatgaaatcagctctttcaataagatcaagggaaaattttgaagaaaacttttatatcctgctaagatgtccttcaaagtttaagtctataaaatagttttcagtgtgcacaaattaagggaatatgaactcatgaaagatgccaagaattccactaagagacctcgctcattcaatcaggagttgatgggagaaattttcaaaggaactgatggagggaagtgaatatatgtaattgcagatataatactaaaacaaatgtgggaaaataatatataaaagtgatataacaacacagaaacactgcaatgtaaaaactgaaaatgtgtagggtaaacaaaaagagaaagtaatgtaattcttactcattgtcacatagttaagaggtaggagtcaagtaagtcacataaaactgaaaccaaattttagatgcataataagaaaaagggattgaaagcactataaaacacattagtccatatagagaaaacaacataaaaatgcaagcatctgtaatgactcaaaataaagctaaataactaaatgaattaattgaagcctgcatggagaaaaaaatcacacaaacaaaataatttgatggagtgagaacaataaaatcatttatgtaaataaatgccaaccgatttcattcatttattaagaaacagagatgttcaaatcggcttacaaaacacaaccccaaaaatgctatacaccagaaacacccctaaaatgaaggaaatcagaaagctaaaaattagagaataggttaaaaaaaaataaagtggagttgagggagataataggaaggcagaaattataatcctcatgtcaggaaaaagatcagtattcagaacacaaagtattaaatatgacaaagaagaagagtgttatgctaaatattataatcaaaatgaagctataaaatgattgatatctgtgcaaaagtagcacagaagccaacttatttaaagttgtggttcctgacattataagaaatattaacatggcctctacattcaaaataaagaaataagggtatgatacaatcaacataactaataattgctttctgtgatatatgtaatatatcaatttgctgtaaaattgatatggtttggctctgtgtccccagggaaatctcatctcaaattctaatcctcataatccccatgtgtggagggggtcctggtgggaggtgattggatcatgggggtggtttcccccatgctgttcttgtgaaagtgagtgaggtctcacaagatctgatgactttatgagtttgacagttcctccttaacacactcgtctctctcctgtcaccatgtgaagaaagtcttcactccctcttctccttctgacatgattgtaagtttcctgaagtctcaccagccatgtggaactgtgggtccatttaacctcttttctttataaattacccagtctctgatatttctttatagcagtgtgaaaacagactaacacaaaaatttagcttatatatgaaatgtatatcttttggatatatttatattttatattattcaataaagaatatattctcaaatgtaaaacaattacttacaaatcaagtaatagtttacatggaaaaaaatagtggaataaaataaagctcttagagcacagttaaattataagttaaggacaaaaaaagttcttccatctggaaattttaaaattctctaacaaatttttggagaatatggacatgaaaattaaaattattttaaaaaattaaaaacactatgtatccaaattataggatttattttaaactatgaaaaaagaaaaactcatagtcagaagcatgtatttcaataaaaatgagagagttaaattagtttaaataaatttctaacttgaaaagctaggaaaagaaaaatgtgaaagcaaacataataccaaaaaataaataaaaattataatattatttagataggaatcagagaacaatataattaatcactaaataaaatttgtgttttatataattaggaaaatttaaactactaactaacctacccaataagaaaaaagaaagcaaaaacaaaatgtgaaaatgataaggaaataaccatttaaataaaaaaattttttttaattgagatattattttaaacatctctatggaggtaaatagaataaatagatagtttctttttaatgtgtaataaactgaaagtgagatgactagaagtggaaacaaattttcaagaaaattgtagactaattccaaacatgaatatcaacacaaaacttctaaataaaatagcaaatgaagcaaaaagtcagggtacattgtagataaataggcttatttcagaaaggtaagcatgttcattatgaaaatcattgataaagttctctaaatgattaaatcaaaggagagaagccattctccttttaaatgctgaaaagaccttcagtaaaatactaacatgtagataaaatgctaatacccccaatatattttttaaaacacataaaaacatggaaagatcgcaagaacaaataatgaatctgaccaaagtaaagaaatatggtcacttcagtcataataattaaaatgcaggttgaaactatacataaaaatagcattgctccttttgtacattgaaaaaaattgtaaaagctggataacataactctgctggcattgccgtggagatacctgccttctcattcattgctggtgttagtgccagatggtatgccttatgaagaggaattgtgtgatatctcatcaatgtccattgccaatttgccctttgcagtagcaacttcatttctaagatttaacatcaaagtagaaggtggggagaaatatgttcaaatgattattcattgtgacattattgctagctgtgaaatattagaaactacataaatgcactgtagtctgattgaattaactatggtatatacatgtaatggaatgctatatgtctcttaaaaacaaaagagatctatgtagtatagagtgagttcctggatacactgtcaagggttaacatcgtagatacagtgtgctacctgtcctacctagttatttgtgttcctctctccctgcaaaaaccacaggaagaataagccagaaatagtgacgtgcagaagaaatctggcaacatggtacatggtgtagggaaaagaagacaactcctctgagcataatacttttgacttttgaagtgtattccaaatcttcaaaaaatcaaattgaataaacagataaggaatcttaacactgttaaagaggaaagtcgcactggacaagatgaggagacagagattgattttattctgatattacgtccagcaatagggtagtggggacagaccaactcgataccagcaagagctggaacgtttttaagatctggggttggagggaaccttaagccaattttgtctgccagttggccttaaccaaaggaaaagtaaactttttattttcatgataggaggtagctttacaacttagagcaaggtgccccactgcagctaggctcctaccctcccacagagagagggagaggggttacatcttccttgatgattacctttcaaaagcatggctcctaggtctattcttgggttgtgaaagtggaaagaggctcttaaaaagatttgcatttcaaaagtgcagagagaggatttaccatgagaagttttctaaagtaaacgctttaagatcctggaggcaggaagaaacctgcctaatgtttactcaagctgaggggaatggtaaggctttcttggcgactaattagctctatgtcaaattgattaattgattaagataaagaaggtatattagtcaaggttctccagaaagacaatacaggctacatagatacgtagaaagagattgcacgtgagggattggctcgcatgattacagaggctgaaaagtctatgatctgccatctgcaagctgaaggcccaggaaagccagtggtgtagtttcagatccagcccaaagatttggaaaccgagaagttgataagtcccagtctgaggctgaaggtgatgtgaaaatccccatctgttacctaaagaaaattatatttttctttcaccctctcaccagaaatagtcaccattagttttatgagaactttcttctacttgttggaataataaaaataaaagtcttacctatgtgcatcaaatagatagtgcttgagtaatatggattgcctgtttgtctaagtgttggggatactgtggtaacaaaataagacaaaacccctgtgctctgttctagtagaattgttaataaaccttcaagattactagtttaattgaggtcagttgttaaacaggttttggcagatgaagggcagcatatatctaaaaatcatggaaccccttagtcctggaccttttcttgcaaatattgagactactgtatactgcttttcctgaagtagaataataatgcgcatcttcattactttctcctccctccttaaaaggaaaaaaaaagaaagcttagaatgttcatgttctgctcccatcagtggttcctaaagaaaggctggggtgaggtagtggcatggaattggtaggccaagacttggctcactggacaatgagttttcagttcaataccatgtttaacgacattactgctctggttacccatgaacttgtaatgctgtgatttgttggagttttatttatctatgtatttacttattttacatttaaaaattgcatttgattatacttttattttaagtttactgcttttaatttacatgtaattttctcaatgtttgggcctatgtcaaaaaataatggaataataatattaggtttaaataattctgaattgtctagtcattagcaaaataaatttaaacataggaggctttttgaaaactctataataaagcttccgatttctataagctgaagttgaagaatccaattcaaataaatacatatttaaatagagattgtgttgactattcaaggaaaacctttcccttatatttctataaatgggccatcttgatcatttcaaataaggcttatttaagacaacaatataatatgaaaaggagaaaaatgaccaaatgcacgtagatcacctattttttttctcatggaggaattatgttctctattggaatctagcaagttctaaatgtctgtcacttccaggcagaaattgccccctggctcttaacagccctttggagacctgtcaaatgaattcaaaggaatttttatattatgtcagttcaagttcctttcaaatttgtctattctattctattctttgctgtttctaatttattttatagatttttaatgtcaattaactatttttccttgggaaataactttattttgcccacattctactaatatatcacaattttaagctcttgattgatttatatatttttattaatttcatggggttttttgtttgcttttgtcttagtttttgagacagggtctcactctgtcacccaggctggagtacagtggtgagatcacagttcactgtagcctcaacctcatgagctctagtgatcttcccatcttagtgtcccaagtaactgggactacaggtgcaagccaccacacctggctaatttttgtattgtttgtagagacagggtttcgtcatgttgcccaggctggtctcaaactcctggtctcaagccatccaccggcctcaggctctgaaagggctgggattacaggggtgagccaccgcaccaagcattaatttcaatttagaaaatactcaagaaaatttcttctgcttcttgaagtatcttcttcactttcttatcagatgtttgcattttacgtttcttttaaaaatgcatgcccatgcactgttcgatgaagagcatgtatttgagcacaccctgctctgtgtgccatgcattgtgcttgactctagagaaccagtgaggaccaaagctgaccaggtccattcatcatggtgcttacattttactgggaagacagacaatttaaaaaagatgaatgaaatacataacgtatcagatagtgaaaagatcaaaggagaaaaattaagacagatttaaagtgttgtgactgttgttaaaattttagagagtggccaggaaaggcattactgaggatgtgacttgtgaatgcgaacctcatacctctcagctacagtgggtgggcttgaagtggcttcccacttgtggtaaaagagtgccgctgagttaggactgtcttgtctggggatatgggcttggttcgctctttggagagcctctgtgaaggcctttccaccagccagcagtttatcacgggcatgccacttcagcacaattccctaccttattgagcataggcctctcgaaaatggtcttaggtaggcactcacccagtagagtgcaagttagagatttccccttgtggtgctattttttccctttagttttaagaaagaattttaaaatttaaatctttatctatctggaatttattattgaatgaaggaatagaactcaaactaggtaatattcttaactatactaaaatgaaaagaaaaaaaatatgcaaacagaagaaattcttaaaaatccccaaacctattgaccaaataatgattatttgcaacattattggagacaaaaagctttttgaaaccatgtagataattcctatatgttaatacaaaaaaaaatgcaagggaaaccaattaacatacggtaaagtaggtgtccatgaagtttacaaatattaaataaaaatatctacttcatttaagtacgtgaaaagatgctaaaactcacatattgtaagaaaatgagaaaaactacggtgagagagcatttactttcagctccgatttgcaacaataaacaaaattctggtaatacacttggagagcatgcggagtatgaggctctctcccatgtttggtaggattctaaactgatacatctctgtggcagacacactcatgatctctgtctctgggaaactaggcccttgagtaatctgcttgaatgtggagatgacctgtcacatccatctaaccaagagaatacaacaatatacaggacatacttgattatgtgtatatgattacactacataagatgtaacttcttttgggctgagagattctcatgcttgcttgtttcgtgacacaggtggtcatatgtatgtgggggtttgggggtggttcacaatataaagagctgaggatgacccctaggagctgaggatgattttcagccaactctgcaagaaaattaggcttgcagtccttaggtgcaagataatgaattcagcccacaaacccagtgatcttggaagaggatcctttcccagttgggcattcagttgagattctagcctcagctgataccccaactgcagccttgcagataactcggctaagtcaagcctggactgctgtttcatagaagcagtgagaaaataaatgtatatagctttactctcataagtttgtgattttttggtatgcaaaaataaaaatctagtaaagcatctatgcagataaattcaatgatatttatagaaagaaatattaataaacaatttgagccaataatacctgtttatggaatgtgtcttccagttgtagtatagatatgtgcaaacatatatgtacaaaatcatttattgtggcaagttttgtaataacagtagtatggaaaaaaatcctccatacacataaataagcatctagtcatatatggatagattatggtataaacactaaggaacattataagcaataaggatagtacgaacatttaaaacaacctccaagattatttttgagtgaaaaatggttttcagaatagtgtgtatgagtatgctgacagctgtaaaatggcaaaataatgcacaacattaagtctgtatatatgtagattatccctggaaaaaatacttttaattgcaaaaaccacaataacttttgcaccaaccgaatagcatagaattggtaaaatgggttgcctctttgaaagggtatgggagactgaaggataaggtttagagtacagtttttacttcattttgtaacttttatatttttattatgtgcatgcattttatattgaaataaattattgtttttaaatgatatgaactagaaatagattttataaaataatggtcttaaacttcttcaagaaactatagctaactaatgttttctagactgtatgactatagggatagtaaattatttgatgattaatgtatttctgaaattcttgatgttgtcaatgttgtttcatttactttttatgtatgtgctgcattatttatttactcaacaaataaatatttgagtgtttgcaagatgttctgcaactttaggttctgtgagaaattcatacatgaataaaataagatccctagtcccaggactttataatctagcaggggacattagagcagcagcaactaactataatcaagaaaatatgtggtcagaaacataaatgaagcgtgagaggtttgtaggcttttacagaaatttctatctcctttctcgtgttttagacccaggaaggagaatacattgaatctgacgctaaagtatagacgaaatatcaaaaatttatgtgcattaaaaaggcatttcgaacagatggcatgagtcaagccacaggtctgtggaaaactgtcagacattcctgggaagatggcacatgggctttctggctagaaggcagagttcttgtagatgttcttgtagtgaaaagcaggaataatggcaagtaagaattttttagtaatgacttgcgaggttccttgaaagaaagaaattttgtttaatgtaaagaaataatgagcaatacaagatttccgagcacagtcatggaacagtcagaactgtgaatcagcaatattattgtgacagtggtattgaagaggcttagagtgagatcagttttggttgccttgaattttgttgttgttgctgttgttgttatatatgacttgtaactggagcaatcatatgaacatatgaaagtgtaactaagtattgttgagttattctagctgaagattttggaatagatatgattttcagaaaagggggggaaggggaaaagagcattttgcaatcagtcaatcatttatttgttaagtaagtgaataatgcagcaagtacatagaaagaaaaaaggtagggaccaacgaatcatgtttgtgaaacataatttgagggacaaaatgagtcataaaagcctctgggggaaatatgaggaagaacctgaaatcttacagcattaaagtgaggtgaggaattcacaaagaaacactcacacgtcataatgaattaacatcttgttgtctgtggtacaattttaatttaaaattaaatgtggatatgagcaatatgaacaaaaacttatatttctgaaaaaataccacagttttagcaataggaaaacttctattaggttaattattactattttgtaaatgatcagtttcctatattacactggaaaatatctaacatcaattcaattttatgttgaaaattatttcagcacaaagttttcaatgtataaacacatctctctttagggattcacgtagccaaatgcatttttttaaaaatttcaaatgtaagactacatggtagtcccaaaaacttccttgcagagctgatttttctatttcataattcaaaatacaaatataaattacttgaatagtttatcaatcatattatgagagaaataaaataaagaattatcaattgttaggtaattttagagcttcttttaacagtaaagggaaaaaaggaaaagattaaaaagaatccctcagcagccttcattaacattcaaatagattacagttgaacttccaatgaatttcatacattcatttgcatgtcaagttttcacagcataacttcttttttaacaaaagataagctgtgcttcaacctctattactgttatcagcgtgtcctatcacagtgccaacgcttttctctcaaggcaaaatgccactgtactctagttttttttagaaattatttcctgtccaatcagctttgcaatcagtctaaattcctactatgtgaaagaaaatctggtaggcatttatttaggaaaggagaatgtagagagcatcttttaatgtgaaacattatgatgggtgttggaaataccatgctatagaaagcagacatagttcctgctttctattagaattaaattagagtgttttttggtagacagacacttcgcaaataactcctgacaaactaaggactatgagaattaagaatgctagcaaggggttgaggaatactaagataagacccattcctgaactcaaccgtaacatcaattgttggaaataagtttagaagaagaattgtttatataaatgttagtgtcatttagagaggtagaaaatacatgagaagacatttgtggtggaggatgttttaggaaaaattatcccagtagcctcccaagtatagcattaagcaagctattttagacattatgaaaaataaatgttcatggaccatttagattaagatactaatgttacatccttgtttaattcattcatgacacacaaagccagacaagaagaaaaagatggggtgagataactttatgatagggtacaagaggagggaaggattatgctaccagaatcctgtgttttccaatgttcataagtcctaactttatgatagggtacaagaggagagaaggactatggaatcctgtgttttgcaatgttcatcagtcctatatctctgagatacaccaatctccactggtggggtaactataaggagaaaactgaggttaaactaaggaattcagcagtcaaattatgcctggaaccaaccaatacagtattgatcaagtatgtcgaccatggctgttacttgcttaccaatgagcttgatgaatagctctaagtctcatattagtttctagtagagcacggggacaaaataggactatcatgtcatcaaacagtggccaatttgggaatgacatagctgtttctctggagttggcatgatcccgaactcacaattgggccttttcatcctttctgtctacaagtaacacttgcatttgccctacctatgttttttcaatcacatattgcattccgctatggatttttaacatgtcttagagattactaagctgctattcatacctactgtatgtctcataagatgcttacttgcttactctctctctaattaacatgtcttataaatttgcctacatctcagactactcatgtgtttattctctatagttagccattcttatgagttttatttatagtatttgtttttcttttctttaaaaatatagtatttttacagaaatagaacaaaaatctggacagcgggaaaagaatattgggttgatttgggatgtttcattttgaggtatccatgtgaaaattcagagaaggcagctgggtttatgagtagtttaagaggaagacataaataaggaggtttgcttgggggaaaaaattggagacacgaggattattatgaagtcccaggaagagaatgtagagagagagataaagtagcctatggccaattcctgatgaacctcaagttttattgccaaataaaagataagcaatggctaaagaatcagaaagaaagtcaggaatttagttctataaagactagcagaagaaacagaaaatgtgatcaacctccacacgaggaaagtggtcacttctggcaaatgagtaaacaatgggtaatgacgaggctccaacattgtccattagtttcgttgtcatggcattcatgtttatgcctgggtaaagctctccagcataatggcaagggaacggagacacagtgaagattcctgatcaataaatgtgtggtgacaaagtggaaacagcagctactctagacgactcttgcaaaaagttgaaaatagaagaaatacctggaggagtatgtgggattaatagaaaatttttttttttcacatgagagaataaggaaggattagataatgtgaaggcaagagatgggaaaacagaagacagatggcagaggtggcttttgtactagatggacaaaatgttactccattggcatagggagtcagaaagaaaggacagggctgatgtgcttcagtttttacatttgctgattgaaagttgagaaaattacaatctgatgatttatgttttctctgaagtagaatgccaattttaaaaatgtatgcctatgagtgtgtttaatggtgttgaggatcccgtcaggttaggaaccataatttaggtcttaccaattatcccaattgtgtgaatttatttttttaattgagcaatcttattaggtgcaagcatagagtagactagtggcttgtctagaatgggaatataggcagatgacatgaagacagatgaatgataatttaaattatcctcaatagagtggttgaaatgatagactttggaatctaagttagaaagaaaatgaagaaaaatgggctgatattcagaaaaactttgtaggttaattggctggtggtcttaaacatttcaaacccaaaatagttccagacgacgacaaatttcagaaagggactataaatagacactgaattgagtgaagtagacattagaaattaggatgatttgaaattgagaagtcagcatgctgggagtcatacaggtgaacagagaattcatgcagaatacagtgtgcattatactggaggtgaatttctaaatgtgagaaccttgaattctttagaattacctattaggtcatgatgtaacatgcttttaaaatgtttctcctttttatgtgctaatactgtgttgtgctttttaacattaatttcataggggttatttgttggatattgtatataattggtgcataatttatttttcttttgggatttctagtattagatttatattggctttgtaaaacggttcagaaaggttttttcctctcttctagacatttcacataaaaatggtcttatttcttccttaaatgattgacaattgaaactgtacgggcctagagttttatttgtaagatttttttgtttttgtttttgagacggagtcttgctctgttgcccaggctggagtgcagtggcgcaatctcagctcactgcaagctctgcctcctgggttcacgccattctcctgcctcagcctcccgagtagctgggactacaggcgcccgccaccgcgcctggctaatttttttgtatttttaatagagacggggtttcaccgtgttagccaggatggtctcgatttcctgacctcatgatccacccgcctcggccttccaaagtgctgggattacaggtatgagccactgcgcctggcctatttgtaagattttttaaaaaatcaaattacaaatatttataggctattctgattgttccatcttctgtctgctgtggtaagttatgtttttgaacaatgtttgctcatttctctagcttgtccaatttgttattataaagttgttcattattacctttttcaggtctgttggatctttggtaataatctcctttcatatctaacatttataattttgtctctcaattaatctagctagggttttaattttttcatcttttcaaataatctgcttatttttaaatttctattgcttgtttgatattttttcatccctgttcattattagtatgtcctttgttctatttagtttgggtttatttttctctcctttttgagcttcttaagaagaaacttaaggttatttattttagaatttctattctaatctaagcttgtaaagtgactaatttcctaataaatacagttttatctgaattcaacaatattcaatatgttgtagttatattttcattctgtttgtaacattttctagtttctctcgttgtatctcctcaggaaaaattgattatctaaatatttaaatttccaaatatgtgtgttttttgaatttcaagaaatattagaagtattccaatatttccaaataatttcaaatatttttccaaatacttaaacttctaaatatttttgtgattttcttgtgagaacacattctttaatatttcaaccgtgttaaatactttaattcttatatacaatgaaaatatgaaaagaacatgtattctacttttaggggatgcagtgttccataaatatcaatcaggtgaaggtggtggataatgtttgtttagattaacagtctttttagatcaaattatttttttgtctagcttttctatcagttactgagacagtggtgctaaagtttccaaatatgactttggaaatgtcagcttgtttctttaatgctgttaatttttactctgtgtattttgaagtagtttgttaatggaaacccatttctgattgttatgtctttttgatgaattcattcttttatcatttcattatgaaatgtccttctttatcttggctgatatacttttcagtgtcatagtctgttttgtgttatgtatgtaatcacttcagccttcttatgcttaaggattgcacaatacatctttcctatccattttcttttaacctgttagtctcttcgtatttaaaatgtatctcctgtagtcattaagtagttggctattacattccatccgttttgacaatctctgttttctggttcattaacattaaatgttaaccgttgacataatttaacttaattctaccattttattctttgctttctttgtcctcccagttcttgatttgttttccccttttttgtctttaaaaatttgaatatatattggcattctaatttacctatcagatgcttatctatacccctttgtgttatgttttagttctcactctagcaatgaaagtatatacttctaacattgcccactattttcttagagttaataattttctcattttacaaacaatgtaggagttttacaatgtgattttataagtaattttactcttctctggcttttatgacatagttgatgtatatacgtttttagtttacatattttttatatagtttatataatttatagttgacatatatatgttagaccccacaagacaatgtcataatttgttcttaaacaaccctttatatatgaaggacattaaaaataaatagtccattgtatttacacacatacctaccttgcccagttgccttcattcctcctgaaattctgggcttccctctggtatcatctttcctcaggctgcatattttggcttactattatggtacaaacctgctggcatcaaattttcttagttttgttttgcttacaaagatctttattttccttcaatctaagaatatttatgccagctagagactatgggtcaacgacactattttgtcttttggttcttgtagatattatcacattgtcttctgatttccaaaatatcttttaagaaatcagcagtcacttaaatctttgcccttatgaaaactggaaacctaacagggtgtaagaagaataaattaagataaagaattcacattaagtttatgcttgtcggtctcattaagacactgtctttagttgcactatagcattattttaaaaactagttttaaataagttataaagtcagtatcctctagttaaaatgcctggtgagtgcatgcaagttttgagtgaactcagtccacagaacttccctcttttctgacatcagctgcagagtttgaggattcccaagaccaccattagatttgataatcttctagaagagtccacagaactcagtgaccactgttatagttatgtattatttcaaggaaaggacacagatcaaaatcatcaaagggaaaaaatacatgtggcagactccaggaagtttctaaacatgaagctccaggctattctctccccacatagttatggacagtgttaagttctcctagcaaagatgggtgacaacacatactgaacactgcaaaccaaggaagcttacccaagatttggtgtccagaggctttattgaagctgcgtggtccactgactacatggctcacctcaaccttaatctccactctagcccctctggaggctgagtggatattgaatgaccaaatcccccactgacacacctaccactccatgagccgcagtattagattttctgtcatggtccaaagaccctaaacaaagacatgtatatcaggcaagacattccaagggcttagagatcacctccttgaagctagggcaaagctcagacttttatttgggaaaagctaaattcttcaccatacagtatatctttctctttctttttattttcaatcagtatttacaggttttatgtctggatcaagaattttagcatcactatggtcaacctatattattaaatatttattagtcaaatgtgtactctgttgaaatttgtccttgctaaattttcagatatttgtatacactattactagttgtacaaataaattcattttttaaaattttagatgtgagaagggaatttatttgagcaatttgggatacacttaggcaaagacaaattgatgaaaaggaagtggttatttgggttgtcggcagcaggtcaaatattctaaaagtgatttaagcagtggagtgaaatagtgaattctgaactctgtgcaagattagagtgaaacagatggaaaacagtttttttatggttatgggagaccaaaggtaaaattagaaataatgatattcctgttagttacaattttttgtttgataattgttgccggaatgagattgagaagtgcagtgaaaatatcaacaaatgtcatgaacttttcagacatggtgagctattataattatagaaggttagactaaataactgatgaagaactcccatttgtaaaattttattagcttgttatataaggacaatttttgaaacgataatccagatacctactttcaaatcccaattatttttaagaagattttagcctaaggcaatgcacttaaattgaccaaatatttattaagtgtgtactatattcctggaaataaagatgtgagattcaaatgaggtttacagatataaaattatgtgagtttttagtttgttgtcatatattaatttatttgtactaaatatttttgaacatttaatatgtgttaagaaatgtcagatttgggagtttaatgataaacagaatgcatctctttctgtctaaaatttcatctccaaaagtcaaaaaacagacagaaacaactgtaccataatgtgatgagtattataataaaatcttataatagaagatcctagatgaactcaatacattctgaacacagaacttacttcagaagcaacggtgtcaatgcatatagtctaaaaagtctcacagttcttaacaaattctacatagttttatctatactatttgatcccaacttagctctacaatcaaaacatcatcattgtcaataatcaaaatgcggcaaaagtatactattagaaacatcttttgtggtagaaacaaaatagacaaaccatagtgaaaagtccactatatttaatactttgtaaacaaccaacattcattgaattgaactaaataatgcccctaacattgctaaatgatgcattagcttaaatatgttcaaaataaatcatgttttgaattcaaagacacacacacaatatgcacaggctgtgtgtgtacataaaataatggttacatttcagtggatttcattctgctccttgaagtcttccaatagcctgaagtcaggaactcccttacttatttatatatatcttcatttgcatttaaatatatataatatttctcttgtattcccttttcaatactcggtaagaatattgcatcaacaataattagtctagataataatttttctttgttaaaggggatatcaacatttttaaaatgcttgttcgaaaggtagggtgttggagaacatttttgcttggcatctatttgaattttgccactgaaactaaacaattagtcatcttcatgattgtatatctagaaaaccccattgtttcagcccaaaatctccttaacctgataagcaacttcagcaaagtctcaggatacaaaatcaatgtacaaaaatcacaagcattcttatacaccaacaacagacaaacagagagccaaatcatgagtgcaatcccattcacaattgcttcaaagagaatcaaatacctaggaatccaatttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagccaccaatgactttcttcacagaattggaaaaaactactttaaagttcatatggaaccaaaaaagagcccacatcgccaagtcaatcataagccaaaagaacaaagctggaggcatcacactacctgacttcaaactattcaaactatactacaaggctacagtcaccaaaacagcatggtactggtaccaaaacagagatatagatcaatggaacagaacagagccctcagaaataacgctgcatatctacaactatctgatctttgacaaacctgagaaaaacaagcaatggggaaaggattccctatttaataaatggtgctgggaaaactggctagtcatatgtagaaagctgaaactggatcccttccttacaccttatacaaaaatcaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattcaactaaagagcttctgcacagcaaaagaaactaccatcagagttaacaggcaacctacaaaatgggagaaaattttcgcaacctactcattggacaaagggctaatatccagaatctacaatgaactcaaacaaatttacaagaaaaaagcaaacaaccccatcaaaaagtgggcgaaggacatgagcagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctggaactggaaataccatttgacctagccatcccgttactgggtatatacccaaaggactataaatcatgctgctataaagacacatgcacacgtatgtttattgcggcattattcacaatagcaaagacttagaaccaacccaaatgtccaaaaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacgctctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataataaaaaaaaaaagaaaaaaaaaacaattagtcatcttaaaagtctcttctagggtatcattcattcttttctgattagaaacaatatgtatgattaagactgctgttaaagtcccataaaatattaatcaaacatatgaagttctggttaaaaatgtccagtgcaggttaatttttgttgctgtccttggccttcattgattgcttcctataaccataacgtttcactagagagaactcatggagaatgtaaaaggagccagtagtgaactggatttgtttccctctatgagaatcagatattcatataaagttgaagagttgttttctttgttttaatgtaaaatttcaattgtacaagtgtatatttatctcctatcatcatgaagttgcatgtattataaagctttttggatacatatttttttcttgttcagtaaaggtaaaaagcaatcttctgcctattttatttacacttcacaaaataatataatttgagcatacactgaaaataacatattcattataatcacaataaaatagaagctttctgtctgaatacagctcggtatgtattatcaagaaaaaaaaacatgatcaggtaccttaaattaaaatcatattcccacggaacattctattctttgagtagtattacatttctttctggagtgctttttagtgatgttattgaatttatatgtctatactactgaaatagcctcctcatgatttagaggagcaaaagcttgcgatacctaactctgtagttcatttaatttttcatttgaatctcagtttatcaaaacattctataatgtattcttctaattgttgaaaatgataaaaatgtaaggaacatgtgcatctcacatacagataatgtagaatttcagtgtcactgaaaaaaatctgtgctttagtgataagtagaaaattatagaaactcttgaggaatttcagctttaattgaatttgattatattataatatataatctgaaaagtccagatgaaataatataatgcaatataatcagaaaaatataatatcataaaaatccagataaaaatagagtatgaacaaattacttgtatatattctagcataaaactaataaaaaatacatttgcagggccagcaactattttaacatgatttctcaatttttaaaaaatgggataaattcaaactcaccaataaaatatagagttaaaatttgaattaaaaatattgtatccaggtggaaaattagaagtattaagtactatttatttgattcctatttaaaggcataagttaaataggaatcaaataaatagttccaaataaacagtaaagcaaaattagagcatatctcactgttttttagaatttcgtttcaccattcatgtagctaatgtcttggattctactgttcatacaaaacatggttactatgtaagttaggattttttagagaaacagaagcaataggagaagtatttatttatctatgtatttatgtatttatttatctattattatgaagtttgggatcacccaattttgcaggctgagaaatctgcagtctgcaagctgaaaatctcagaaaggcctgagaaggggaccaggtggtacaaatcccagaccaaggctgggaggaggctggtgtcccagtgtaacaggcaggctggaaggggaggaatgtccccttcctccactgcttttttccattaaggtcctcaaaggattgaacggtgcccacccacattgaggaggacaatctatttcactgagttcaccaatctacatactaacctcatgtcaacagcatcaccgacatattcagcgatatgatttggcggtgtccccacccaaatctcatcttgaatgtagcgcccataattcccatgtgttgtgggagagacccaatgggagataactgaatcatgagggcggtttctcccacactgttctcatggtagtgaataagtctcatgagatctgatggttttacaaggggaaatcccttttacttggttctcatatttctcttgcctgctgccatgtaagacatgcctttcgccttctgccatgattgtgaggcctccccaggcattgggaactgtaagtccattaaacctttttttctttgtaaattaccagtctcaggtatgtgtttatcagtagcatgaaatcggactaatacactcagaaacaacgtttacttgggcactccacacactcaaggggacacatgaattaaccaccacaatttgccttgtatcctcagttcaggaatcatcagcagaattcttgggtacgctatttccttagaagttaatttatttcatttaagtttctacccaaattcactttagcagaatggacttccctgacaattctttctaaaacattgacccatcacttactctgttttatttttcaaaagtaaagcacttataactatcttgcacagcatgtctgagtttgcttatttagccattgtctgtctccctgcactggaatataagccccctctgagtaaggctttagtctgtttctttcccgtagcagcatcctcaggacatcgttcaggtgctcaataaatatttactgaatgagtgaacagatttgtggttgaatgaaggacacaatgattattttatcacacaggcagtgagctttcttgtatttgaggaccacgtttaattcaacttctccaaactagcaaccaatattcctattactacttttttcaaagccaaatgttacctccactgtgtatccattgaggtttcactatgtcgctcaataaaatctctctaatgaactcagatgcaccctccatccatattctacatttctgcaagttgttgaaagggcgtcttcttttgagaagtgtctgttcatgtcctttgcctactttttgactgagttgtttgcttttttcttgtaaatttaagttccatgtaaattctggatattagacctttgtcagatgggtagattgcacaacatttttcccattcttttttttttttttttttttttttgatatggagtcttgctctgtcgcccaggctggagtgcagtggcgcaatctcagctcactgcaagctccgcctcctgggttcacaccattctcctgcctcagcctcccaagtagctgcaactacaggcaccccccaaaacacctggctaatttttttttgtatttttagtagagacggggtttcactgtgttagccaggctggtctcgatctcctgacttcgtgatccacacgccttggcctcccaaagtgctgggattacaggcttgagccaccatgcccgaccccatttttcccattctttaggttgctgtttgctctgatgatagtttctttttgctgtgcctaagttctttagtttaattagatcccatttatcaatttagtggactgtgactatcagaaatgttctgtgtcatctgtggtacttgcgtaacagttgaacatggccacagaggatacactaccttctgattgaattgatttggactcttgacctaaacattcagagcagaggattcaaattctttcaagcatttctacagtgccttaaatcagcttccgtaccacaagggatcagtaaaatgatgaaaggactgacataatttaacagaaaatgtggtatgtactttcattcaaagaaatactatgcacctattaataatgatgaggtacaacatatgtatttaagaatgacagtaactagaaggcataaattgttattatttctaaaaagtagaatatgagaaagtgtgacctgtgattacttttgttttatttgtgtattatatgttcacatataacatcagaagacatgctccaaaagggtggccatagagatttctgtattggaagatcacatgttctttttaatttacttttggttcatatgcattttctaatgtttttacaatgagtatatgttacataaatcagaagaaaatagtaacaacaccaccaacaaaaataatcagttcttttgtttctgtttgtagtcttctggtctagcatctccaagagaggaaatctatggtcactctccttagtagcaatatgttattagtgtcagcagctaagtgagcctaatgtagctatttcaaactaatgaatggaaatagcagcctttttctcctacctttttcttcttcaatcatactcttcaagcttggtgctactcacatcccctttcatccccctcaccctcctctgaagtcacaccaattcattatgttaataatattcagtactccgtaaacaagagagagtctgaggagctccaataatcagtgaacactttcttttttcctgggagtgccacagtcatgtgaggattatgcagagtagtagcgtttatatggctttggggtgctatgcagggcctggcataagaaggaagaatccagccctttaaataataataaagatgatggaatattttaagaaatatttaatttctcttatgagaaagcaagtgtaattaagaagccaagccaaagtggaataaaagtgagattccctgtaggttaaaaaccaatgtagatgcagggataatgcattgggttttctgatttgttttaattaaattcatgtggtttttatcctccatgaacccagcattttttaagtgagggtaaaactcccaagtttagacagaaacacttgttcataatacattaagctaatcttttgtattttcttagtgacactgtaatattttcctctgaaaaacaacaagtcattgttttattaagacatgaatgcttttaaactgatacattaggaatctgtttcagaagagatgtcattttgttctctaaaattctatgcttatataaatcttttctttctttgatttgtattaatggaggcattgccagatataaaatttcctcagttaggtagtatcctgagtatcctacctgagattttagcaaagctgtggagaaggttcccacattggggaagaagtggagagaccattgttcacagcactgtagggttctggcttttcctatctatccaactattaaattaaatttgagttgatgggagacacgcttttattaaagtgctatgtgattcctcattttgcacccttctgaaattcatgtattgttatttagttttaattttcaaagatatttcattagtatattagctaattaaattatgcagataataaagaatagtagataatcccccaaatacaatcatggcttccatttaataagtttgatgtaggtctctggagtacatttaatttaatctttatgtccatttcataggtgaatgaaataagatttggtgaaattaattcacttgcaattttgcacaggaacttttagggaaaaactaaaacatcattgcagatcagtctgactttgagcctgttcatctcacccctactctatatgaggtgtttgaattttatagcatgttaaaacattttttctgcatgatattcttgacatatacaacatttccaaaacagcaatgaactctcagtaaaaaagggaaagaaaatgggatttgaagacatcaatggaaattcagaaaagctttcccattttccaattattcatccatttcacttccttttcatgcttgtatgaaccattgtctctaatccacattataatgaataatgaacccttaacccccaacaaaagaaaaatcacacacacacaaacacacacacacacacacacacacacacacacacacgagagagagagagagagataaatctctataaacttgatggtctacatatatattgctgtctaaaaaattgtcaagaatgaggatagatggttgaaaatagtagatttttcttaaaataattaatattgcttatgaatcttcagtttggccaagtctcagcaaggacagcttatctgtgttctacgtcaactggaatagctctatgaaggatggaagagccatgatgtctggcaattcagttgaattgggacaactaagtcaatcatgtctgagggctggggggcttaactcctttccacacaggcctatccataggagcagctctatgggctgcttgggcttccttgagactgatgctttggtttcaagtgtgaacatcccaagaaagctggaaaaagctgtgtgaagcttcatgaccatcttcagaagtcacatactgtcacttctcttatatattgtagttatgagagcactcagattgaaggggaggaaggtagggagacaccacttctcaaaaggataagactcaaaatcaccttgtaggaagaatattgtggccacctttagaaaatatcttcaactggtgttggcaattttctttattaagaaaggtaattagtgctttgtgtttgctggttaaggtgatgccagttgggcagcagaaagtacaagtaagtaaaattaaataacagcttttgccacccatttgggctgagatttaaataaggaaatgaaagcagcagttgccaaagataatctaagactgactttttgttcgtcgtgcacattcttttttaaaatcaagttttccctaggtgcagtcttgctgtatatacattttaaaagcatctagttgaaggttgcaagtttttatattcccaacagtacgtgtgttacttctttcaggaatacgcctactggactatatgaatgttatttctgcaaatgtttctttaaatcatacattttctttttaggatagcattgaactgattttaaactgatttcattatgctccacttaggaccctggacgctgcctttcacacctaggtgcttaataatgtgattcggtgatgaacttctattaaaaaacctttctagaagtcaaaatatttcactgtattgtttgggttacagcatttgactaaagtattttttctcttttattcatttaataaatatttattaagtatccccaaggtcacagtttttaattataggctttaggggtggaatagagggaatctcataaatatatgatctttttttatttttgaaattatgtaaggtccagggcagatgatatcatttaaatctaggtattcaacttaaaaatatacaaggctgggcataaaggccatacccttggcctttgagaaaaggggcagtatgttgatgtcactttggaatataagacaattacacaaatggtcagttcagcaagcactgctccacaaatacaatgtctcctataaataccctcctgtcttcatctcagggattctgttctgttactctggtcagagtcatgttttctgtattttttttttttttttttggaacgaaattttgctcttgttgcccaagctggagcacaatggcgcgatctcggctcactgcaacctctgcctccagggttcaagcgattctcctgcctcagcctcctgagtagctgggattacaggcgcctgccaccacgcctggctaatttttgtatatttagtagagacggggtttcaccatgttggccaggctggtcttgaacttctgacctcaggtgatccacccacctcagcctcccaaagtgctgggattataggcataagccaccacgcctggtttctgtgtctatttttaaaattcaaaacacatttttacaatttaaaattattgtaatcactttaattttcctttcatttatctattaaaattggatttgggcaacaaactaagattacttatgagagaagcttttgtgtatttaaaacaccactttcctcactgtttgaaatacgcattttcccacgtatcccatagagaccaatcctgcttaggccactgtgagtgacatgaccattataaattattctttctttaagagtaattttctagaatggctatctaaatccatgtagagtatcaacctgaaagcaataaggttgcatttctctagctataaattaaataattcaattttcaccatatcagtcagacactgagtcttttctccagtccccaagtcagattaatattttgaatttctaatgatattatagtgtctatgttaccccttccccaaagggtctccttctttaatttttgaggagaaagagtgtgtggcttgtctatccctaatccttgtcctgccagtggctcgcctgtgtctacggccagtgcttatatgcagcaactgcgcacatctcgattctgctccctgtgaaggtggcatgctacttcagtggtgtaaggtggactggccatttattttacctcagctgatatgctaagaaagatctttatttctcctacaagcaaattctttttttcttcaactaaaaaaatggtaataagctatatttaattgtttgttttctttttaattgattgtactaaataaacattgttgtacatatctgggcagtgcaggtactgccttggcaccctcctttaaatgtggattatgtttttaacggcctctaaatctttcagtgggagaacatttactcaactggaggttaggtgagattaatgttcttttgcctatattgatttctcttattaatccaaatacacatttttttccttgcaacttatttgaattgctatttggatacaagtgaagttagaatttgattttgtagtgatccatatcaacctgaaatgataggattagagccaatatgttatagtttcataaatttgctgataaagtgggttactgaagcttgtgttgctgttgccatatgttgaattgtttactgctgtagtgaacaatctacatgaactaacggagtctcctgcctatgatggaaaaacaaggtctctagagaaattaatgtggataaaggggttgttattggggtgatgattagatcagagggcaaaagtgggtgtgctggcatttaagatgtaaaaaaaaatagagatcttttgtaaagcttattctttgtacttaataaattaccattatactaaaattcacttgtagaacagggatttgttcatcccgttctccattttctgagttcacctgtccccgtatcttctctaactctattggatacagcctttctcactctctggcagtaagtatatagcaccaacacacacactgactctttacaagcatcacaggttattttgaaataattggcaataaatataccagacgtctaaattacttactaataatttagaatggaaaaggaaactgtattgactcactgaccttgtaaaactcctggagatcgttaaagtgaaataggtgaaaactattaattcactgttaccaggtaacatcagacagagtaagtcatctatccctagaagaactgagttaaaataaaaaattatatttaaaatcctactcttctctccaaatagtaattaatgtggtagggtgtaaactgatacttattttcacacaagctgttttccttaaactgcataatattttcttataaatagttacaaatcttaggaaatatgactattttctttgtttctaaattctgtgtaaataacttatttagctgatttttaaatttctgacttttagacaacagttttgtttcttatttctctaaaagggagcaaacaatccaataacctgaaaattgtcctgctcctttcaacttagcttttgcttccaagtgtgagaaagtaacttgtttgtgcttagggaatactgttgagcaacagttgtctcttttgtccctgtcaaatcaatcagcaaattctgtaaaagatgcagcctagtcaattgcatcaattagggttgtcatgaggtgtgaagttggagacaatgttcacatttgaacagaaacagtgaaaaataaacattatttcagaatgttacgatttcatcattgtatttctaacttgaatttcaaatagaaactacagaacactgtagtcccagctacttgggaggctgagtctgtaatgcactatgcttgtgcccgtgaatagccacagcactccagcctgggcaacacagcaagaccctgtctctaaaaatttttttaaagaaactacaagacaaaagcagaaaaagtatggtcaatagctttgctttctaccattacaaagtgtatttttaacttttcctaagaaatattaattggataaaataaggctaccacaggatgaatgaatgattttattctttgtcagagttttgcactaatatctcaaatcagatataaaaccatatagcaaaatgaattttatcaagaagtggcatgtgttttagaagagtattgtaacatctttgaagtaatgtgcttcttcatcctgacttgggagttgtcttttgagtttggtttatatttatatttatatttaaaataaaatattaatgttatacataacatttacattttagccacaattgcattcattaattttgttttattcaaagttgtgaacgctgaacttaacattaaaaatatatttcaacttgacctgcaattgtgaagagattttctacctgcttccttttagttactttatgccaagtgtggtttggagcacctcatatgctaactcctttaatcccaatcagcattgtgagaaactgactatagaaaagaccgcattagataaggagaaatagacagagaaggctcctcggtcaccaaatgagtggcaaaaatgagatttgaaaccaggcagccccattctggaatctctgtttaatgctaaacagggccacctctcagggtgcagaataattatagctacaattttgtacttcccatcacttggccagaaaatgtaatttctctgcaatagtttgcttaatcctcacagcagacctgcaagataaggaaattaactttccttaaagacaagaaaatgttggttcagaatgccgcatgactgtcccacttgccctaaattatgtcaccgagtgccaagcatagaacagaaattggagctacactacccttagcccttagatgcttcaatcaattattctaaaagtttaaaatgttactattattattttcccttttaaaaagttacagtgcgcgtgaaaaacagattgtgagcagacatcagcaagaagaggatgaagaagcaatggaagctattgttgcaaaccacatgaagggtgccattttgagtaactgcagagtgttgccaggagcaacacccacaaaatgaaagtaattcagtaaattcttataattttttgttgccttgacattcgttttgaatgtggtttggctttctcatatcagaaaaaaggctcagttacccttgtttttatactacacccaaatggctcaagctggtggccagagatgaaaacttacaggttccccatttcctctagtctcgatggattacctggtagcctaacctggccctcatttctgaggggtctgagccctggtcaccatgccatggttgccacattagccaattcatcagcagcagcagttaaagagaagtaagaaaggctccagtgggtcatctgtccctaacccatgcctatttttctgattgtaatacagcagcagtatttccttccgatgatgaggatcaaccactctcgccatgatagtgtctcattttcttgtctgttattcacaagacaaaaagactccaactatttgcaacctggtaatgtagttttcttgtaactttaggttcaatcctggatataacattcagacttacaatagattatggcggggttcacctaacctgttggcttggggagcttactagaagtcagctcatgatgggcagctctggctgtttggtcatttggtgtcccatgttcaagagctccatttcaaccagggcctactagcatactaggtgtaggttgtcaaaggtgtttaaccatttgctgcagctgtatggctagtgcatcagatacctacaaggctgtgttgttacttcccattagagctttgaataaataccacatggtgctattctcccaccatcgatacctctaaagcattggttctcaactgggataagttgccatttatgggaaattggagaatgtctaaagatactttagattgttacaacttgggaggagagtgatatcaccacataatgggtggaggccaagaatgccactaaccatgtgacaatgctcaggccagcccacccaggacgataaatgagccagcctgaaatgttggtagtgccaaggttgaaaaaccctgctcttatgccataggaactaccagcttttgtgactaaagtgtcacttttactccggacaagtcaggatttgtggcagagacctttctgctctgggtcccacataaagctggtagaccttcacactatctggctagtgagcaatggtagtgcccctgggttttggatttgctgctttactaaccctaagaggcctgccgtatgctgtgagtctttccttgtggtgggagttgcctgagccagcaatgattgaacttttatttaaggtaaacagtcaatatgctcttaaaaatttataaaatgagaaaaatatattttattattttcctataagtttatctatttggctttcttcatttctttaaataggctcaaacttccatctggtatcattttccttttgcctgaaaagcttcttttgacattacctatagaataagtcagctggcaacgaattctcagaatttctgtttattcaaatatacttttaatttgccttgattattgaacgagactttttctgcatgtataatcctaagttaatttttttctagcaccttgaagatgtgatttagtatctaatattttttggcttgaatatattctaataaaaagtccgtagtaaatattgtctttgtttagctggacatgtttctgtttttctttcaaatgaccttaagggtttctatcttgttctgtgtttttaggcatttaaagtgttttaggcaatttaaaagttgcctaaagacattgttgagagcgtgatggttatgagcaaaaacaaaagtgatccagtgatgatactgaactttcaagcattaaaaaaatgcaattaaataaatattctacctataatggaactttcttgaggtaaagatagatttgaatctgaagatcaaagagtcatatcacatggcaggagatacaggtgggtggtgaggattccaagacagacctggcaacaaagagacatgtcttggttagatgataaggattcacatattgagggaaatattagtgtggcctcaaaaatagctccacattctgaaaaaggagaaaggcatctattttatttttaacttttattttaagttcgggggcacatgtgtaggtttggtacagaggtaaacatgtgtcacagcggtttgttatacagattatttcatcacttaggttttaagtctagtacccaatagttacctttcctcatcctctccttcctctcaccctccagcctccgataggccccagtgtgtgttgttcctctctatgtgtccatgtgttctcatagcttccacttctaagtgggaacatgccgtatttggttttctgttcctgcattcgtttgctaaggataatgatctacaaatttctgaggaaagtgcatccaaggagttttatattcatcccaattatccttcaaatgttaattcaaaagacattccctctcagtgttttatgattttagggatacttggtaatcaatacggaatataataatgtgacatctgataaaaaatggtacatgctttcaaagagagagctaaggctaaataattgtatttttatatagtacaatgcacatagtatagataatgagagcaagataattatataaataaaattagtttcaatgtaacaaaaggttgaaataagtataaatgcaattgtttctccgtttatcatagcagggagctgggcactaagtagtgcctaaaattaaagattttgatcccttgatttttttgtcaatcattttttttaactctaaggagatcccctagtgactaaaattttacttgataaaaaataatagacatttaattatgaggtgcaccattgccactaaacaacaacaacaacaacaacaacaacaaaaactacaagaaaaccaggacatattatcaaaacacccttgactgtaagaggtactttgatttcaaagagcgtaaaatgtgaataattggaagtctttaactggtggaaaaatccttttggtgaagaaatatttaaccaaagttcagaaattcctttaattctacattaatatctacatattatatttgagtaaccttaagtgtacacttaagtgtaagctctttatttacattaatattgtataatgctatgtatatttattcatttactcctatgtgttaaatgtgtctatctgtcttcctatctctctgtctattcattcatctagctttctatctccatatatatttccagccacagaaaaatgtgtgctaattgcctttatcgcataatagcaaagattgtcttgtgtggttttctctaatgcagggtaatgcagtttttgtttcctttgatttttttccttgccttgaaatttttgtgataaacagctaccaaatttgcaaaaacatcattattcctagaaaaatttctttctatacaggaataacaatataaaaagatgtgtcaccattttttctcacaaggcattagtgcattaagtaccaattgcagagatttgttctgatttgaataggtgtgacccttgcatatctaatttgatgttcagacaatttctttactgtttttgcctcataacattttgagatgtgttcacatgtgtgtggacaaacacatactctttatttccactgttctatatctggaaaatcactgtgaaacaattctcagaaagctgcaaagaagtagcggaatatagagtatagtgttttcaggctgctgaaatgctgatggacatttttattgctttatcttcttgctgatagattgattgctcagtctaaggcaaatcataagaatctctgatcccggttagtcagtcaatgtactgcctcagagaaacgcctgtcaagtgaaggttatcattgataaatgacttctgtgagtaataatcaaactttaatcacaagtaaataaaccaatgaacagataattattggtctacctaattaactttgaatttcagccaaatcaggagggacatgagaaacagaattctcatgttgccacttattaaaaatgcattcctggggaaataatttaacttctcaaaatatcagtcttttcatctacaaaaaaattattgttgtgaagaatagatgagaaaatgtatgaaagcattagcaagataatttttacgtgtatatatgtgtataaacatttattttcttagtgagcactatgtatatgaacttctatctacacaaaccaagaacaagataacattttccattaaccaaagcatgacaatgggcaaagaaaggcaataaatctacttcaggattggcaggaccgccacataaagcaaggaactgcagtggtattcccaccttgagaaaaatggaattacagaaggcgcagagacagcactcagcggaaaactggaccacagcactcactctcctggggacgccatctccaccagccctgtgcattttatagccccaagctgccacattaggacctgctcagaactgtggtattctggcgatctggagaatataccacaaaacaaccagatgagaaaacacatcctcaaggttatcttcaaatacaaaacttcccttaatatttgcttgtatacaaaacattaataacatgtaacataggcaataagcacaagaaattgaattcaggtaggaaggtaaaagctgaaagtattgaggaaaaagggaaataagtatatgtataatacacaaatagataatggaaggaatattatctaaaataaagcagtgtctatgaaacaaagccagaggaattggatagaaaacctaggcagaaataatggaaagaaaaatgaaagaaagcaaagaactacaactctggaccttcattctttccacaaatcttcccacgtgtgacaaaaacattcacagatctttgcacttgtgaactatggcattgttttactaatatgttaagtttatggcaggaagatctggatacgaattctgggcttcacttacatgtcatgtgagtttggagaagtacctaacttctaccacttccatttcctcatttggatatcattaaaaatagtaactcagtgggtcacattgaagattaatcagctaatgcagttgatttcatggtaagcccataatcttaactttagtgttaactttaatgtgttgttagactttaatgtttactgatttgacagtgtctagccttgaaatcagccttctcaattagtcgtcgcatgagtacttattattttcatgaacaatgaactcattacttgtgtgtgtgtgtgtgtgtgtgtgagtgtgtgtatgtttttacccattgtgaagacatctttccttcaagaaggaaaattaaataattactcccaagtttaaaattcctgacctatacctcttccagccaagctagtatatccgaaaatggcagtctgccttcttgttgtgatctgatctagaggggaagaacaaaagcccctttctcaagccctagcttacctgactttcagcagaacagcaacaagagaccctagaaactgttagccacagtttctgcttcagggagccagggacttccctgaagccctccatgtgcagttaggactaaaactcaacttatggttactccttgttcattttaatgctaaaaaatcatacccaaaggaggaaacttaaaatgccaatgctacaggaaatgtgtaaagaagcatgtaaaaccattctcctatgcatgccctgataatacccctccccctaggaaggccctataaaattaactcccacacttctttcagggagaagcccacaccttttccttcctcagtgctgactcccttgtgcacaagctaaataaatattctcttaactgctatacctgatagtcttttctcattatttatctcctgggagactgcaagaacccaagatacccgtaacatatctttcatagattctgcaaatcattattgataacatgacaaaattgtcaagataagaagcttgcacaaaccgttgtactttttatatatatgttgctttgttttctcaatgtgctcctaactgctaatacacagactagtaaatatgggtgctaaatcatgttgatttaattaataaatgaaaaaaatcataaagaacattgtatgcaattcttccataatcaagaatattctgacacatttattatttcaggcttcatttggacttttatgtatttcctgggtaatagattagaacatggttcttagaaacattactgcattattattgtgaagttctgaaatttacacaatatatagggtttttaaaaattttcagttaatttaatagttcctagtaaatagctttatgaattaaacacctttgtggaatatctagctctatctctctgaacaatgtgtcaatgctttttctttcagatattacttttattatttctgtataaaacgagtttcagaactcaacatatttcaaaaagtatatatattttaataaatatttatataaatatatatttcaatacatatatattgaggtttttgttttttcacacatattttgaatattcaaggcacttgatcatatcaacgcaaaaatacttataactgaacagaaaagttttcaccttattctctctccaacagatttgtgtgtctgactattaaaaggctgctttagatttgttttgtgttgtgaattattagcatcttgatgttctttaaaataattagcagggaaaatgtatttagatatatatttacatagaaaaattatgttaaagactacatattatatgcgcagtgtgtgtgtgtatatatatatgccacatatatatatgccataacgaagtaccagatacttattctgtggcttaaaacaacaataatttattctttcaaaattctggaggctagcagtctgaaatcaggatgttggcagggccatgcactcttggatggcgctagaggagaaccctcctggcttccttcagctcctcctggtggcaagctttccttgtaatgagaaggaattgcagccaacaggaggagctgaaatataagataggctgaaacacaagatacgctccttgccttgctgatgcaccactccggtcatatgaccatcttctcccgaagtgtcttcatgtcatgtcatttttacctttgtacatgtgtttctttgtctgagtttcccctttttaagaggacactaatcatattaaattgaggctcacactaatggcctcatttttacttgattttctctgtgaagaccctatttccaaacaagattctattttgagatagtggggtttaggacttcactatgtcatttggtgccacacaattcaagccctaacaatacatttattttaaaaatgaatctttgagcaactatgtctttctctcttgtataagtgaaattactaatcaagatcaagataattttcatcttctaactatctgtgatgattaaagaaattttcagatgggcctaaatatttgaaaacatagcttcattcacatttcttttaaatattagtcatagttttactctctcatcaggttttcctttaaaataagaactgaacataagattcactttcacactggatgtttgataattggcttatcagatcaaattatgtatactttgtaaggaagggacatttttatgcttaaattttcattgcatatggaggatagtccatgcctaggtgacactggccttatgttaatgtattcaactataaacttctcagattagggtgttcaaaggacaacatctgcttgtctagtggtcttactcccaggggaggaatggttccagcaagggacacagtatggcattgtttccattaaaatgaatggtcttcctcgcaaaagcccataagctcattctaatcacaagaaaaacattaaatacgtactgagggacattctacaaaattcctaaccactattcttaaaaactgtcaaggccatccaagcaaagaaagtctgagaaattgtcatagccaagaggaggctaaggagatatgacagctagtgaaatgtggcttcctggatggagtcctaaaacagggaaaggacattaggtgaatattaaaggcattggaatgaaatatggactttgttaatcccatcaatattggtttattagttgtgacaaatgtaccatattaatgtaagctgttgacaatagaagaaacaataatacactggaattctccatattagctgtatgactcttctataaatctaaaagtattctaagattggaagtttattttttcaaaaaaagaaaggtgtaactgacatttggccatattgggctcctcatttaatgaaagtgttattatattggctgcagtaattgacactaattatcaaagaaaaattatgttgctactacacaaatggggataagaaaacatgtctgaaatataagataggctctgaggtaactctttgtactcccatgtcctgaataacaatcaaaggaaaactacagaaacacaaaataatcagcactgaactgctaatggcttagagccatcagaagtggaggatgatttgggtcattccagcacacagaaagccacaatcagtcaaggtgcttgaagacaagaaagaaaataaagcatgaagagtggaagaaaaaagtttggaccaattacataaatgaatattgtaatagttatgagtatttttccttgtttgggtatgagtgtattcatatataatccaacagttttgtcctttctatacacctatcatatcagataagtgtgactagtagctaatcttatcttagtatttagcctaaggcatattaaagggatatatgactcagctagaagccaaccaaacctcaaccaaaggtagataatgtgaccatgtatcctctttggggagcagttagagtgctctcatttatatgaggaatggttgaaacattgcagatggaagcatgattttatttacttgaagattacgtatgataaaaaagagatgtgcacaaatgcttagttgacaagaggtggactgttgtgccattgtactgtgtcaacttagctaggtttcccaacattccctcaaagtatatactaggttagagacagtcgtgaaaaatttaaaggcaaaactgaagtaacggttatcatatgaacactactttggactgctagaggagctgtagctcacatacaccctcactgactgactagctcgcagattccatagcttaggccaggtgctatgcaactttgcaaggttgacattctcttctgcagatcattttcactgtcaatgttggaggcagtcagagacagacacaagtttccctttgttcttgtgggttctgatttgttctcataggtttgaatttttctatgctctttcctgatgcacatccagctttttttactggacccatgacactgcctaccccaggctcaccaatacaccaagacttcttcatcagtttccataatgtgtaaggattaacctctataataaatgccttatttcacattattcatagtagtctgcttctccaatcaattatttatatatgtggttacaaaatacacaaagaaatgttgtggaggtaggagaaattctgggttgcaacaattttacagttgatgagtgcaccagaataggaagccagatgctatgttctgaaggtttgtgtcccctctcccaaatttgtacattgaaatcctaaccttcaaggtgatagtattagaaagtgggggctttggaaggggattagaccatggggctggagccctcatgaatggcattattacccttagaagagaggccaaagaaagactccttgcagagtttgaagacgaacaaatggtgctgtctatggtctgggaagtgggtcctcaccagacactacatctgctggtgctttgatctcaagacttcagaacagtggtaaatttctattgcttataatccatccaatgtatgagattttattatagaagtccaaacagactaggacttcagagaacaaacattaaggccactaattggaaagagaatttggagactagcctggtttcttcttgtctacaccccaacactgaagaagcagaggtgaacaggtgtaacaaataaagctgctagcagtggctggagattcaagggagtgttccaggaagatagtagccccttgaagagacaatgcacactaagaagtggaggtcaaggtgccaacatagaccccaacaggaagcatggtcttcccaaatctgcagaatggtaagaaataagatcctttaatcaatcacatctctacccacagacaaatggacatggattataaaattaaaagaaaactacaacaatcaaatcttactaattacttgaacaaatgcagcatcctggtagaaacatcagcttttactaatagttacctaacacaggactagtcaagaacaattccaaagcatttaaaaaatttaagaaaatgtttttagatacattgggcagattttacttcttagaaagaaaagtgttataaaatggaaacaaacatgttgaaactgtaaacattaatggcaacaagttaagaatgagagcaacatactctagaggatgcagaatgcagaatggagagacctagtctatgtacaagggaagttgactgaattatccatgaaaagttcattctatacttcaaatgtgggaggataaagtgatatcttaagtattctgaggaaaatttaattgggaacccaaccttctgtccagacacagtagaatttgtagaaaaacgcaaataaaatatttttgaatatttaaagtcagaaatacttgccaactagaggatctctcttgaaaaattatttatgggtaaatagttttaagaaaattttaggctaaataaatagtactacttacaatggcagtaaaacttaagtatatgttgaagtaaacgttgccataatttaaaaaatataaatataaaatctcaggaaatctcctaatgggatatggtgggaatagaaaatgcagagaaggtgaaaatatgttaaggtcattttcttattcagaaaaaagatatagatattgtttaactccaaaatttacttgaaaaaatacttttaaataaaagatgaaatgaaacaaggaaaatttgttcaaatcaacaagagaaaacaaatgagaataaataaaatagaaagtatatctggaaaacctgaactaagatgacagaggaataagatcaggtgaacatatgtaatgataattatgaattgtagataatctcaatagttgacaccaacaagcaaacaaacaacctgaacaatagactattcacaagggatgatttttagagcgaaagaattaggaagtttcagaatattgaaatagaaatacctggttgtacgaagaaaaataaaacatgtaatattgatgtccgatgaaattcaaaacaaaaacttttccaaggtggagagattacatctgatcaaaatggcaaagtctgtgaaaactgaaggagggtgttcatgaggtcagtaaataagggtgatgccatcgggagaaagctgaatagacttatggaaagaggtgtcgaagatactgttcttattacgggagtgactgaaaacaagatgaaccctgtccttcctttctgcatagtgaaaagcaagcaacttccaacttacaattcttggagagcagtgccttttgaagatagtccaatctcaggtaaggcatagaatggtgcaaatataccaaaaacatcgtttaatggaagtgagtttgcaggttatcttagaagggatgattttggatgaaaccactcaataacgtaggaaaaaaagttgggtatagaagtacagagtagaatggggcaccagtcctagaaaggtttgctcttggatgtgggccatgctggccttagagaaatcatatttaagggtgatgatttcccagagttaaaataaggcctttcctgtctctccaagtgaccaggcagcagcccctgagatggaggtgaacagaatgcctttgtggaaaggctgtgatgacaaagtggtgccaccttggggaactgggttggcaatctgcatcctttggtggctggcactctcaaaatgacagcaagagtgggttattgctcaaacaatgatcttcactcgctaactctgctttaacaaatattcttgatatgtgccagtttgtagcagtatcctttctctgtagagctgcaaggaaatgtaagtgagaaaaactatgagattcctcttgtaaacatcagcctttggtgaaataaacataaaaagggagaaattagtgcaaaaagttaagggtaacttgttccttgtgcacataggaggggatgtggttaaatacatacacccacatgcactgaaacatgttgttaaactttaaaaaatatgctcaccacatcctctgagagtgcagaggtggttaaaagcaaacatggttacatatatggaggtggaaacaggtgtctgagagatgagaaatttccccttaggcagcatcgttatggtttctcatctagtataatagttattagcagaagacctggatacagactgcagggtgagaatcctggccctaacatgtattagatttgggatacttgtatgcaaaattagcatactgatggtatctaattcataggatgtttgtgagaattagctcaggcaatctaaggaatgtgcttcattgagctcaatgaatgaacaatcaccattatgatgattagtcttttttccccactccttgcttatttgccagaagagaagagaatacacaaatatatacccaaactataaaaccttgaaaaacagtgaaattttaataggaactccaataaaacaaataacaggtatgtaggagagctaataggaagacaggtagatatagatgatatacatacagacatgtctgttaggcataggggcatttgtagtctcatagaaagtttgtcaccagagcacatttatttataaatccacttcttgtcatagattaagtatatatggattagtttaatataccctcttgtgtgactgcctaacaaacattaataatagagctttaaaaacaaatccttcttgagaattttacatttattctgaaaaattcaacctttaaaaagtctagttttttaaaaaagtgttttaaatattttgcttaaaggtgtactgaatatttggattcttttctttacctcttctggaggtaaatataatatggttatgtttctaccagaggttgtttttctaccaggcattagcatatttacttattttctgcgatgacaaataccaggtatttttcctttctctctgtcgctgtctctctcttgcctcattcctcttgctctgtttatccttcttctctgtttatatatacagaaatgtcttaaagattattgcatgttttttcaactagaggaagggataagtatcttaagacacttaaaagtgtaaagtacagataatgtattttgacagcaacagcagagcccactttcactattttttaaactttatttcaagtgtaacaagcatagagaaaagagaaaaatcctaaccaaacagctcaatggattggtacaaactgaacctacttatagccaagaccaggtcattaagtagaacattttagcattcagaactctcttgtgtctcctccccatcactaacatttcactcccctaaaataaaataactattattaattctgaaaagataattttatctgtttatgaattgatataaattgaataataaaattggaattattttgttactggcaacttttataaaatattttgagattatttaatttgttttatgtagtgatcatttgttcttgcaaatacccattagtaagtattccattgcattgttgattaacatttggattgtttctcatgtttgactattaagaataattcagctatgaacatttttgtacctatgtcttggtacacatatgcatacatatcttttctgttgaaagtatatctaggagtggaattgctagggcacatcatatgtttatgttgaacttgaactttatgattgactgacacactcaccaatgtgcacagccaggagaagtgtagaagttccttgttccaaagcttaccttgctctaggcatggtgaataacctttgcctttaatcattctggagcatgggtaatcataatcctgcagaatgcattgatcaactttgtacttaattattgcagggcatttaggtaataatctttggtgcactgtctgattatgtttcttgcctttatttctgttgggttgcctgtcttgtatttattctctggcagtatttgattattctggatatgagtcctttttcagttatgtgtgctgcaaatttattctcctgctctgttgcttacctttcaatctgttaaaggtattttggatgtagggcattcttattttacatagttaaattatcagtatttttatttgtcatgttagtgttctttgtttcttaagaaatcattctcagaagtcctagctagagcatccaaattggaaaagaagatgtcaaattatccttaatcttacatttggaagaacctaaatactctaccaaaaaactattagaaccgataaacaaattcagcaatgttacaggatacaaagtcagcatgtgaaattggtaacatttctatatgccaacagtaaaaagtctaaaaaatgaatcatgaaagtaatcccatttacagtagccataaataaaataagcacttaggaattaactgaagaagtaaaaggtctctacagtgaaaactataaaacattgatgaagaaataaagaggacactcaaaaatgaacagacatttcatgctcgtgaattgaaagaatcaatactgttaaaatgttcatagtacccaaagcaatctacagattcaatgcaatctcaatcaaaatacaaatgacattcttcacagaaatagaaaaaataatcctaaaatgtatattgaagtgcaaaagacccagagtagtcaaagctttcctgagcaaaaagaacacaactggaggaatcacattatgtgtcttcatatcatactacacagctatagtaaccaaaaaagcatggagctgatattaaaacagacacgaagaccaatggaacagaatagagaacccagaaacaaatccacacccctacagtgaactctttttcaacaaaggtgccaagaacatacattgtggaaagaacagtctcttctaaaaaggtgctgggaaaactgaatatccatatgcagaagaatgaaactagatccctatctcttaccatatacaaaaatcaaatcaaaatggattataaatttaaatctatgacctcaaactatgaaattattacaagtaaatattggggaaactccccaggaaattggactgagcaatgacttcttgattaatacttcgcaaacacaggcaaccaaagcaaaatggacaaatgggattgcatcaagttagaaagcttctgtatagcaaagaaaacaatcaactaagttcccagaatgagagaagatattttcaaaccatccatctgaaagggattagtaatcagaatatataagaagctgaagcaactcaattgaaacaaatgaaataatctgattttaaaatgggcaaaagatctgaatagatatttctcagaagaagacatatgaatggcaaatatgttatgaaaaggtgctcaacatcatcggtcatcagggaaatgcaaatcaaagctacaatcagatatcatcttactccagttaaaatggcttttttccaaaagacaggcaataacaaatgctggtaagaatatggagaaaatggaaccctcatacactgttggtagcaaagtaaattactacaaccactatggagaacagtttggagggtcctcaaaaagctaaaattagtactaacacatgatccagcaatcccacttctaggtatatgcccaaaatcagtatatcaaagagagatcttcactcctatgtttgttgcagcactattcacaatagccacgattcagaaacaacttaagtgtccatcaacaggtcaactgattaatggtgctgttcagttcaactatatccttactggttttctatctgctggatctttcaattactgttggagggatgtttaagtctccaagtgtaatagtgcatttgtctatttatctttgaatttctatccatttttgtctcacttattttgacatccttttattaagtgcatatacattaaaaatagtcatatcttcctaaagaactgatctctttacattctgtaattttcctctttatctttgttaattcttcttgttttaaagtccgctttgcataaaattaatacagctaccccaacttgcttttgataagtgttagcatggtagatctttcttcatcaatttacttttaatctgtttgcttctttatattttaaaaaatgtagacaagatagggctgggtcttgattttatatacagcctgacaatctccatcttttaattgttgtacttagaccattaatttaacattattatttatatttttgaattaatatctccatctttataactgttttgtattcattgagcttattatttttcttttatgccttcaccttttaaaaaatattttctagttttaattggtcaattgatggttttattttatctcccctcttagcaatattatttataattcttctaagaagtttttatagagttgtcctagtgtttgtaatacacatttacaactaatctaagtccactttaaataacacataccacctcatgggtagcacagataacttttaacaaaacatcccaattttctccattgggtctctcataacattcacttatttatctctaggtcagttaagaataagaaaaataaagtatttttttacctaatttatttctcctttgatattctcccttcagtttttaaagctttattcaattataacagatatacaaaaacttcacatacttaatgcatacatgtgatgagtgtgaataaaggtatatacctaatataccatcactaccatcaaggcactaaacatatccttcacctttaaaacattttcttgtgttcctttgtgtgtgtgcatgttgttagtgatggtgggaacacttaacaggagatctattcttttaatatctttgaaaatacacactaccatgttgttaactataggtactatgttgtaaagcagatctataaaactactttatcttgcatatattgaaactttataaccactgaacaaaaattccccttcctccctcctctctactcctggcaactacagttcaattctctgcttctatgaatttgactgcttgaaatgcctcatataagtagattcatactgtatttgtccttctggaattgcttatttgacttagcataacttcctctaggttcatccatgttgttgctaatgtcaggatttcctttttttaaagagtgaatagtattctattgtatgtaaataccttgttttctttattcagttatctattgatggacatttatccagagaagacataaatggtcaccaggtgtatgaaaagacgctccatatcactagtcattagggaaatgcagatcaaaaccacaataagataccacctcatatctgttaagatgggtattataaaaataaaactcacaaacacagcaagtactggtgaggatgtggagaaactggaactctcatacagtgttgaagggagtgtgaattggtgcagccactatgaaaaacaagatggagattccacaaaatattaaaattagaactgccaggtgatccaaccatcttatttctgcatatttattccacgtaactgaaatcaggattttaaggagacgtctgctcccccatattcgttaaagtaccttttacaatagccaagatacgttcttctttgctttatgtagatttaagtttctgacacgtaccattttactcctctctgaagaacttcttttaccatttcttgttgggcagggatactggtgacaaatttccacaattttcattaggttgataatggaccaggcagaatataatcggaaaaatagcaacaactttatttatttgaaataagatcatttaaagcaagaatttgtaaaatatgtgatggaaaactgagaagccaaatgagggcaaatgttgccaccagagagaaagcagtgagcctctgggaccgctggactagaggggcaaaagctgaggctggtctttggaactcagaggactgttaaacagggtgcgaatccaaggagcatatgctcctcctgacagagacacggtttggataaagagggaggggaagagacacgctagtttctccctccacctactctccattttttctattggacaattacaaaagtccctggcaaaagaccagggaaacatgccctttcagcagccaggcgtctgttttacagagcagcgtgggcaaaaactgaggaatcaatctaagggcaaatggcctagagacacttaaatattatatttgtttatatttaagatacatttactccttcagaaaaaaatctttgaacacaatactatgccagatgcaattaaggtaggtgctggggaataaaaggactaggaaaattatgcaaatgtttgtaagagtgttggattgttacaaaagtggagagtctgtattgtgtggctctttatcaggggaattaattctagaatctggtcagggagttaaaatactttgctccttcccaccctcccaaggaaatgaactttatacttccatgtgtaggttagttaggggaaaatgaggaaaattgggtgaggaagaaagtcctaagcagaaggaaaaccacatgtgaatgaaagaaggtcagacagtataatccattaggaggttaaagtaataaaattatggcttaagtctcttaagagaatgggagagaatttcctagaacatcagtggtatgcagaggccaggttgtgcaactctttgaaagctttgtcaaaggtttgaatattctcagatgaataaagcaaggaagaaaataaagttatgactggatatagatttttaagggatttctcttactgcaggtggtaaactgaccacaaggcttctgaaagcaatacagaaaacatggcagtggtttgtgaaagagggagtggttcgtgagagaggcagtggctcagaagagatgatgggagcctggactttggagactgatgtaagaaaaacagtctgaatgaattccagaaatatttattcagaaaaataaaaaagagttagtgatgtctgcttattcaattatttagctattcaacaatatttgttgaacaatgactacgtgaagtgtacaagataagctgaagtgaatgagataagcaggagtttatagagtagtttagatatgttaaaatgttactattatatataattataaatatatatcgttatttttgtgttgctataaaggccaaatacgtattttttggaaagtgtttcaatacagaatagtaaaagagaggagattaagattgtcatgtaacatcaattagaattcaaatagatgcacagatttctggaagaattgcattaaaatgatcatcaaaactgtgaaagtggataaaatgcctctggagagaaaggattcccgagtgagagaagaggaggccgtaaaaagatgaaagtgaaagaggataaatggttcctctcctcccccaatgttcccacgcctcactagcaaatcaagacaagatttcagagaaatcttttcattttcctgtcaatgtaagaaatttagatcctcatttgctataataatttcttcaataacaaaagaatgctaggaccatggtccaaagggtggagagaaccagtacatgatcaagggtgccgccgaaagtagacctagttcagagtgcaaatgccttattatggatttcagccaggtctctcttgctctggtgatttccacaccaccttttctctgccctaatcttcctgaattgtcccaaatttgctttttatggttctgtgttcactcatggaaatctaacgatacatgtatcctaaaaattgtgttgaaatgctctaatgtaacaaatatgattcctggaccaggaatcataagttattttcctttactttgatggcactgaaaatgttgcattagcctcactatattaaaaaaaaaagttactcaaaacatcaatattgctacagagcctggagatgcactgtttgccaaatattaaatatcatcatgcatacactgctatgaaggtagaaaatatttatttaaaggaaaatgttttacatctccaataagagaaatacaaaatattgtggaaaattcaatatttttttttctcagctgaagccattgggggattgtggaaagaagacaggttcaactccctgcctggcagcccccactgattgtgtgaactattgcaagttgccgaacttgtttaacctaaagtaatgtcgataagaatccactttcctcatttaaagtagatgagatcagctttttcaactatgtaacccatagcagtgctatgaggatgaggaagatgagacataatatacttaaacaatgatggtgattattattgtatgaataggaactgttatttcaggcatggttatttttaatataaaatgatattacaactataaaacccagttggccaatgttttgtgaaattttctatgccattaacagtctcttgacatatcaagattcgttcatttaaaaagtcacatatttgtgagagtattaatcgaggatattgatttagcataaggttgtggaaagaaagaaaaatatagctggtttataaaaagatacatttgaacattctgccattgcctttaactagtgagcttacctcatttagacaatataagaatatgatacaactttaagcaattactatcaatgactatcatatattaaatatacaattagtaaagaaattttacaatcagaaacaactgtatttctttaatacctaaaatagaccttatgaagactttttagtttcagatggcatgaataagagctatttaaggctggacttttatatgtaataggaaagatgatgctagttagctatagacttattttctgttaaaacatgatcacagcaacaaagcccctagacttccaaaaatacacctagtgatatatctaaaggctgcaataaaaaataaaattcatgtttgaaaacataaaatcagacttttcatctgtaaatattaagcaaaaaagtgatgagttatacaattaaaacattgccttcaatattataaaaagtaaagcatgaatggaataatctaggattcctcattccaagttgttgattaaaatgtaattccatgtccagtagtaaatccgctgtagaaataaatgcgtcttcaataaattcctgctggacaattccaaatttgattgctaagaaatgacacatttacaatgtgattgccacatattatggcagataagtgaaaaatttatcataaatatgaagtacttagagctacaaatatatttttatgtcttagacataaggtaataatagataattatattcatgcaagtgatattttctttttctctactctgattagtaaattcctctaataattctgagtttacccagtgtcctgttagctggatggatttgaatgatgcattctggtaggtcttctaggtattcccaataggctcaaatcaatctgtttctgcacaagaaatgcttgcctaactttcatgtggtagataattatgggcttcagaataaagacaacaattcttaaaacttagctgtgttacttactagcttttccaagttcatacaatgtgtcactcgtaagccaccatttttaaatataaaatgatttgatagtaattttatctctgaagattaactaagatagtatatgtgaatagtcctacaaaatataaactgtattttcttccttctttgttaaaaatttgcatcagacattgtgtgaagctctgagaattcaaatgcacaactctaatactttttttcccaatattttattatgaatattttcaaatatacagaaatagttgggcaaggagcaccatatactccctatctagattctacaataaacattttgctttggttgcattacttatctatacatctgtccatttctcaatctatcttattttgtattcatttccaaataaattttagaaaatatgtttcacccctaaactcttgagcatgtataacattacctagagttcaaatacctatttactatttttctaaaatttacctcaatgaaatgtacacattttaaatatattttttgataatttttgacaaatgtctttctaaaccccaaatcctattaaggtatagaatattactgtcaccccaggaggctttcaggctttcatgtaacccttcccagtcaatctacggccacatccctcctacaggcaaacactgttctgcctttctttcactatagattaaattgcacaactctaattctcatgaagctcacatcctatgtacataaagaacaggtacatacctgctgtgttatacggataccacattattaatccatgtcatctgttgatggacacttagattgcctccataccttggtgactgtgaaaaatactcagtggaatattatttagccttaaaaaagaaggagaacccaagtccctgctagttcattcccctcgcccctctctccattgagttttgtgttcctcagagctcaccttagtctgtggctcatccctctcttcactttcagaggactttacattccaaggctttaattatccagaaaatatttaatagatcttaatttctatttatactgcagacttttattccaaaatctggagttatatagctaatgccctatttgacatttggatttaaggagatcacaggtatcacgactaacatttctgataagagccttgatatttcctcccaaatcaggttttccctcattcgtcaccatttcagtaaacggcaccaccatctaccgtgtggcttgatctagaaacttgacccttcctcatttcttctctttctattagcatccacattacaaccaccaagcagatcagataaccttgtctcgaaattatacctggaatattttcatttattaccttctctgctgctacaacttaatccaaattagtgtcatatcttgctttcagtatttatgcaactttctgtgtttattcttttattgttcctcacaactcccaaatcctcaaaataacaagagtcatctcttgaaaatgtaagctattcatatggctttccaatgaatttagaataaaatgcaaaatatatcacttggcatgcacaaatgtgtatactccattcctattttcctccgcaactttatttttcaccgcctattcatgtaatgagtattctttagttacctaggtcttaacacgcaagcttgttccaactttaggacattggccctctggcctctaccttttcaagtgtatggctctttctcattcattcggttttacaaacacttccttagggagaccttctagaaatatctgaggtagctctcagtgcatgattggtagatgagggttcagcattcctttcaactttcttctaatgtccatttaaataaggcagagggtcgggtgtggtagctcatgcctgtaatcccagcactctgggaggccgaggtgggtggatcacctgaggtcacgagtttgagatcagcctggccaacatggtgaaaccccatttctactaaaaatacaaaattaaccaggtgtggtggcacatgcctgtagtcccagctacttgggaggctgagacaagagaatcgcttgaacctgggagatggaggttgcattgagcaaagatagcaacactgcactccagcctgggcaagacagagagagacttcatctcaaaaaagaaaaaaaaaaaaaaaaaggcagagaaaagaaagccaaaaatagcgttttagaaactctctgtatctaggtgtggccatgagataaatcttagctaatgggatcaaagtgggaggagtgtttgcaactttcgggtagtatatataaaagagaaaaggtgcaggctagtattagcaggttctggcgtaccattttagaaaatgtggatgagtaaatcccttagggatgatggagctgtttactgctgttttgtgaaacacacacacacacacacacacacattcttatatatatatatacacacatatattcacacacacacacacgttcttaataaaaccagtgttatctagggatctctagagtagcatttgatcctacaccttactaatatagccctgccattcttttctgtctctgagctctgtttacttccctcccattttacaattattagcttttttgcttgtcaaatatatattatcactgctagacaagataaagacaggaacttttgttgctatactgattactgaatatccaatgtctattccaataattagttaacaatagacctgcaatacatatttgtgaatgtatggatgaatgggaatggaagaataatttaattgggtaagtactttgaagctattatttatacaattccttcagcttaaaactccagaaatcaccaaaggagagttaattctgatgaaattgactgggccagggtgtctgcagctgaacattaggaggtccccaaataattccaaaacgcaaccaaagtcgaaaatgtctatcatggaagattcccagaaaaacacacttcttcatcaaaactgataaaacattgactactgaggtatttggggatttagcatgcaaccatctatcatattttgacaagataattgatgctatgcatgggcagtagaaccatgtagaaagaagttttgaatgtcgaatagttatcaaagcaataagaatgttgggcaaaatttaaaacaccacaagtaaaaatttatatttagtatatacatattttagttatatgttaacatatactaagccatttattcaaatataatcatgggatggttgaaatcattcaatagaaatgtataatcttaaattcactgagattactcaatttctttaatttatgtaaaatcatgtgaagtacatgggccttggaattctaatgataaaccaaatccagacattgcttttggggatttcaaggataaagtacataaacataatgtatgagaatgcgttggcccgtcaacaaaatatccttctatttttacatagcaagaaaaaaatcatcaattctccagttgaatggaaaagtgaaatatatgtaactccacatatatgtagcacagttgcatacaattgtatacatataattattgtattaacaaagatacataaaattattgaccatataataataattatatataattacatacatatatatatatatatatatatatatatatatatatatatataaaataaccatgcccacttaacatttttatccaactatgtgaaaacatttactatgttgagttgtagggtgacaagtccagggtaatgcgtggatctgtagtatcaagattaaatttaataagtactctgcatgcaaccaaataaacaaatgaaaacaagtagatagaagctgactgtgtgccttgatatcatggatccagactataggatatagatataacatcaacttttggtaaacctttcattttcaacactttgcagatgaattatcatatacattttgaaagaaatcccaatggcactccttaaaatatttctgggttttcaaaagtgaggcttttgcaaagattctcacctctcaatatgtctaattactctctttgtgcattgagacctaccaggctctttcaagattcaaagctaaagttagaaactcaatttcaaatgatatcaaagcctgttctgatcagcactttggtttttaatatacaatgaaatgcttgaaaatctaggcaaattatcatgttaaatcataggcacctgtcaatgtttcagccttttaaacacattttattgcaagttattgagattatagcagttaactgtgaattttcagttttacatttgtatgaaaattagaaacaaattaaatactagagacaaaatgtgttggtttgtttttatgagatataagtattatttggtatcttatacccagtagtgtatctgcatttcatcacttaaagcatttttactttgattcgtctgaaacacaaacacaaacacactcacacacacagtgaaactatgaatggtgatatgactgattaaaaaaatctctgattatgccttggaatcaaatctgtcatttactcaaaagaatcttgttcttgtacataattgcattcatttatgactagcagaacgccattaacatatttgtagtttcttttaatttcagaaaaaaatattgcatgggacatacttttactaaaatttcttctttgctaatctgaagttctaatttaacaagaatcctgtatgttatttgctaaatctgacaaacctactaatggtagagaaactttggaagccactaagatattcatcgatggaatattttaatacagcaaacacatatatagaacttaaaacatgtcacacaccattccaatcactttgcacatttctctagtaaatttcttgcatcttgaatcctattttggtgtgtgcttctcagaagatccgaactaacacagaaaatctctttgtccagcttgtctagaatgttgctcgtaatgttagatatccttcttatgctatgaattaattacagctctataaccatgccttgaaaactctggacaatattggaggttagtggtgtgtgttatccttttcccctctcctaatgatttctccacctgggaaacagactggaattagcaaagcacatttccacctgacttgggtattatactagtgatttttgccttatgtatcatatgcctcgatatttattgtcatgagattttatgcgtttcgtcactaccaatcatcccagatgtaaaataagagtgtgccagaacacctggcaaagtataacagcgatgtttccttaactctgctggggtatccataaacttcaaacactagggggcagtaaggcagtgttattcatttctacagacttgaaacaactctggaagagatttcccaagcagatggtcaagagagctattttgatgaggtttaatttaattattatttgacgctatttcatgttgaaaactacaaaaaattttttacaagcacctttctaaatggttctatcatttgaaattctgtaatttcatttgttattaaaaaataatgtattgattaatttgaagacgtgaggaggaattctttaattgtcaaagaaaaaagtacttgtttgttttcaaaaaatcatcttttaaatgtcatgtagagttattccaataacatagcattctggaaaagcaaactaattggtacagagaacagatttggtgcccagaggatgaaagtggaaggaaagaaattctggagataacgaaacgtctgtattctaattgtggtggtgagtatacaactatagttttgtctaaacctacagaatgtacactagaaagtgtaattttactgtatacatgtaaaaataaattaatagatgcatatatgttgtttgttgcccaacaattgtatattttgatatttattgaaatattgctactagatcatggaagaatttactagcaattaaagcacagttagccttgcatatatcaaacaagggaatttcatatccaagaaagaagatataacagtgcaatataaacagtctatgaaataattaaatcatcatttgtataagatgagtttatttataaaataaaagaaagaaaacttgaaaataattatacgaaaatcctggaaatgacagtataatatttgaagtaagaaataacttttcctaactgattgctgtgtgttgaaatattacttctaagttactaaagattcttttaaattgaatcccactttctagcccaaacaaaatataacaattactgaacaaaaacaaaaacaaaacaaaaatcagcttggtaagcttgtggacttggtcagagttcactgcaaatctaattcatagggattacaccataagacagacaagtgcaattaccatggatgctcttgctgaaagtataaagcatctaaaagaatccacagctatgacatatagaatgcaacagcctaggatatttcatgcctcaaaaataagatgaaataattatgaaaaacattgaaataggtctaaacattatttgtataggaaactattattaaaaggaaattgaaaagtagtcatacagtaatccctagatgtgagaatttaatatttgaaataaatatgttatatgaatcaactaataaacactgttaaatagacactcagtgaattggaaaactgatgtgaagaaatcacacaataaaacactgaaatataaaaagaaaacattagagatattaggtaagttgtaagagatatgaaaagaaaatggacgcatgaggggtgcctgtccatatggataagacagggctatagatgccctcatcttgccacagctcttctaggcctctttagggttaaggcctagggttaagaatttctggtcaaaccggttgtctagcttcacgtcctgtttctatggattgtttgtaaccagcttttgctgcaactgtttctgctgattaatatcttgctaatcataggttatggaaagacggtgtttctgttttaaagctctgttagaaattactgatgcacacactatattgtaaattcttacctctgtataccgtacttctgcatacagatgttatgttaaagaattacttcatccccatgtgaccatcacacctcataatcaaatgaccctaaatccctcactaatctaccctcgccctcactaaacttaataataaatgctggtatatccagtgcatcgttggcactgtgggaccagaaggcagtgacccccctggacccagctttcactatcttgtgtgtgtctattatttcttgacctgctgatccgcctgggaacaaagagagacccccactgcattgtgggctgctggccagatcccacaatactattctactgtttagttttatgagataaacttttttagatttcatgtatgagtgaggtaatgcagtatttgtccttctgtgcttggcttatttcacttaacataatgtcctccagactcatctaacctgtaaaaagtgacaagatttcattcttttttaaagctgaacagtatttcattgtgtaaatataccacattttctttattcattcatccattcatggacacttaggttaattccctatcttgggtattttgaatagtgttgcaacaacacgagagtgtacacatctcttttaaaaactgatatcagttcctttggatatatacccagtagtgggattactggatgttacggtagtcatatttttactttctgagaaacatctatactgttttccataatggctacacaagtttgcattcccatcaatagtgggtaggtttcctttaattcatatcttcgccagcatttgttaccatttttctttttgacaatagcttttatacgtgggatgagatgatatttaactgatgttttgatttatattttcctaatgattagtgatactgagcatttttttcatatacctcttggccagttgtatgtcttcttctgagaaatgtctattcagatcatttacccatttgtaaattagattatattttttatattgagttgtttgagttccttacatattctgaatattatccccttgtcagctgtgtagtttgcaatttttttttttttattctgtaggtcgtctcttcactctgttgcttggttctttggctgtgcagtaacatttctgtttaatgtattttcatttgtctatttattattttgtttcctgggcttttgagttcttattaaaaaaattctttgccaagaccaatgccatgaagcctttcctctaggtttctaggttttcttctggtagttttatagtttggagtcttacatttaggaatttaattaattttaagttagtttttgtcactggtgagagagaatggtctagttccactcttttttatgtggatatccagtttcccccagaaccacttattgaaaagactaacatttccctatgtgtgttcttggtgccttttttgaaatgctgttgtctgtgaatgtgtggatttatttctggattctctattctgttccattagtctgtgtgtctgtttttatgccaataccatgaagttttagttgaaatagttttgtagtatattttgaagtcaggtagtttgatgcctccaactttgtgctttttgatcaggatggctttggttatgtgtgggactttcgttattccatgcaaattttaagattttttttctgtatatataaaaataaaaatatataaaaattagctttggtaatttgatagggtttgcattgaatctgtaggtaactttagatcacatggacattttaacaatattaattcttccaatgcataaacacgaaatatgttaatatttatttgtgttttcttcaatttgttttatcaacattttatagttttcattgtagagatgttctcattggttaaattattccaggatattttgtatttttgtaactattataaatggggttgctttcttgatttcttattcaggtagttcatgttggcatatagaaatgctaataatttccgtatattgattttgtatcctgtgagtttattgactttatttattaattctaacattgttttggtggtgtcattaggcttttctttatattcaatcatgctctctgcaaatagagacaattttacctcctcctttccaatataaatatccctaatttatttctcttacctaattgctctggctaggacttccagtagtatgtagaatagtagcagtggacatccttgtcttgtttcaggatttagaagaaaagttttcacctgtttcccattcagtatgatgttaactgtgggtttgccatatatggcctttgttgtgttgaggtaaattccttctatatctaatttgttgaaagtttttctaataaaaggatgttaaattttatcaaacactattcctacatctattgaaattataatatgggtttcttcttcattctgttgatgaaatgtatctcatttattgatttgcatatgttgaagtatcttcggaatgctggaataagtcccacttgattatggttaaataatattgttgatgtgctgttttatttgctttgctgtatgttttggtgtcaggataatgcacatcttgaagaatgagcttgaaagaattttctcccatttcatttttttggaatagtttgagaagaattgacactggttcttctttaaatgtttggtagaattcagcagtgaagacatcaggtcttgggcgtttctttgatgggagatttttaaatttttaactcaattctattatgtgatattggtctttccaggttttctacttctctgatattcaatacgtgtccaggaatttatccatttttctaggtaatctggtttgttgggttatagttgctcataatgttttctaatagcaaaaatatggaacagtttacaaatttgtatgttatccttgcataggggccacactattcgtctctgtatcagtccaatttaatatatgtgccgctaaaggaagcaagcatcatacatacattttagatgatagaaacctaaaagaaatggaaaactccaaaattatccaagaaaaagcttattcattaacttcaaagattaaaaataagatcgattgctgacttctcaaaaatgattaaagccaggacaaaatacatttaaagtgataaaagaaaatattggctaacctagaattctaaacctttttaaaaagtataaaaatgaaggcaaatattgtgtaaaataatggattacatcctttataaaaggcaaagacagactgaatacctagtttatcttaaaagattaaaaaatgtgagaactgaatgtaatatgaaatcctgttctggatacttcacaaaaataaatgtgaaaatccaacaaaaagctatagcagtcatgaattcatatgtatctgcagttagaatgcaaaacatataaagcaaaattcaacatatttcaagccacaataatagtgcactatctcatttctttcagaaaattttgtaacagtaaatgaaaaacagactacatgatattttgaatattatgttacattatttgaattattgtaactgtgttatttgaacacagttaaaataagcaatctccattgcatttgctagaagggattcctctggctactatatccctccttcatatattttcattttccgaggcagagagacatataagtttaagagattgggagggaaaaccgagcagccttcctcaccttttaaggatctatctgcatttagagattctacactctgctccattgccctcctttatgccatactggttgagtgaagccctcacagtaaagcagcattgccagtgattctacctgtgtaagtctgcctaattcaggagtcatatactagtaagccattgccaaggacaactaagtcacatttctcatggtcaatttaacaattataaactagctttttgtctctacttgcctgtctgtagtgactacctcttaactggctgaaattatggtagtgggaaaaagaagtgctattgtgtatgggatccttatgatcccttttcacatttataattatatcattctacataataatttaaaattcatttttaagcagacaaaactcatgcgctataatagaagtattaaaatttcaatgaatttacttaatattgaatatgccattggatcaatgaatttgaaaataccaataaaatgattgcaaaaccatagtaaaagaaaaatttcactgatgagtaaatcaaaattattttgaaaaaacttccacaaatcttatgtgttaaagaagaaattaaaatagattatgcaatatttaaagcacaataataatactgcagattaaaatgtatgaagatcaagatacctgagtagagttattcaatgcttctcttttactcaaaaaaggaccaaaaacaggaaatacataactgcacttcaagtagagtggctaaaagcagagtaaattgcagaacacaagaattcagcaagaaagtgacaagattctctggagtacactaacttagggtaacagcatagagagggaagtgaagcacccagccaggattgtcccagagctaggatgagctacccattttgggaaaaatgtaagcaagagacccccagcagtcctgattacaactctgaatgcctccaatactagcttcatgagagactcatagtcctcataggccaagctcaggataaggagctgcctagagttcagatggctgtattgctccagagagggaactcatgctgggtctgtctcactccttaggatctaatctgctgtggtacatcattttgaaagcagagtcactgctgaagaacattctctcctagggcttattagcccctgcatctccacatccctagagtcctactgttttctcattatgcctacaaaaatggatgtaataccatgactccagcttgaaccagcaattgtgacccttcctgagcccatgcagcatcatttgccccaaggagaagtaccatgcctgcctacttacctggggagccaacaaccactaatggtgtcaaccacaatccctcaattggtacagtagctaagcactgtgtgtgctccctcagagactgaggagagacccataggagttaactgctgctggtaaccctaaccctgtgactggtagcaccaaagctgctgagggtggtgtatatgctcccctgggtctgatgacaggcccacctggtggttgctggtggcagtgaccaatcccttgctattgatagagctgtggaatgctacatgtaacctattcccctagaaactaatgactatccctcttgttgactagtgctgctgatgaccccaactcagcaaagacacactaatgccttcacaaatgctcacagtctaggccactgaggaacctgacgacactgatgactggattacaaccagtaaaatcacagagaccacactactgcacctcctaagcactctacccaactgcaacaatagtcacatctatagaaaaaggtcttcacttatgaaagctattctgtaaaattgaaaaggcaattgtgtggcaaggtgtgtagatatcaacataggaccacagaaatataaaaagcaagaaggtatgacacctccaaaagaaaacagtaactctgtagtaaacaaccccaaaggaaaggaagtaaatgaaatgcctgcaaaggaattcaaaataatgatactaaggaaactcaggaagatacaagagaataaagagagaaaatccaacaaaatcaggataacaatttatattatgaatgataaattcaacaaaaagataaatatcataaaaaagaatcacacagaaatcttggagctgaaaatttaatgaatgaaataaaaaaggatcaaaaggatcaacaataaagtagatcaagcagaagaaagacattctaaacatgaagacatgtcttacgaaatgacaaagtcagtttaaacaaaacaaaactaaactaaaaagaaaagtaaaaagaaaaaactaaaaagaaaagctaaactaaaactaaaaagaaaaaatggtaaagaaagtctataggatgtatgggacaccattatgataagaaatattcatattttgggtattccagaaaaagaagacatgggaaaaggcatagaaaacctatgtaataaaataatagctgaaaaattcccacatcttgggagaaagatggacattcagatcaaggtagatgaaagatttctaaacaaattcaacctaaagtaccctctaagacacattattgtcaaaatgtcaaaagtcaaagacaaagaaagaatctttaagtagcaagagataagcaacaagagatacaaggaaatcctcattagcgtaatatttcacagggaaacacttgtaggccaggagaaaatgaaattatatattcatagtactaaaagaaaagcaaaattctgccattcaagaatactagacccagcaaaggtgttcttcagaaatgaagaaatgaaggctttcccagaaaagcaaaaactgagggaatttattaccactgggctggcagaagaaatgcttaaaaagtcttacatctggaagcaaatgggcagtaactaccatcataaaagcacacaaaagtataaaatgcactgatagagcagaaatagaaatgagaacgagatgagaatcaaaccttaccatcataacacaaaatcacagaactgcaaagatgaacaataagaaaggagaaaaataacaaaaaatatacaaaaaaatcagaaaacaattaacaaaatgacaggaataagtccacagctattaataatagtcttgaatgtaagtggattaaattccctaaatataagctataaaccagtagagtggattaaaaaagcaagacccaactctatgctgcctaccagaaactcaccccatctttaaaaacatacataggctgaaagtaatgggataaaaaagatatttgatatggtttgaatttgtccttgcccaaatcgcatgtcaaattttaatccccagtgttggaggaggggccttatgggacgtgattgggtcatgggggcagattttccccttactgttctcatggtaatgagttcttatgagacctgggtgtttaaaagtgtgtagcacctccccctttcttctcttcttcctgttctggccatgtaacatgtgcctccttgctctttgcctactgctatgattgtaagtctcctgaggcctccccaacaatgctccctgtacagcatatggaactgtgagcaaattaaacctcttttctttacaaagagtatttctttatagcagtgtgacaatagacaaatgtaatatttcatgccaatggaaaggcaaaatgagcaggagtagctattagataaaataggccttaagtcagaaagcattaaaaaagacaaagaaggtcattaaagagatgattttagcaggagtacataatacttgtaaatatatatgcacccagcactggaacacacaacaaaaaaggcaaatattattatatctgaaaagagtgatagattgtagcacagaaatatttggggacttcaacactttattcatagcatcagtcagttcatttagaaagaaagtcaacatggaaacatcagttgaaactacactatactatagaccaaatggaccaaacatttccttcaatagctgcagaaaacacattcttcccatcagcacatgaaacattctccaggatagatgatatattacaccattacccaactttcaaataatttggaaaatccgaaataatatcaagtaccttttctgcccagaatgaaataaaagtagacattagtaacaagggaaacctaagaaagtgtgtaaatacatagaaactaaacaacatgctcctgaatgacaaatgggtcaataaaaaaattaagaagaaaatttttaaaaaattgaaacacattaaaatagaaagacaacacacaaaatcttacgggatatagaaaaagcagtactaagagggaaatttataccaatgaacacataaaacagaaaatagaaagatttcaaataagataacaatatgtctcaattacctagaatgaactaaattcaacatcactagaaggaaataaataataaagataagacagatatctcccaaatggagactagaaaaaatacaaaagatcaattaaatgaaaagttggttccttgaaaagataaatacaattggcaaaccattatctagtgtaatatttcattcttgcattggcacaacgacatacctcagactgggtaatttatacagaaaagaggtttaattggcttatagttctgtaggctgaggcctgatgctggtgtctgcttgggtactcgagaggtgcaggaaacttacaacgatggcagagggtaaaagggaagctggcacacacatggtggcaacaggaacaagaaagagagagtgagggggaaggtggcacacacttttaaatggccagatctcatgagaactcactgtcttgaggaccgtgccaacagggatattgctaaaccattcatgacaaatccacccccatgatccaatcaccttccagcaggctccacctccaacgctggaaattacaactggacaagagatttggtgggatcacagatccaaatcatatcaggtaagataactacaaaaaagaggagccgaataaacaaaaacagaaaaaacagagacattacatctgataacacagaaatacaaaggatcattggtaactattatgaacaactatatgcaaacaaattagaaaacaaagaagaaatagataagttcctagatacatgaaaactaccaaaattgagctcagaagaaatagaatatctgaacagagcagtaatgagtaaaagattaaattggcaatataaggtctcccatcaaaaaaagccaagaaatggatgggttcattgctgaattttactaagcttttaaataagaactaacatcaattcttttcaaactatttcaaaaagtcaaatgggagaaaattctaagtgtattctaggaagccagcattattctgatgacacaaccagagaagcgcacaagagaagaagacaactgcaggcaaaaattccttatgaacacagatgcaaaaatcctccacaaaatactagcaaaccaaatccaacagcacaataaaaaatgtatacactgtgattaatagggacatatcctagggagccaagatggttcataatatgaaaatcaaaaaaatgagctacattacatcagcagaatgaaagacaaaaccattacaatcatcttaacagacacagaaaaagtgtttgataaaatttaacatctttctatgataaacactctcaacaaattaggtatagaagaaatcttcctcaacacagtaaaggccatatatgaaaaactcacagctaatatcacactgaatgtgaacaagctgaaagactctaagaactggaataagaagaggatgcccattttttaccactcgttccacatagtactggaactatgttgccggagcaactaggcaagagaaaaaaaataaagggcatccagattggaaaggaggaagttaaattgttcctgtttgcaaatgacttgatttatttatagaaaatcctaaagattccagcagaaaactcttacaattgataaacaaattcagtgaactggcaggatacaaaatcagcttacaaaaatacgtagtatttctgtacacgaataacaaattatctgaaaaacaaatcaaaagaagcaatcccattcacaagaactacaaaaaaatctaacagtaaatttaaccaaagaggtaaaagatcactaccatgaaaaccgcaaagtagtgatgaaaaaatagaattggggaggacacacataaattgggaagacatcctatattcatagattggaagaattaatttgttaaaataagcatactacccaaatttatctatttgaaagctaccgctttcaaattaccaatgccatttttgtcacagaaatagaaaaagaatcctaaaatttttatggaaccacataagtctccaaatagccaaagcaatcttaagctctgctccccgccaaaaaatacaaagctggaaggagggatcacaatacttgacttcaaaatataccagaaagctattttaactggaagagtataagactggcataaaaacagataatagaccaatggaacagaacagacagcccaaaaacaaatccgtatatatggaaccaactgattatcaacgaatgctcaaaaaacaaacactggggaaaagcctgtctcttcaataaatggtggtgggaaaattggatattcatatgcagaataattaaactagaaaccttctctccctgtatataaaagtgaacccgaaatgcattggttatttaaatgtaaataattaaaactgaattatttacacttaaatatgtagctatgaaactaagagaagaaagcaggggacatgcttcaggacattggtctgagcaaatattttacgcataagaccttgaaagcacagacaacaaagaaaaaaatagataaatggggatatataaaactaaaaagctttcacacagagaaggaaacaacagaatataaagacaacctgcaaaatgagagaaaacatttacaaacctttgatccaacatggattcatatttagagcatacaaggaactcaaactactcagcagcaaaaacaaaataatttcattaaaaattgggcaattgatctgaatagacatttcttaacccattaatgccagaagttacaattttgtgtgtgtgtgaaaaattagaccttggcgatgaccttgagcagtaggatataaataactcccgctagcttagcgttccaataatgaaacactaggcattaagagaagatttagaaatgaccattgagtatataaggaaatgctcagcttcactaatcatcagggaaatgcaaataaaaacgacaataagatcatctcaccccaggtaaaatggctattaccaaaaagattaaaaagtaacaaatactagtgcggtgtggagaaaaggaactcttacacactgttggtaagaacataaattaggtcagctattatgaaaaccatgtggagggtcctcaaaatgttaaaaagataactcccacgtggttcatcagtctcactactcagtatatacccaaagcaaatgaaacaagtacatcaaacagatatgtgcagtctcatgtttattgcagcactactcccaacagccaggatttgaaagcagcctgtgtccatcaagaaatgaatggataaagaaaatgtagtatacaaacacgatggaaattcttaagccataagaaaataatgaaattccgtcatttttggtaatataggtaagtctggaggacatgttaagtggaataagccgggaacagaaaagacaaatactgcattttcttacttacgtgtggaatctaaatagttaatctcacaggagtagaacatagaccagtggttaccagaggctggaaaggggactgggggatagggagagttggcttaacaggtataaaattagagctagataagataaataatttctagtgttctatagcattgtagggtaagtataattaataatttgttgtatattttcaaatagctagaagagaggatttttattcccaaaacaaagaaataataaatgtttgaggtgatggatacaataattaccctgatttgatcattgtacattgtatacttgtattgaaatgtcactctgtaccacacaaatatgtacagttatatatgaattaagaagaataaaatgtgtggttgcagaagctggattcatctattactctataatggatagctttctacttagatcaaaccacatttttgtacttttgatcatttccttcatttttttcttgtagaaaaagtgatagcaatttatatgaagaggaataactttagagttgattggtgccagttgtagatcactaatcagctgcttcaaataggaaaccagttcagtctaatgtttaattttttccatccagtttatgaaatcaaagtaaaactgttgaaatgtatcctcctgaaggttaaatataaaaaattctgagtattattctataataaatttaaaatgtcaacactgaagagaaacgattaattttctggtgacattatgaatacaaatgttgataaaaacggttttctaaagttggagatctgcttgcatttggatgtggtgcacacatcattcataattacattcatactgtcagaaagcaaaatgtgtttatcgcaaaaaattataattgccaaaatttgtaaatgcttgttcgtaggtacagaatactaaattacaaaatcttatgataatgctgatgttgaatataaaaaatacttcagaatggcattatatgttttccctctttgttgcttgtcatcaatctgatgctgaaaaaagtctgagcctttgatatctattttgtaaaccaatgtaagttttttatcacactgaactctttataaacaaatactctaaattttggctgtacattgttcacaactagttggaatttgtttgttctcttttgtttatcaaggtaatatgtatattaattttaagtgtccagattggtgaattttggtaattgtgtgaaatcatttagccaccgtgattgaagtagagcaattcatcaccacaaaatgcttcctcatacttgtatgtattccataatctttcttcaccctcactccaggcaacctttggtttgctgttggtcatagttttacgtgttatagaatttcatataagtggacttatagagtatggagtcttttatgattgacttatttctcttaatgtttttgagatgaatctgtgttactgtctatattgtctatattaatatttcttgtctttttattgctgagtattccacagtatgaatttaccacactttgtttattcatttaatagtgatggccacttgtgttgttgccagtggggctaatatgaataatgctactatgaacatttatatacttgttttttgttggaatgtatattttcaattctcttgggtaaatacctggaaggagaatttctggattatatagtaatgaatctaactgtataatgtaatgtcgcacgcatcactagttactgtaccattttgcattcctacaagcaatgtgtatgagttccgaatgcatcaaatccttgtcaacacttggtagtgtcagtctttatgactttatctattctagtatgtagtgatatctcactgtgattttaattgacatttttctgctaataaagttgaacaccttttgctaaaacttctaaaaaatgataaaatttctcatccacattaaaataacatttaaacctaagtgctaagtgaactttttaaaatataagcaaaaaaaaaagaaaaaaaaagaaaagaaaagaaaacaagaaaaaagtttgaaaataagtatctgaaaatagggaaaataaatcataataacctaaaaaaatgtaaaagaacgggtataatgaagaggagaaattactataatagaccaggctgggaaacatagtgagaccccatctctccagaaaaagataaaattagccaggtgtggtggtgtgcacctgtcacagctactccaggaggctgagttgggaggatcatttgagcctcggagattgaggctgtggtgagtcatgatcatgccactgcactcaagcctggatggcagagcaagaccctgtctcaaaaaaaaaaaaaaaaaaaaaaaagaagaaagaaacagaggaaataatataataatatagaaagtggtacctctaaaaacatgaaaagaataatgcaagagaccaactttaggaagatgtaacaagttaaaatgaaagagaaaaataacacagtgaagtgacaggaagactgacacacgcaggaagtgaaaataatgatatgagcgctacatgcattacactttaaattttaaaaatgagaaaatttctaaaatattataattaaaaattactcaaattacccagaattaagacaacatgattagaccagtaaacataagaaatttgattgctactcaagtctcatcactcttaagacaggagacctagataatttacaggaaagtttaaccgaaacatgaagaaaacataatatatcatttaaaatctcttatagaaattagaaaaagcaataattctccctaactcaatttctatagctagtatattatcaatatcaaaaaccacacaattaaaattcaattaagatgagcactataaggcagcaatatctttgcttatttatatgaaaattctaactatgtgagatgatggaaatgctagttggcttgattgcctgtgatgatcatttcacaatatatatgtatacaaatctatcaagttgtataccttaatttacacattttttgtcaaatatacctcaataaagctgcaaaaatctaagtaaattatgaatgaacttaatataacatttaacccaatacaatgattattgtggtttattatagccatgcaagtttgttttagtgttagatagtcataatagcatcaggctaaagtagaaaaacaaaatgattatctctgcagggccataaaaaagtatttcatgaatgcgtatttaagaaaatttggctaagtagaacagaatgaaatgccattgaattgattttaaaatcttagcgaactagtaacagaatgaaactccattagtaagtttctctcaaaatcctacagcaagcaatgtgcccatttatgaaaattattcaaatctttagacataaagtcaaaggtggctataagtgtgtattagttcattctcacactgctataaagacacatgtgagactgggtaatctatgaagaaaaaaggtttgactcacagttccacaggctgtacaggaagcacggctaccgaggccttaggaaatttataattatggcagaaggcgaaggaaaaacagtcactgtcttcacatggccagtgggggacagacagtgatgcgggaagtactccacacttttaaacaaccagatctcgtgagaacccactatcatgagaacagcaaggaggaaatctgcccccatgatcaaatcacctcccagtagttccctcccccaacattgggaattacaatttgacatgagatttgggtggggacacaaagccaaactatatcaaagtcctttcaattccattggcttattcaaggactattttattattaagaagaatgcacctatattgtcttgttttccactaactgattagagctcagagactgaaattatgtgtgcactcatagattactgtctatagaaaaggccatccccaaagtaaaaatcttctgctggtagggcatagggcattgactagctttgtttctacatgtaaattcattttaggcttacttcattttatatatatatatatatatatatatatgaatttacttatgatcctaacctaccatttggcaggttttgtcactgattaatgaattgaataaaatgttgacacatgttcttttacatttgtgtagaagccatggttttaattttagaaaattgtaccttatcagtacttaaaatagaaactttagagacatttacacttaagttgagaatagcacatacatgctagcttcacctttattatacaagattaaactgtaaatttatagttctgttcatttataaacatttatataaaataaataaatgaacaattagataaaagatttgatatacaggtgttcattttgaaatatactgggcccactatcctcctggcacaaataaaaacattccattagtccaacggctatttattatgtcttcataatatgcaaaccacaaccatggagtttcatccaaagtgtattcctctattagcagtgactttaaaatggaatagcttacgtattttataatatcttgaaaccatggataatttaagttgaaaaaatttacatctttaatagaaattttgtcatcacttaattcattttacagatatttgtcaaacggtctttctgcatcaggcacttgctattaggatgatggccaactgtaagtacctcctttaaaaggaacatagtctgatccagctggttgtttagggaaagctgacagattgattacaactacaagaagatttgaaaaccactaagtgtctgtgttccaacaacttgacttctaatgcttcttattcaaaaaaaatggtaaaaccaccaacacaaatgcccatacctgaaacctagagctcatgttgacattcccttcatgatcctttcaagacatcaacatttcccacattttaccacttctctatcaaccttgtagaaggctccatcaattctagccaggaaaaccaaatggattttctcaagaagctgaacacacagccattggaagatcttttaaaagtaaatttcttgtgctattatctaactgaaatactaatcccaatgaaacaaaataagcaaaagaaaaactctagaatgtgtcaatgtgtacaatggtaataataaattaaaacatctagttttctcataatgatatctatcttattctgctcaaggtgtagaccatgaactactccttgtccttaaaatattcattaatggtccaaactagacaggtatacagaagttaagagtaatattttagaaattgtatagcaatttgatactgttgtgattatttctcttattttacaaaagcatcttgctggagagagtgaaaaagatttttttttaaaacaaaacagtatttcaccaaatatattttaagaagcataatctagcttataaagctaccaaaattttgttagacgatagcaaaaattgccagtttaatatgttttacaagctagacattcaataaatatttattttgactcatattctcatattatatgtagaaatattaacagccttgagtgttctatctttggaaatagtcagggaaacacttcataaccaccagtccagtaagaattcaaagtatattggagataggcttatataatcttacatgtcttccagttttaccattgtacataccaaacgataatgtctaagcagtattttcatttatttttcttatatttctttccaagtaataaaatttgcttcaatttatgtacataacaactgcatatttaagctttggtggtagcatacaaattgggtttatttgccaaaaagggcatatgtggtttatcaacatttctatgagttcttattacgatgaaccaattgttttcacctttctaatgagaacactcacatgtgaatttgttaggttagcttgatctgtaacatagacatctgttaaccaggaacaaaaatctgtctgggtcaggaacccaattattttcacactttcttcttcagaactgccaaacaatgaatatttttgatttctaataagaaaatagacatttaaccaatgtttatttagtttgtaataagtttcacctttgccttgttttccagcttatatcttcccatttcattctactaatttgaattgccattgttgcttcaagcttgaatgcatttactttttcttactgttggaaaatgaatccagctagtcctggcactgtgtactaggaacgataatgcaatacataatcagggtattgctttttattgccccaaagggatttatttccttattaaaaattaaaggtagcaatacgatgtttccttttaagtaaaaatatttttatctcagatctcagtcacactgagtacatatggccgttatttattataaatcagttaccatatagtaattgaaataagagtgaggttaagaagtctaaattcatgtcacacgttccaaggagagtcaaattttagatgcaaagtgaagattttttatacggacttataatgtatatctgtgaattagtcaagaaactttcatggcattccttgcgtgcacagtactgtggaaggcacactggaaggtataaagttactaaaggtgttaccagccattcaatttgtaaaatgagaaatatttttattcaaatgaaaatggattttgcagggagtctcctaggtccatgcacagaagatatatggtatcagactcggtaaaagagagaaatcaaggtgggaatggttaagtaactttttgcagcagataagactttgaagaaagagtaaaatttataaagaatttttagtcaaatgaaacatttggtatgactctgtcagaaaaaggaatgtctaacttctaatgggataatatcaagtatccttgaggatatagatacacatatagatgtctgaagattttttcattcaaccacctactcttcctgtatagactctgcattccttaagtgaaacacaacatagacaagtaaaaatatgacaataaaaggtaccaaatttagccctgaaaagtatccaacttaacttcaaattttgatggtataatttgtccaaacaataacatacccttctagcatgtttgctagaagcttgcagcaatgtcttatttgatccaccccaaatcttgaggtttgatgttgttacatatattttgaactttccttcttatcacttattttatgtaggtgggaagattatcaggtttttttcacatgtatggtgtgaaaagtgggcattgagagtaggtttttaaatagtttcaaaatactaagtatttttaaaaacagctttattaagatataattgacataaaatctgcccatttaaaggatataattcaatgatagcaatccagcataatctaattttcaaacattttcattgcccctaaagaaatcctgtaccctctagcagttgctttccctttgtggctgaccattctagccctaagccatcaccagtctcctttctatatacatagacttttctgttctgaacattttatatgagtgaaataatataagcatgatcttttatgactgacttgttttgcttagcatgatatttttaaggttcatccatgtcatagcatgtgtcagcacttcattccttgttatgactgaatatcttatgatgtatccaaggtgtggatgcatcacatcttgtttatcctctttcatcagttaatgaacatttggattgtttccactttttggctattatgaataatgctgtgggttaaccctgaggacattacactaattgaaagaagccagtcacagaaagacaaatactgcatgagttcatttacatgaagtactatgacagtcaaactcacaaaggcagtgtggaatagtggttgtcagggggtggaggagaggaagaaacggggagttaataatcaatgggtatgaagtttcagttagcaagatgagtaagctctaaagacctgctgtataatatggtacctacagtcaacagtaatgtattatataattaaaaatttaacacggtatatctcttgttaaatgttcttaccaaagtaaaatatcttttagaaagaaaacaggtccatacaaacacttttacatgaatgatcattactgcttaggtgttttttttttttgttttttgttttttttttgatacaatatgctgaaatagtgaccgagtcaatataaatggtactgtagggttgagggaaatttttaaagaaaaggttaacaggaaaatccttgaatgaatccagagaaattttcttttgtgtatccttgcctctgagaatctgtttcttcaatgagaaataatggtgtagggagcccacttagcgcagccaacagcctgtcagtctcataatcttaaataatggtgaaaaacagataattttttaaataattaaataatatggaaaacagattctagaggatccactaacgtatatcactaaatattagcccagaggttagacatttatttttcatctagaataatgttgtgtaacttttataagtgaaaatattattcaatgatttagtatgtattgagttatgatgaataggattgttagaacttcttatcatttgaaattagcagaagagtactactttttaaaatctttctcacaaaaaataatatccagatgaatataagctcacagtgtctactttcattaataaaatccattaaaaagtccctaaatttttcatgttttttgttagattttaaaattatgagcatgtaagaatatttatctgtttcaaatctttccaagggtaagaccagataataaaattaaagttttccaaatgtgagggaggtattgaaacctgtatattaatataatttacaaaaagagtatcagagctaaggaaagggtctgataatagtggtctggtgagacaaatgtaatgaaattggtcagctctcctaaactatggtgctggctctttcagtaaaaagtaccattatttgctctgaaatcacaaaattgtatttgaattaactaacttaaaaattgtcttatttctcatggttttggttattgtctggattccttctaactctaaatttttataatgtaatgtcatacagttcatgtataaatactaagactaggtgtaatatttaatatgcctaatacatctatatatgttgtataacatgtagtttagtaattaaagaatttaaccacataattttgctttgggttctatttatgagttgttctgcatgaaatacattgtggttaaaagaaaggtaacacgtgcggatttgattatgcctcatctgtcagtaatcaaatgcctgcattggcaatgccaacatttttgaatgactccagggcacatgtttccacaaaactgaagacctgtgttcccaatttgcatctgatataccagtcaggaacctaattatgagcagcacacatagtttgtgcttttatgctgtaagtattgcaatcatcaggctaatgaaggtgaataagtacataaagagggagacgcattttgtttgtctttggaaatcactttataagattttggcagcagatttgcctaccacttcattttttggataatgtttaacatactttacattttctttctatttattgacataaggaggccaagaagtactctgagaggctaaaagaatccaaatttggattcaaattttgctacagaaaatgggaagtgggaaaaatgcagacaagtaattggagaagtgagaatttactccctgtgtattaatataatgcatgatctgtcagagattcatcttctagttttatagatgagccaaaaattctttctgaattctcatacactcctcagctttgcattctgcttgatttttctccctgcaaataattcaataattttaatatttaatataaagctttcagaatggtttcattggcattccagtcacttatgggcaaggtattaggataaatatttcattctccagagagcactgcatgcaattgctgctgttagaaatttagttcctttgaaagctatcacttggtgttgcaataatattttagaaatacagtcttttaaatgtggtcttctttactgccaggcaaacatggctccaagagtattatttatcagggtcatgactccaattaatagaattgtggttcttgtcttttttagaaactataataatattgcttttaatgtttatagtattaatcttactttgtaatattttaacactgttttggcttatagcgaagttacagaaaaaataaactatatttggggcctgatggcttcaattcaagtctgttccccactacttaaaaactatgtaacttttggtaaggtatttgggttctcagaatgaatgttaaactgtttatcaaatgagattaaaatgacctttgataatctcttatgactataaactagatcacaatagataatgaatgtgcaattctaatcaaacttataagctatattacaaatttaacttcacttccaattaacacatacgaagtttacagaatgtgtaataatagttataattaaatccatagttcccactctcaagtaacgtgttcattagaattcatcgatcatattatataatcttgataattttatagatgctttaggggattcaatataaaacacccatatttgtgcaagtgcatgagtgtatgtgtgcacacaacacacacgctctacaactgccacaagaaatttacaatccagctgcaagtgaaaaatcaacattcacataagatctctacagaatcccataatttaaatgttaacttgtgtagtgcacctagatcatatgcagtatgaaatttcaaggtagaggaaagttctatgggtagtagtgtctcaggtaattttatagaaatttttgagtaatagagtagtttaggtttgtaattcaacctgggcctttctgtacatacctcccaccaatctcttccttgttttctgatctccaaaccctggaatctcaaggttactcttgcctggggcaccttctgtctgcctcaaccactctttctcaagagagtcacattactcacttcctcacattatgcaggtctctgttcctatgcctgttgtgtacaagacctttctataccaccttaaataaaatatctgctccgtcctgaccaagcccactctctggtttttaccctacactgtcttggcactgatcactcagtatgtgctacatactccaggcattcgaggtagtgctatgacctgcagatcaagttactgagacacagaataattaagtgaactctcaaggtgacatatttgacatcagagccaaaatttgagccccttcagacagattccagatttttataatttatccagcttttctagctgatgttaatggacacaggccttgccggacatgctctcatccacagacagacatttccaatttcccattacatttatgtaagtgaaatagcttctgagttaacaattctaattctttaaaactaatgtttgggaagaatacctccaaattttatctcacatttcaacttttatgtgcctccctgtattaaattgctcaaacctgtcacttcagaagagtaagaagaaaaatgtgacacttgaaagaaggaactgtggagccagcagcaagggtgaaaagttttgctgttcagcttagggagggcatcttgggaaattcatcttctttctgggcctaaatttcatctgtgaaagaatatctagtccactgaattgtcatgagggtatggtaaactgatacatttaattacttagtctggtttttcataagcactatatacttgctggtgtaaaaataagagtacattgcttcgtatcgtatatattttacatattttaaaaattatgtttatttggggataattttagatttacataaaagtggcaaaaatagtaaagagattctctgtgtatccatgacccagtttcccttagtgttaacatctcacataaaaacatggttcttttactggagattggcagttagagatcaatatctgtgtgtcatcgctctggtttctttcgaagtttcatttcatctaggctttctcccagtggaccaagttagaaaatacatgtatatatactaatatctatatgcagcatatctatgttgatttctatatttatctgtatgcatatatgtatatctatctatccacctcatctatccatttcaaaattaatgttagttcacaccaatatctcttaatctaaatataagttttaaaacagacactatctatatacttctgtgactttaatagaagtgaaattaatattttcatttaaaatattatttgctctaaattttgctgctttgtataattgactatgtggtttttaaaatctctctgcactatgaacaatataaaatctccctgcattatgaacaatagtatgaggtttcctacaagaaataaaaataaaattaccacaggattaaaaaatccccactactgcatatatatccaaagaaatgaaatcggcatgtcaaagaaatatctccactcccacgttattgcagctctattcacaatagtcaaggtgtaaaatcagtttaagtattcatcagtggatgaatagataaaaagaaatgtggtgtgtatacacaatgtaatacaattcagccataaaaaagaataaaatcctgttatttatgtgacctgaatgaacctagaggacattatgttaagtgaaataaaccaagcacagaaggacaaataccactcataggtagaatctgaaaaagctgatcttatggaaataggctggggaaggtgtgggagggtgagattatggtgagaggttggttaatggtacaaagttatagttaggtagaaggaatatgttccgctgttctattgcacagtagggtgattataattaacaataatacattgtatatttcaaaagatctagaagagagaatttggaatgttctcacctaagagacaggtgtttgaggtgatggatatgctaattatcctgatttgattattatataatatacacatatattgaaacatcacactgtgtcccataaatatcaacaaatatgcaattaataacaataaaattttttaaatccaaacttaattaaaataatgcctttctcacttttttttttttttttttgagacagggtccctctgtcacccaggctggagtccagtggtgcaatcttggctcactacaaccctaaactcctgggctcaagcaaaaaatcctcgcacttcagcctcccaagtaagcagggttacaagaacatgccaccatgactggataatttgaaaatgtttcttatttattttattttgttttgtagagacagggtttagctatgttgaccaggttggtctcaaactcctgacctaaagggatcctcccaccttggcctcccaaagtgctaggattacaggggtgacacaccacacatggccactttaatcatttttaatagcaacatttgtttacaaagtaagttggaaagtgctatactaaaatatatatgctgaataaaaatacacatttacagacatacatatacatatacattgactcttgacaacatggatgtcaattctgtatgtctatttatttaactttcattttaagttcaggggtacatgtgcaggtttgttatacaggtaaactcatggattaggggtattaagattagcatccattagttatttttcctgatcctcccccaccttccaccctccatcctccaccctccaatagacgcctctaatagaaagccactgtgtgttgctcctctctatgtgtccatgtgttctcatcatttagctcgcacttataagtgagaagatgcaatatttggttttctgttcctgtgtcagtttgctaagaatgatggcctccagctccatctgtgttcctacaaaggacatgatcgtgttctttttatggctgcatagtattccatggtatgtatgtaccacattttatttatccagtctaccattgatggacatgtagattgattccatgtctttgctattgtgaatagtgctgcagtgaacatatgcatgcatgtgtctttatgatagaatgatttatatttctttgggtatctactaaggaatgaaattgctaggtcgaatggtagttttgtctttaggtcttcgaggaattgccacactgttttccacagtggttgaactgactgacactcccaccaacagtatataaatgttcctttttccccacaacctctccagcagtggcaggacagagtgcacacattacacgtgtgctggtggggcaaggaaggcaaagcctacccagctgctagcaaaaagatgtgggaggttgctgtaggcctgggtgaagctacagtgtgaggaggaagtggatgggctaacgtatggctgtgggggctgccctgctacagctctatgctggtcaggcacgtctgccagtataggggttatgattcagtcccccagggcatctgagactaccgtggaagcaagcagaaacaggttaaggacccaggagaggccagcagaccaaggaatgctcagatcagaccagccctgtctgatgggcaagactgccctgcagagtttaggtctgatagttcccctagggctaaagtctcctgtgggagcaagttgaggctagggagataagcttccctggttgtgctctgctatagagactcccacaacaaacactttttgctttgcctcagccagtgtgctaccatcaccacttctctaaggacctctccctgccaactggagtgtctgtggtggttgaggggtctccttcagccaggattccagaggctagtgtcaggagccagttgctccttgccagttcaactcacaggttcaccaggagtcactggaagcaaggaaggagtcgggatgtggatagccctgggcagggttcccgccttcctccctcttcagcccagcttctgtgtctttcctccatcagctctcagtgccttccctctgaagttcttttataagtgtaccagccatcttgatctgttattggcagctattccacctaatatgtatatttttaattgagcctccaagagggtgcaaaaccagatataggagaccctgattcagtcccctgtatagatgaggaagctgaggttgtgtgtccatttacatgcaggtttttttctgcctctgccacccctgagacagcaagacaaactctccttttcttccaccttctcagcctactcagtgtgaagatgatgagggtgaagacctttataatggatcacctccacttgatgaatagtaaatatattttctcttctgattttcttaacatttgaaaaatctggcttactgtattataggaatacactatataatagagatagcatacaaaataagtgttgatcaatttcattaaagcttttggccaacagtaggctattagtagttatgtttttggtcactcaaaatttatatgcaaattttcaactgcatggctggagggggtggtcaatgcctctaacctctacatctttctgtaataaagaatacagaatgtcaaatattggtctgattttctttcatggatcatgagtattataagactctttcataagaaggtcatgagcatgataaacttattttggtgtagcatacaaattacttagaaaactgagccctttttagaaaactttcattactttactgacattaatagtactgagaatactggggccctaacatccatatccccagtttgaagcaatggctccatacagggagagataagacaagaagacctcaggctcttgcccacctttcactaaaccaagaatatccctcagagagaagcttgccattgtctgtggtttagagattttgcctggggggagaaggaaaccgtaaaacagatagttcttaatcttttccccaaagaactgactttatttccaacaaatcttggggaagttcaaccttaatgtactctcaaaaataatgaaatttgtgggataagataaataggaagagattccagatacaggctaaactgtaggctggttagattacagaggagaaataaaacaccatggaggagccctccagatgtcagaaaaaaatgtcaaacactgacctcagaatgttttttttcaaaggagtcagactttgaatagattactttgtagagcaatttgtgccccaggacatttttgaaaacaatggagcaatcagctggcaattagtaaagtttaatagctggatgtgtcagagaaagtggaagaaagccttacaaaagccactgtcatgcaaggtgactgcgagtgttcccaaagctgagtttccctgaggagtaacattaaaagcttaacaatttgagggaaaaatggacttcaccaaaataattaggccagtcactaaacacataaacaagccaataatgataacatacattgagtgaaagcagaagtaaccagagttgccatattatcaaagatagccagtttccaacagaaattttgaggcatgcaaaaacaccggaaagcatgacttactcactagaaaaaagcaagcaacagaaacagcctgtcaaggcgaccagatgtcatatgtatcagaaaaagaatttaaaggggctattataatcatgttcacaaaattaaaaaagaaaactattattaaagaaagttctgattacaatgattcatgaatttgataatattaataaagagacaaatgttgtaaaacagaactaaaaggaaattttacagttaaaaagtacaataactgaaatgaataattctccaaaacaattcaaaaagatatttcaacttgcaaagaaagaataataaaactcaaaggcatgtcaatggcgattatgctaaatgaagaatatagagaaaaatgaatcaagaaaaataaaagaacctaagataaatatagccatggttgaacacaccatcagaagtgtaatgggacttccagagaaagaaaggagaatgaaaaaagcagaataatattcaaagaagtaatacctgaaaatattccaaatttattggaaaacagtaagctatacacctagaaactcaacaaactcctagtaggatctatgtaaagacattcacaaagagatacattacagtaaaaatattgaaagtcaaatacaaggagaaaatcttaaaagcaggaaaagtgacacattacttacaaaggagcttgcaatagactgaatgcttatgattctcaaaagtttatatgttgaaatcctaactaccgaggtgatggtattgagtgatggggtctttggaagtttggaaatttggcactgaatctgccagtatcttgatcttagacaattttttacaattcttacaaccataagggtatataccccagacaacgaagctgattcagtatctcagtattgtaagtataattgagagtataattcttacaattgtaagaactgtaaacaataaattcctgttgtgtatgttactcagtattttgttacagcaacctgaaataagatagagctcaaataatttttacagctgacattactacaggagttattatgaaatcatttttaggcagctagaaagggggaaagttctcagtggaattttcctttaataaaaagcagcctctaaactatttattctctaacagaaagcagcctgagaagtcaggcatagatatgcaaactaggagcttttatatgtaaatgacagcagctgtacctggaagccatgtacattcagtatggcctctcctgccctcttttccttgtcaccccttttatgggtgtcatggcagtctccaggtaaaaccacgtgtacgagtatcaaggccacggccaggtggaagccacgtttgcataataaaagactaggatgggagggccagtcttttcctgggctatgtgaatggcacacctggtcaaaccaatcccctgagccctaggtaaatcaatcacttcctcctcaagcctccgtacaaaaccgattgtgttcactgcaaacaagacaccctcttttgggcaacccgctttctcagcatgaagaagctttttatctcccttttcttctttttctattaaactttccactcctaaacccactcctcatgtgtgtctatcttctgaattctttcttaactaagacccagagccagggtatataccccagacaacagagccatttcaacatctcagtataaacaattcagttcagagtagtattttcaaagtgctcaaaaatcaaaaacaaaaacaaagtaaaaaaactttcaaccaaggatcatacatccatcgaagttcatttttcaaaaagaaaggtaaaataaaaacttttcaggataaacatcagctaagagactttttttgctagaagacccaccttaaaagaactgctaaaacagttcttcaacctaagaggatttaacttcagtcatttatttgaatccacatcagtaagagtaattacatgattatatatcagtatgaatgcatatttttccccttgtttctcataatcgatttaaaaaacaattgcatatgcaatttaaaaattgttaaagcatatgcaattgcccttcaaattagttaagagaagcaaggagaaaatattatatataaaagtatagctgtgactacaagatagagaaatgtttaagccaggcacagaaggaaaaacttcatatattcacaattatttgtaggggctaaaaatcaaaataattgaactcacggatatagagagtagaaggatggttaccagaggctgagaaagtagtggggaacagtggggaaggagttgggaatgattaatgagtacaaaaaagtagttagaaaaagtaaattagccctagtatttgctagcacaacagggagactatagttgaaaattaattacacatttaaaaataattgaaaggatataattggattattgtaatacaaaggacaaacgcttcaggtaatagataccccatttaccctgatgtgattattatgaattgcatgcccttatcaaaatatctcatgcaagccctaaatatatacacctgctatagacacccaaaaataaaaaaataaaaagttaaaaaacatttaaatgtaatatatatactaataacatcatggaggaggtagaacaaagctgtatcattacaggtagttaagtaataatttaatgttgattctgataaattaggttatatatggtaaactacagagtaacttcaaacttttaactcaaaaatatagtgaaaatataaatgaattaaaatgcttagatatccatttaatgaaagatgagtcagggaaagagggatagaggaacaaaaaatgcgtgagatatataggtaaacaaaaagcaaaatgacagacaaatccaggtatatcaataataataataacaaatgtgaatggatgatacaatctaatcaaaaggtagagataagattggattaaaatatgttctatacaggagacacagatgtatatattaataaaacagaaaataaaaattgaaataatcaataaagctaaacgtttctctgaagagaacaacaaaatcatcaaatctttagccagattagtcaagaaaaagaaaaagaaaaagacttaatttgacagacccaaattcaaagatacaactaggataaaagtaaaagtatagaaaatgatatatcatgaaactagaaaccaaaataagctagagtggctatatagatatcagagaaaatagactttagaacaacaaaaaagttactaactacaaggagggacatttcggaataataaaattgtcaatctaccaggattataaacataaatttatctaataaaataaaaatagcagacaataaaaaatagagcataaattaataaaatagagaataaaaaataacagaaaatcaacatagccaaaaatgtttatctaaacaacaaaattgtcaaattgttagctagattaataaaaataaagaagagagagagaatacttaatttactagaatcagaaatgagagcaggcacattactaccaatcttacagaaagaaaaaggattatgaaagaatactatgaacaaccgtataccccaaaattatataacttaaatgaaatggacaaactcctagaagggtacaaacgaatgactaaaacttactcaaaaggaaacacattatgaacagaaccataacatgcaaagagtttgaagtattaattaacaaaatacccacaaaggacaggtcagtcccagaagtttactactggatcccaccaaacattaaaaaaaaaaaatacaaattctccacaaactctttcaaaagatagaagaggatgaacagtttccaattatttttatgaggccagtttatcctgataccaaaaccaaataaagatatcacaagaaaagaaacatacagaccaatatctcttatgaatatgttttctaaaatccttaacgaaataaaactaaatcaaatacagcaacatataaaaataattatatacgatgaccaaacgggatgtttccagagatgcaaggttaattcaacatgtgaaattcaacgaatgtaaaacatcatttgttagagtaggtagatagctagacatgaacatgggggaggctcctgagaaaggaaaagcctgggaaggttcactacccactccctagaggggccaaccaaaatttgcatattaatagcatctctaatgctggagtgggtgggtctaagtcaaatgtggttaggaagaagaggaagtacttaggcagaaagaaacatcccagaacacctcttaaggtgccacaattatcattcactctgccattacaatgtcagaatatcgctagctacatgcacattcctaagagcaacctggcatcatgagtacagattagggcaaataaggaaattccaaagagatatgcaggcacaagaggtaaagatttgaccactacacaaccttcctggggtggcggtaattattagggctgctgtcaggcaagactcgtattgaattaccagttgtattagtctgttctcacactgctataaagacgtacccgagactgggtaacttataaacaaaagaggtttaattgactcacagttctgcatggctgggggggcatccggaatcttaccatcatggcagaaggggaagcaggcacatcttacatggtggcaggtgagaaagagcaagcaagaacagggaaaattgccttataaaaccatcagatcttgcaagagctcattcattatcacaagaacagcatggggaaaaccactgccatgatccagtcacctttcatgtggtccctcccttgacacgtgggaattatggagattacaatttgagatgagattttggtggggacacagagtcaaaccttatcaccagcccaagtatgcacattaaccaacagtaagggaggatcctgcaatcctatgggtagggagtaaggtggaacttaaggcaggagtgggaacactagacaaaggaaaaagacggagacttgaggcagaggtggggattgcacagaaccttcagagctgttttccctgcatgatcaacccactgctccattggggcatccctctttattaaattttttttcctacaataagctctctacactgtatttcatttcaataaagttctctgctatgtttgtactgtctcttggtcaaaattgttcttccaagttagacaagaactcggacatctgctctttctggtaacaatatcaatagagtaaaaataaatcacatgattatttacttagatgcagaaaaagaatttaatgaaacacaacatcctctcatgacataaacaattaggaaaattgagatagaactttttcaacctgataaaggatgatatggtttggctgtgtcctcactcaaatctcatcttaaattcccatgtgttgtgggagggacccgtttggaggtaattgaattatgggggtaggtgtttcctgtgctgttcttgtgataatgaataagtctcacaagatctgatggttttataagggggagtttccctgtacaagctctctctttgcctgctgccatccatgtaagaaatgacttgctccttccttgccttctgccatgattgtgaggactctccagccacatggaacttaagtccattaaacttctttcttttgtaaattgcccagtctcgggtatgtctttaccagaaatgtaaaaacggactaatacaaaggatatctataaaaagcccatagctaataatatcagacttaatggtaaaaaacttaatgattttcttctaagatcaggaacaagatatagatgtctgttcttgccattcctttttaaaattacactttaagttctgggagacatgtgcagaacgtgcagctttgttacataggtatacaggtgccatggtggtttgctgcacccatcaactcatcatctacattaggaatttatcctaaggctgtacctcccctagacccccaccccagtgtgggtctagacaggccccagtgtgtgatattcccctccctgtgtccatatgctctcattgttcaactccttcttatgaatgagaacttgcagtgtttggttttctgttcctgtgttagtttgctgagagtgatggtttccagcttcatccatgtccctgcaaaggacttgagctcatccttttttatggctgcatagtatttcatggcataaatgtgccatagtttctttattcattctatcattgatgggcagtttggttggttccaagtttttgccatcctgaatagtgctgcagcactgttcttgccatttctattcaacatcatattggcaattccagtctgagcatttagatggaaaagaaaaaaagagaataaaagaactaaaaggcatctagatgtatgacataaacttgtaaataaatagtaatatgaaattcaattaaacaactattggaataagtgaaaattatttcaataactactttagtcattttaagataactcatttatcttggaaataagtgaattgagtaaggtaaaaggatataagatcaagatacaaaaaccaattgcatttccatacacattctatgagtaatctgaaaataaaattttcaaaaactttcatttatgatggcattaaaaatattagaacacttacaaataaactcaacaaaagagtgcagaatttgtactctgaaaactacaaaacattgttgaaagaaattaaagaagatctaaataattagaaaaacatctcatgttcatggatcagaagattaacattgttaagagggcaacactcctcaaactgccctacaaattcagtatctctgtttaattctttgtagaaattgataacctggaattgaaggagacccagaatagtcaaaacaatcttgaaaaacaaaagttggaggactcacacctctctattttaaagcttacttaaaatcaatgttaataagatagtataacactggaataagtatagacatatagagcaataaaacaattaggtgctgggcgcagtggctcaggcctgtaatcccagcacattgggaggccaaggcgggcggatcacaagttcaggagatcgaaaccatcctggctaacacggtgaaaccccgtctctactaaaaatacaaaaaaattagccaggcgtgttggcacgcgactgtaatcccagctactcaggaggctgaggcaggagaatggcgtgaacccgggaggcggagctcgcagtgagcctagatcgtgccactgcactccagcctgggcaacagagcaagactctgtctcaaaaaacaaaacaaaacaaaacaaacgaacaaacaaaaacaattaggagtccaaaaatgaactcatgtatctggttaactaatttttgacaaaggtgcaattaccatccaagtgggaaagaatactcttttcaccaatgatgctgtgataattgcatagatacatgcaaagaataaaggtagagccttacttcataccttataggaaaaaaaatcaaaatgaatagaaaccttaacataagtgttgacagctgatgtgatactttggttcttgtcttcttggtttaaaagaatttaaacaagagacacagcaaaggaggtgtagcatagaataatttattgcaaaaaaataaataatattttgaaagttaggtgcagaatagacagtacaccatgagagaaaattcaagatgggctgcttgtaaggatgagacaacaaagactggcagtaggtagactcccttcatggaagccttacctgattattcatgaggaggtggaaagaggttactagtaagcatgttctgggtggtcctctgggttcccatgtgcggtagctgtacatgcttgttcatatgtcacacgtctcattagcatcttaaatctccacccaagggtgtgttttctactattgttatgaacaaagtgtcagtttgaggacaggtaaaatcaaaatgtgcatgctctctagaaggtagcttagcttgactgagctcaattacagagccgatgctgaggcttattgtgttgactgtatggttaccatggttgctgcatcccaagaacatggtcacttcctggactattcatcctgcctcataagtgctaaaactataaaacttttaaaagaaaacatagagataaaacttcgtggccttagatttgacaagagactcttagatatgacaccaaatgcacaagcaaaaatagtaagtaaaaggaaaaaatacatttaaattagacttcatcaaaattaataatcattgcattctgaggatatcatcaggaaagtaaaaagacaatccatagaatgcaagaaaaattacatatttgatgagacttttattcagaatatataaagatctctttaaattcaatattaaaaagacaaactgtggtaggagttattaagaaattattttaggcagatggagaagaaaagaggtccttggaaagttgtttcttttaaagcagctttagaaaagtttcctgtctagcaggaaagcctccactcttagagcctggctggcagcttttgatatgcaaatgctagccattagaaactgggtccacaaaacagggtgattcccgccctcttcttccttgcccccacatctgcctggcagcaaggtcgccctcacatatccccatgtgtgtagaacatcacggcaccctgcatttgcatattaaaaggctaggatgggagggccagttttttcatgggctaggtgaataacatgcctggtcaaaccaatcccctgagccctatgcaaattagacaccgcctcctccagcctcctcatataaccggctggtatctgtgcacttggggtctcctctctcgactttggacccctttctccctctatctctgtacaggggagcttgtttcatctttcttctcccttctttcttgcctgttaaactctccgctccttaaaaccactccacgtgtctccatgtcatttttaatctaattcggcacaaggaccaagaaccctggtgttcctccattcattgcagccatatcaaaacaacccaaagaaaaaattcacaaagtatctgaactgacatttccccaaataagatagctgaatgagtgataaaactatgtaaagatgttcatcatcattgatcagggaaataaaaattaaaaccactatgagatattacttcacacccgcttgaatggctagaatttaaaaagccagacaataagtattggtaaggaaatgcagcaattgaaatccttagtcaattaaggattgcagccattttgtaacacagtctgacagtctcaaacaattaaacatagagttactacataaaacagcaagtacgcttcaaggtaaatgtcccaaataattgaaaacatatgtccttgcaacaacttatacatgactgtttataacagcatttttcataaaagctaagtggggaaataacccctgtccatcaagtgatgaatggataagcaaaatatgaatatacctgtgagaaatacaaattaagttctaagcctacaactgactgaatggaccccattttggccaaggggacgctgagttcactgccataatgagatgggaagttcaccttattatacctcctccctcactaagcatcattagtctttcttccctaagtgctaaatagaaaccagccctttcaaaagactccacactgatagtttattatgtcaacggaaagagtcaaactcaaaaatatttgaagatatttattctgagccaaatatgaatgatcgtggcccatgacacagccctcaggaggtcctgagaacacgtgcccaaagtggtcggggtgcagcttggttttatatattttagggaagcataaggaatcaatcaaatatgtttgagaaatacattggtttggtccaggggcttccaggttataggtaaatgcaaacattttctggtggacgcttagttacatttgtcgaaagacctggaatcaatagaaaggaaatgttgagggtaagaaaaagattgtggagaccaaggttcttttgaagtctcatagtggctgcccttagagacaatagacgacaaatatttcctgttgagacttttaaaaggtgctaggctctcagttaatctcttcaggattgggagggcttgtaagaaatagaactggttatgttaatagagattctttacaaatgcaaatttaccccccaaaaggatggctttgcagggccatttcaaaatatggcaaagaaacatgttttggtataaaatagcttgcttttctcctttgtcatgtaatgttatgccagaatcagattggaaagtaagtcacaatatatagggttaaataaaacccatcggatgagaatttatggtttgtagggcatgactccaggcctcttagaaaggaatttgggcaagataagataaaatcagagcttagtcctcaattactagcttatcttcccaggaaccaaacaaagataaaatgagattaatcatttcttcactctcccagaggcctctgttttttctagtctctttttcttcaaatgttctccatctcttatgtaaaatgtagatttactgggcactaactaaagtctcagaagtgtgtaatcactcatctcactgctgctctatccttttttaaaattctatttattttttatttttatctcaataagcttttggggagcaggtggtgtttgtttacatgggtaagttctttagtggcgatttctgggattttggtgcacctgttacccaagcagtgtacactgaacccactgtgtagtattttatccctcacacctgtcccaaccttcctcccaagtccagaaagttcatcgtattattcttatgcctttgcatcctcatagcttagctcccacttataagtaagaataggctatgtttggttttccattcctgagttacttcacttagaataatgctctccagctccatccaggtcactaagaatgccattatttcattcctttttatggctgagtattattccatggtgtgtgtatatatataatatatatatatatatatagagagagagagagagagagcgcacattttctttatccattcattgattgatgggcatttgggctggttccatatttttgcaattacaaattgtgcttttataaacatgcatgtgcaagtgtttttttttcatataatgacttcttttcctctgggtagatacccattagtgggattgctggatcaaatggtacatctacttttagctctttaaggaatctccacactgttttccatagtggctgtactagtttacgttcctaccagcagtgtagaagtgttcccttttcaaccacagccatgccaacatctattatttttgtatttttaaattatggccattcttgcaggtgtaaggtggtattgcattgtagttttgatttgcactttcttgataattagtgataatgagcatttttttcatacgtttgttggccatttgtatatcgtctttcgagaattgtctattcatgctcttagcccactttctgatgggattatttattttctccttgctggtttgtttgagttccttgaagattctggatatcagtcatttgtcagatgcatagttagtgaagattttcttccattctgtgggttgtctgtttacactgctgactatttattttgctgtgcagcaccttcttagtttaattaagtcttatatatttatctttgcttttgtcacatttgattttgggttcttggtcatgaagtcttttcctaagccaatgtttagaagggttttttcaatgctgtcttctagaattttatggtttcaggtcttagatttaagtctttgatccatctggagttgatttttacataaggtgagagatgaggatccagtttcatttttttacctgtggcttaccaattatcccagcaccatttgttgaatagtacgtcctttccccacttgatgtttttgtttgctttgtcaaagatcagtttgctgttaagtatttggcttaatttctgggttctctattctgttccattggtctatgttcctatttttttttttttttttcttgagacggagtcccactctgtcgcccaggctcgagtgcagtggcgcaatcttgactcaatgaaaccttcacctcccgtgttcaagcaattctcatgcctcagcttcctgagtagatggaattacaggcgccccccaccacaccaggctaatttttgtatttttagtagggacagggtttcaccatgttgatcaagctggtctcgaactcctgacatcgtgatccccctaccttggactcccaaagtgctgggattacaggcctgagccactgcgcctggcctatgtgcctattttttaaacctgtaccatcctgttttggagactacagccatataatatagtttgaagtcaggtaatggaatgcctccagatttgtccttttcgcttttttaaggaaaatgtgtaaatatattactaaacttcctgagaacctctttggaaaaaaacagccatagatgtgtctgtaacttatgtttttcctgggtacatcctccgactcactcaagaaaacccaatgagttgggaatgatgcctcagtcactcattttgattgccacacgcaatgcgatattatttggccttgcaaaggaatgaagtattaatatctacaataacatggataaaccttgaaaatgctacgctaaataaaagaagctagtcaaaaaagaccacatatttcattccagtgcaatgcttagaacaggaaactatatagagacagaaagtagattagtaattgctaggggctggtgcatatatgtggggataggggataatagctgaagtgcacaaggtttctttttgcaatgaggaaaatattctaacattaactgtggcggtatttttccttatctgtgaatatactaaaaagatccttaacatttaaatgtacattttatatgttgaaaattatctcaataatgcatttaaaaataagaagttacccctaaaatgaatttaaatactgatatatatgatcagatcaggtgaatcagattttgcaatctgacagagaaacatggctgttgagttacagaaaggactgaagaaattgatgtgaagtgagcaaaagagaaaatacttaggaaataagggttttaaaatatgtattcataatttaggaaagtgattaatgtaacgtttcccaatagtagtgacacatttttatactagaaagcaggagatagtaaaagggaatatggcatggtagattctctgaatccctaaccaacaggcaggggatggctggaagtctgtttatgcgtaggccttccacagccaggggttcaagaaagaaattttatcttcaggcagaaaaagaagaaaagacaaagctaggcaatttttttttgcaggaaatacttagttttgcaatgtattcaaatgagaaatgaaaagtcagtcctcaggctaaaatcgagttatgctaatcaagggttttgtcaggtgagaaaaaaccttaacatttactgagtgctcactttgcttcctattgtgcttacagaagagaaaggtcaggcacagcgatatcaggttccagaaacttgccatcacaatttggtaatgatagaggaaagagggcaaggaattaaacaatgtgagatcttcttgttataattagacgtaaactaattaagatttactagaggctaggggaagactattagggagagaaagggattagtcaaagtggcttgcttataaacccacttaaaatattaggaatgtattttttttaagaaatcacttttaaatcatttatttctcattatctcactattaaagtggtgtctcttaatcacttaattatagctatgtaatttttgtatattttagtacttaaaaaccctattgacaatcatgaattgtcctcaataatatacaaatgtttaaataattctgaaattaaatttttgaatcacattattgttgggaggaatatattcatatgattgatgtattatctggtggaaaatagaattattagagaataagatttagtatggaattaaaagttgtttttattattttaatgcaaataaaatagtgctctggaacctgaaaataaccagtaactaatgaggttttttcatttacagctatttaacataatattttccacaaagattgagtcaactaaatggatccagaagaatcaaatattagcgctttaataattatttagcagtgtagtttaggtcccacaaagatcagttgatattcaaataaaatcatgacctgatcttcctgattgttagtgtgatttattttttctcacttacttaaagcaagataattcctcttgaaaaaagtcaagtaataattttgtgttacaattctcacctaatttagatattcagaattttgcaaagatggttagaaaaatgaaaagtaaagtttgcttcattttcaattgctttaatgtcctaaagtgtcatatataaaaagcatgtgattattttctgtgtgttgtataagataatgatacttgtgatctaatattgtagaattttttttagatgttttacctttcggtacctgaatgatcttaactgtttctctaattatctgggtgacataagacaatttgatcttaattagggattagagctttcttcttattcatgtcagttgtaaacattataattataaaattggtatagtggggaaggaaaaataaaaactcattggtatgatttaaggaaagtaatttattctgggttggttaaggttagtgtaaaaaaagacagagacataggatacatagtaatgtagatacatgaatatgcagggctaaaaatattgctttggtacaatttaaaatagtgtatttgaaacatattttctgttaacaagaagaaaagagaagattaaaatatatcccataggatatatgatgtaggctattttattaaaaatattgtatctgaaggcagttatatctctgtcctgtaaaattgactttccatgtttttacatatttacatggataagtttaaaaacaacataagacttcattggcgtttgcatcctttttttgcattgtctaatatatccatgctaattctggttggggtattggcaatatagtattatttttcattctttctaatttttggattctttaaaaactaatcacatataaaatattatactttattaaaatctgttgggtacaaactgcacaaaattttatatttgttcactgtatctgccctatctccattgacatgtgctcctttaaaagtattatattgagtagcattttacttagttcaaatgtacaaaaaagcacagagtgaatcgtcagtatatgaacacaaccatgtatcctccactcaagttgcctaaggttagattccccagaaacagagatgggcacagggatgtgagtacccatggttatgggtgaagtgctctttgggcaagtctgtgagcaaaagagtgaagcttgagagggagttaaatacagacataccctcaagaaaagtttaggcatggctgcatcaataggaaaaggcccctggaacatcaactgcagcagtgttttcctctttgaagcagggtaactggccatgaataacctgaaaaggcttcttggtaggatggctcctttcatgtaaaggttggtttctggagaagaggtgaagcgggcagcaataggaagtcaatatttccagcaattgagtaacgagtgggccaggatctgggcagggccctacaatgtcctctccagaggtaaataagcagaattatttgagggagctgtattgggcttccttatattatatgatctcagggtgtgggacttcttacgttgcagttgcctcctcttaggggaggtggaagcttcacatttcttaaaggcgtggtcctttattggcacagtatcattttcaatgcattctattaatcaaagaatgtcacaaggcctgccttaaatcaaggcaggaattattgcaaccattttagatactatcagaaatattaagcacggtgtttattaaaaatgttttgtagatgatcttttattttcaggtgaaaaagcaagcacagcagtacactgatttgggtcaaagagacctagcccaacccaaggtaatattatcttcccttcctaattgtgaatcttagccaacccccatggattgaatcaaaggcctccttccttcttagggctgggtaggatagtgagctaaccacctgtattcaatgtagggatagaaattcaattctcgttccttgccaagattccccagcatactcatacaggtgcatgtggcatttagtcccttctctccttaaggaagctgatgttggggtagggaagggtagagggctcaggaaatgtacaagtaagtgaactctttcagattcgaatgtcatggaggctgcatgtagctttaacaaatgaaattcattcatcccaccagaaactctgtatcaggtagaaagataatcattactgaactcatctatttcagctttgtggatccctttattcaatagtaacatccactttgttctctggttggcccctgtataccctttagctaactcaggctcagctcacacagaaggaggcattttttaatgactgcaattaaagaaatacactttaattggggtttttgctgcccatttttcatacatctcttatctttttcccagttttattatgaggatgagaggagttttccaaagcagtagagacgactacaagtatttatacagatatcttgactcaatttctccttctccagtaggtaacctcatcaatattgtaattctaatctaggtcagtaagagccagctattagtgtctcatcttcctgtgggagtttgtctgtctcatggaaatctccctgagaaggtcaatattctttcacgtctcagtgctttttgtttgtttgttttttgtttttttttgagacggagtcagagtctccctctgtcgcccaggctggagtgcggtggcacgatattggctcattgcaacctccacctcccaggttcaagtgattctcctgcctcagcctcccgagtagctgggattgcaggcgcccgccaccacacctggctaatttttgtatttttagtagagacggggtttctccatattggccaggctggtcttgaactcctgacctcaggtcatccgccctcctcggcctcccaaagtgctgggactgcaggcgtgagccacctctcctggccatatctcaggtctttaatgaaataaaagtgtttttcttgttcttaaaaccatccactatgaaatatgttggttgggtgatatctttcacatgttgattcagaaatggggtctcttctatcttaattcctatggcttaaacaactgtaagtattatttctatcaaggtaactgctaccaaagtttgaatatgttttccttccaaaactcatgttgaaatttaattgccattgtaacaatattaagaggcaggacgtttaagaggtgattaagccataagaacttcactattaagggtgggattgctgccattattagagtgagttcagcctttcttactctctcttgtccctctgtcttctctcatgggatgattcagcaggaagaccctcatcagatgtcagctcctttatcttgcacttctgaggctccagaactgggagacaatacatttctcttcattataagttatccagtctcaggtaatctgtgagaccagcaaaaacaaactaagacagtatccttggaagtcgtatccattttaaggatgataaacacggagaatcacacatgggagattttgatgtgataagtctgcaagtagctgacataacctttacctttatttattggcctagactcagtcattttcccaaactataattgcaaaggagactggtaaacatagtctagctctatgcacaggaagaataagcagatttggttgatcagacattgatagtcaaagtctggtaacaaatagcatttcacccttcttcctaatcccagtgatggcacttatttcctttgtccaatcaaaagaatagattttgaatgatgcaggttgtctctattcttttcagatacagagcttctaagtctggtgacctaaataactgaagagttaaattatgtgcgctcccctacatttattcatatataccctattaaatcagggacagtgtatttgaagtaaatttcttttttatttcttttgttccatgacctcttggtttttctctcaatttaatggcagctccctcgagtctattagaaataattgcatcaggtgagaagaaaatattcatgtctgagggtgaatattaatatctttatcatttaaagtgccttctgttttattttatacctctgcactataaaggcaatcaggttttccaaccttttaaatacctaaattattatttgtatttactttcatttcttcatgtaaataggctaattctttcctgaatttatcttttttcatgatgagaggaaaagccaaaacacattattactccaaatctttgcagccttttcacttagatgtaggctgagcgatctgatttctgtaggtactcatttcttctgccattacacaacattgttccctgtctttccatccaccgatatctagatgtcacttggtaaaaaggggcctcttaaacaaagattagatttgatggaaatttcaacatatcttgagtcttggaaatttcctttgttaaaatatgtcttaccatcaccttttctacatacctgatttattatcatatcaatgattactgaaggcatacagaggaggccacaactcagtgaaagacctgtcttctaatcccagaagtctgattattgtttatagtcagtttccctcagatacctgagagagaagtcaaaacctctctgcttgtagtcctgcaggtcagaatgtgttggaatacctttctgttactgatatccagtctactgaaaagacagattgggcagagacttcccagaggtaacccatcacatgtattagcatcctattttaattattttttattacccagttgggtcaccacatcaacagaaacagtccagtaatctggacattttcctttgtcttagagaaaacatttttctaaactttattttatttatttatttatgtatttgtttttgagatggagtctcactctgttgcccaggctggagtgcaatggtgcgatctcagctcactgcaacctccgcctcccgggttcatgcgattctcctgcctcagcctcccgagtagctgggattacaggcgtgcgccaccaggcccagctaatttttgtatttttagtagcgatggggtttcaccatgttggtcaggctggtctcgaactcctgacctcgtgatccgcccacctcggcctcccaaagtgctgggattacaggcatgagccactgcacctagccgagaaaacatttttcaacttctggtggtattcctccaagattgcactcttaaacatggtaattaaaaaataaatacatataatctatgtatgatgacagtaattaaaatttgatcgattatttcattttttggtgttgcctagtccagtcttaactctcaagaaaagttaaccaatgcatgttgttatgactccatgaaggttatttcaagttttcagttggatttaatttggtgaccaacttccagccctgcttacttaagtgctttctcttatttcatgaagttagttattaatgcagagaaaacatcattgagtcctgaatatggtgcatttatagaccttgccaacttgcttgacaacagccaccatgcctggaataattaggaccatcaacctctgtaccattgcccataaatctcgtcaacctttgcataaactccacttcagtacccttctttgtcatagtcataagaatgtaagaatgacaatcacttcatttattcatttctacattatgcctacattctagcttaccagccaagacatattcttcctgttgagcgaaaaatggtcatctactattttactaatgaaatgcatttctttttagccattaaaatattacaataaatataaatatattaatgaatacagatattttacaaggcatatttccaacctgcaaagatagagctaaaggtgcagctataaaaatacctcaatacattcttacaattttataagattaatatttctcctgataagtcttaacaattaacattatgttgaaagagatgcagtataaaagtcccactgaaaacattaaatgttgttcatgtgtaaatgtgtttgattttactcttgaaaaccaattacaaatacgtagacatacatatataaagaggcagaacttacaataacttaattccataatacataataagatacaactaagactaataattttgttcataaatatttctcatatttatggctgccttttttattatattacaagcaaactagcctcccttgcattatattgaaaaataaaacaactctgcaaagaaaacaaagcaaaaatttcccataattggaaacaattattctttaaattactctataaaagtaaataaatgttacatacctgctaaactgatattcacaaataactctgaattgcaaacctaaaaatatcatgacacaaaatttctatgtatgattttttattatttgttatttaatgaatggtaaaattattttattattttttattccatatattcctgatatagctatagaaacacatacattatactcataaccaacaaatcttaataaaataatgtatttgtatttatattatagtttcctgaatttaaaaaaaagcaggggattaataagccactttcttatttcccaaacatccgttttccacagattgactcaacaggagcatgatatagcatatattttattttcttctgtcattggataggcaagaaaattactgtgaaattatcgtagtttcctgtcttcttctcacataggccagagctcatctgcaggtctctgacctcactgggaactcctggtacagagcatagagaaatgcctctggccccgatagagagttcgaccctggcaaaatccctgcctcagccaactgagcttgcagacctgtgggttactgggcacagattgcctgtcttgagctgcattatcccctacactccttctgcttaatgtctctggaagtcctgatcctttgggtcatgcctgacataggaccttaaatcctgtaactgaaatatgcagtgaaactttctgggtatatacagctgaaagcaaaataaataacatttaaaataaccagaaaataatattgaccttcttttttgattgacacaagataaatgcccaattgtcatgacgagtaaaatatgtatttaacttcagaaatagtatatctttcttatctatatagtttgataattttgatcattaggtctatctctgttcctttctatataacactctagagtcatttttttcttaatgtacaatcaagagggaaagctttacgatccaagtagcaatagtaggcattgtcttaacatctttagtcatgtttggttacatttattgtccaaaagaataggatgcaatgtgtaattagtgacaaggaaatgtggcaactttatattacggcattcttctcacaggcatttaatagttgttaaaaagtctccaaagcgatgggtctccaatgtaattagttcttaagtttaagaaaaataaacttcataatttacgtctcaaaactgtaatttagaataagaatgatgttaatgagtatgcacataattggaataagtttgattttgtagtgaagcacgtggaaagaagaatctggacaatcactggagggaaaacaacatttctggagagaaataggtagacagcatttgaaaaagcacacgtctaaacaacagtgaattgaaatcatgctgtgtatttttataatctagttttatattgagtattaaaagtaatatagaaagttattctgacacataattttactgtttcttatggaagataagaatcttgtttatcaaggaatacgtcaagtaagaccaatcactatccaaaatgaactgcaaaatcacaatctaaattcagggctatggacaaaactcaatacctcagtatttaaaacaattttactcccaacttgtccagcaagtcttagaaaacaataaaaataactgaatttttctccttatgaaatccctgaagacattagattcataagtcaattatttcctatgcaccagaacattttgtttctgccattggagacactaatgtggtgcgaaagggaactgaattattaaattacaagtgcaaattaatcaaagttttcaggacctttttcactacaccgatttttttatgcctcctcattttagctctctgacctcatctttaactgaacacacacacacatgcgcatgcatgcccacagtattccccccttccaacaaaccatttattggattggaaagtaacactggattacttactttccagaatcatagcacattgttctttggtattctgttttcagtgtattcagttatggttattgttttccgtgtcagaacaaccaaataaaatatattgattcagaagaattgaaagagtttaaagtcaaagtgtaaacatttgaattattaaatgcaccattatcgttttaaatctgcataaaaatctgattctaaaaaattaaaataaaggatttatttttatgagtaatgacaataatacagacaaaggcaatttgtactgggagagaggggggagatgagatttgtgcccctgaagtttcatctctgatattgttaatacttcttttttgttttccgagatggagtcttgccctgtcacccaggatggagtacagtggcacaatcttggctcactgcaacctccaccttcagggttcaagtaactctcctgcctcagcctcctgagtagctgggattacaggcgcctgccaccacacccaactaatttttgtatttttagtagagacggggtttcaccatgttggccaggctggtctcgaactcctgatcttgtgatccgccagcctcggcctcccaaagtgctggcattacaggcgtgagccaccacatccagccaatctttttaataacattaactaaaaaagatattttaaaagacagctttaactgtaagtgctagcatattgggtcagcagaagcataattttcatgaaggtaaagaactctaaggcgatggctatcaggactatgaaagcccaaaaatctctttatacctattaaagcattacttgtctaacctcagttctaagttgtgcatagaagatagaaactcattcccattctaattcaaataatgagttttctcttgcaatggcatgtttgaaaagggacaaataaaagacactgttcttgaaaactaaacagcattgtgggaagtatgtatgtttagcatttgttatagttattgtccaaaagaatagaatccaatgtttatcttatggcatttttcacacaggcatttagtagctgttaaaagtctccaatgcaatagctacttgtgctaccaacactggttatgcaaatcattttgttttttattcatggatgatgatatggttcggctccaggtccatacttaaatctcatctcaaattgtaatccccacacgtccatgggagggacccagtgggaggcgactggatcatgggggcagtttcccccatgctgtcctcgtgatagtgagggatttctcatgaaatttggtggttcaaaagtggcagtttcctctgcacgttctctctccttccaccaggtaagaagtgcattgcttcccttttgcctttcaccatgaatgcaagactcctgaggcctccccagccatggagaactgtgagtcaattaaacctattttctttataattacccagtctcaagtagttctttatagcaatgtgaaaatagactaatacaaagaattgttaccagcagagtggggtactgctataaagatgacctgaaaatgtagaagcaactttggaactggataacagaaaaaggttggaacaatttgtagggctcagaagaagacaggaagatgtgggaatgtttggaacttcctggagatttgctgaatggtttgaccaaaatgctgatagtgatatagacaatgatgtccaggctgaggtggtctcagatggagataaggaacttattgggaactgagtaaaggtcactcatgctgtgctttagcaaagagactggtggcattttgccccttccctagagatctgtggaaatttgaacttgagagagatgccttagggtatctggcagaagaaatttctaagcagcaaagcattcaagatgtgaactgggtgattctgaaagtgttcagtcatatgtaatcacaaagaccttatctgaaaatggaacttttatttaaaagggaaacagagcataaaagtttgggaaatttgcagcctgaccatgcagtagaaaagaaacacccattttctgggggaaattcaagcctgctgcagaaatttgcataagcaacaaggagccaaatgttaatagtcaagacaatggagaaaatgtccctagggcatatcagaaatctttgtggcagccccttctatcacaggtccagaggcctaggagggaaaaatggttttgcgggctgcgacctgggccctgcttctctgtgcagcctcaggactaggtgccctgtgttctagctgctccagttccagtcatggctaaaagaggcaaaggtacagctcagaccactgcttcagggggtgcaagccccatgccttggcagcttccaagtggtattgggcctatgggtgcacagaagacaaatgttcagctttgggaacctccacctagatttcagaggatgtatggaaacctctggatgtccgggcagaagtctgctgcagtgctggagttctaggggagaatctctactagggcagtgaagagaggaaatgtgggtgttgaagcccctacacagggtccccacttgtacaatgcctagtagagctgtgagaagagggccactgtcctccagaccccagaatggtagatccactgacagtttgcaccatgcgcctgaaaaagcctcaggcactcaacaccagctcatgaaaacagccacagtctgtaccctgaaaagccatggggctgaatggcccaaggccttggaagccctctccttacaccagcatgtcctggatgtgagacacagagtcaaaggagattattttgaaactttaaaattcaatgactgccctgttggcttttgtacttgcatgaggactgttttccctttgttttggccagtttctcacattggaatggcagcatttacccaatgcctgtgccaccattgtatcttggaagtatctaacttgtttctgattttatagtctcataggcagaagggacttgccttgtctcagatgagactttggacttggagttttgggttaatactgtaatgagctaagactctggaggtgtgttgggaagtcatgattggttctgaaatgtgaaagagactgctgttcttaaaatcaaagaaaaatgatgacattttgatacttaaattttaatgaatttactaaagagtatcttgattcatttttgatactctgtgtttaaaataaaatacttggtttattatagaaactctacattccaataaaacgtacagacaatatacccacagtggccaaaaactcagtggttggaaagtaacctcaaatatatttaaaaatgtgaaataaaaaagaattcaaagtattctatggaagggttttttttttttttttttttttgagatggagtttcgctcttgttgcccaggctgcagagcaatggcacaatcccagctcaccacaacctccaccacctgggttcaagtgattctctttcctcagcctcccaagtagctggggttaccggcatgcaccaccatgcccggctaattttgtattttttttgttgttgttagagacagggtttctctatgttggtcaggctggtctcgaacacccgccctcaggtgatccgcccgcctcagcctcccaaagtgctgggattacgggtggaagtgctctaatactaacatttggccaaactgttttaaaattcttcttccatacttacaagaatcgaaatgcaaattatgaaataaatactatataaaagtaattatgctcaacattatatttttgtgttattttataaggtaatgtaataattaggtacacaaagaacaacttttggtgtgaaattgcatttagttctgagtgcatatatctatttgtggcttttttctatttttaataatgaatagagtgctgctgcaattctgcaaacaaatgtatctttttttccttttcttgagacagagtctcattctatacctaggctggagtgcagtggtgtgatcacagttcgctggagcctccacctcctaggctcaagtgatcctctcacctcaccctcctgagcagctgggacttacaggtgtgcggcaccacttctgggtaaattttgtatgtttggtagaggcagggtcttgccatgtttcccagcctggtctcaagctcctggactcaagcagttcacccgccttggccttccataggcccggcttactaatgtaatttaaaagactttacagaatagtgtaatgattcaaattgaatattctaaattagatttatgctgctaacaaaatgttttttaaacgtagggcatttattcatattttcttctctaaataagtttccttatgttctatatttatgtcaatgtctcgatctatatgtatttatctacaaatctattgatttagttttcatgtatgttgtagactttcatattaactatggtaacaccatataatgttaaatcagtacactcatctttgagggactatcatgttattctctcatacgctctttctccttatctttttaattttgatatttgactgttatattttcttatgagagtttagctataaacataaaaaaactaaattattaataatagtattattaataatttatttattggagggctgacacttcaatgacacaatttgaatgaaagagaacagtatcttatcatctgatttcattttttaaagtgttaaaaatattttaattgtatttaattcgtttgatatttttaatcctgatgttatatgccatgtaacagagtatcaagcgacaggttgttaagatattttttcccctaggactgtagtatgatctctcactttttgaatgtataagcttatggagacatatgttactttatattacttccccctgtgatttacattttctaatagcaagttaatatgagaaagccaatgaagtaaaaaaatatagcattgaaatacacctgtgttattactgacaactgggtattgggatgatgctctctgccttctaatgctgaatatttctcttgattattagttttcctgtttgcttatttgttgtaactttttccttactgctcaggtcaaagtttaggtattaagttcatcatctgaacttttgcttgaagacagttatatctcctgtgtaaaagtgaggtcttaacttgtacagagcaccatgtgtgatcccatttattcatgcagttggggatcatctagcccaggcagaactatgtcttgtctgtgccttggcttgcttgagggctgctacccaatcacagccctctcctagcaatctaaaggtgagaagaggacacacgtttacaaaacagtctttcaaaaaataatgggctgtggggagattgatccaatgtaggcttagaacatcagaatattcctctccctaatactgtgaccaaattacattctaaaccttgagaaagactaatcctagctttaccttttgtaggttgaatgggagcagggtagcacattttagtttctagagataccatcaaaacagtgtcatatcagaaatcagctgtggcaggcatggtaacctttatttagtaatgaaaggagataagagagaaagcatacaaccatgtcctactccattacatgattaaatgtttgagagtggattcttttcttctgatcacttatctgagcaagagctggcattatcttctaggtatactcattgggaactgagacaagttttaattctatcagattatgtgtgtgtgtgtgcgtgtatgtggcaattaaaacatctattcaaatgatgatcataattttcctccaaaggactaatgaagtgaaatatcgattttgaggagacttattaggataataaaatgcaatgacattctgaagactaaggctataatttaatttttttctattgttttaccataaaaacaagggtgagaaacctacgaggcattaggacgtttgaatatgttggaattggatctttgttttgattgacattgaacgaccagaccctttcattcagttctgtgtgtctgttgtattcttatgtaaactcatcatttttactcttttttttattttattttatttttatttttgagacagagtctcgctctatcgcccaggctggagttcagtggcgcgatctcggctcaccacaagctccgcctcccgggttcacgccattctcctgcctcagcctcccgagtacctgggactacaggcgcccaccaccacgcccagctaattttttttgtatttttagtagagatggggtttcaccgtgttagccaggatggtctcgatctcctgacctcatgatccgcccgcctcggcctcccaaagtgcagggattacaggcgtgagccaccgcgcccgcccattttcactctttaagagattgtataaaagttttcttctgacctttcttctagtttactagttctctttagttgttcttctctacttttaaacttacctatttcttgagttcctaatttttgtcattacagcaatcattcccagaatttccattttattccctatggcatcacatcttccatttaaattattcttgtcatttcatttcttgaaagtattaattgctgttaaagtccttcagtgtctgacctgcctgttagtctgttttcagtgtttcttctcccgtctcatttctcagaccatctactttttttttgatgcctgctattttttcccctgtgttttgggcattgtgatttgatgctctgtaggatgtttctatttttcagagatcatttatttttgcattgggttggctattatgtagtgacagatccccctaatccaagcaaagattgagcagatctgtgggggctaatttatgtttaggtcccctttacttctagtatatatcccttgttattcctaaataataccctggagtttgtacggctcctgaattccaaatttgtccctttattccttggagccagccaaaagcctcaggtgaaaaatgatattaaatactgagctcgtctccctgtatgcctctcctctctcagactttggcctttcaaaacttttgtgacttgcagccttaccaatacttttaaataggtgtgtgtgtgtgtttacatgtgtgttcatatgtgtgtgttcatgcatgtgtacaaggatatgtgtatgttctatccaccttctcttcttcttctctttgggaagtttagctgaaattaaaatagtctgcaattttgagaagacattccttgttaggaagtaagttgtggtatagcagtgtgcctggaattgtgcataaacctaagagaactggcaggcaattagtcacacagctatgacaagttctacgcacatgcatagaaatgcatcactaggcaattttgttatgtgaacattataaagtgtacttacacaaacctaaatcgtatgacctactgcacacctaaactatatgttgtagcctattactcctatgccacaaactggtacagcatgtaactgtactaaatactgtaggcaactgtaacacagtgataaataattgtgtatttaaacatatctaagtgtagaaaaggtacagtaaaattatagtataaaagataaagaatggtatacctatataaggcatttaccatgaatggagcttgcacgactggagattgctctgtgtgagtcagtgagagagaagtgagtgaatgagaagacctaggacgtcaccacacactattgtcgattttataaacactgaatattcaggctacactaaatttattaaaatttcttttctttcttcaataatatatttaccctagcttattgtaacatctttattctatgaacttttaaaatttttaacttttgggctttttgtaagaaaatttagcttaaaacacacacacattgggcagtcatacaagaatatttctttctttatattctgattttataagacttttttccatttttaaaattttttatctttatttttataattttgagctttttttgtctgtctgtttgttttttttaaaaactaagacataaacagatttgcctagacctacatagggtcaggagaatctgtatcactgtcttccatttgtacatcttgtcctgctggaaggtcttctaggtcaataacacgcatggagctgccatctgctatgacaacaatgctttcccctggaatacctcctgaaggacctgcctgaggttgttttacagttaactttttttcttctttttttgtagagacggagtcttgttctgttgcccaggctggagtgcagtggcgtgatctcagctcattgtaacctctgcctccccggttcaagcaattctcctgcctcagcctcccaagtagctgggactacaggtgcacaccgccccgcctggctaatttcttttgtattttagtagagacgggatttcactgtgttgcccaggctggtctcgaactcctgagctcaggcaatttgcccgtctcagcctcccaaagtgctaggattacatgcatgagccaccacgccctgtctttttttgtcgttgttgttaagtagaaggaacacactctaaaatactgataaaaagtataacaaagtaaatacataaaccagcaacattgtcatttattatcattttcaagtattatttactgtgcctaattgtatgtgctacacttttatatgaatggaagtgcagtaggtttgtttacatcagcattaccacaagcccatgagtaatgaatgctacaacattatgatgtcactaggcgataggaagttttcagcttccttagaatttacgggaccactcccattttatatgcagtctgttgttgactgaaacatagctatgcatcacacggctctacattttacctttactgtcctctacattgtttgcttacccaagccatgctattttttcatttcattatagatgtgagcagagaccgcgttctccttgtcatacagaatggggcattatatttacatatttcagagataatgtatgtgagagagaaaatatactgttttctcatccatcttgtgatttcacaaaattactttgtgtaagattacgttaaattgggcgacaaccctattaggtgtaaaattaaaatacatttctattttatgtctgtgactaggaaaacatttgtgaagattttaagttaaagtttgtcattggacctcttgtttttctactgttaaagattaggactgtggaccaggcgctgtgtctcacgcctgtaatcccagcactttttgggcggctgaggcaggcggatcacgaggtcaggagatagagaccatcctggctaacatggtgaaactccgtctctattaaaaatacaaaaaattagccgggcgtggtggcgggcgcctgtagtcccagctactcgggaggctgaggcaggagaatggcttgaacccgggaggcggagcttgcagtgagccgagatcgcgccactgcactccaggcagggtgacacagcgagactccgtctcaacaacaacaacaacagaaagattaggagtggttaattggtcataaatgaacattgatttacaaaaggaaataaacagaggaagaaagtagagagccttatattagaaacagctttggcagtgggagcaacagctgcagtaaggattattgggtaatacacgacacaggcagcctaaattcccaagagagttctcacaacagactgtcttttgtttctggaagtgcctggaaatgcgctgagggcaggagaagagagaggtaaactatccagacacacaagagtgatgttaggtcagaatccccggccatttgtattgcacaatttcagaaaataaaacctcacaggtgtgggcataccaggacaccctgtctgctaagagtaaataactgctccttcttaccccagggtctccacagttgaccgtcctggaggagaagaggttaactgctctaagagatgtggctgaccctatcctacaggcttgtctgaaaacctttccggtgtattgaggaccttataaatcccaaagtatccttggaacttcttttgcagtttcctgaattgagcaagtttggatttctatgagaattgacatgcaattacaaatggatgaatttataaggaaaatgcaaagataaagaaggaaagctacctgcatagtatatatttatctacactgcatgttagtataatctgtgaatatttctgtatgtgacccaatacttaccataaaattagagaagcaaatgaacaaattaatgattgtattaatgctaaaatatataatttttctattttgtcatttaaacaataaaacagctcattctgatttatttatcaataataagtacctgtgtgtatagcttattattaccagtggagaggtggcttataataaaattataacaatttataaagctatagttaactatgtagaaaagaatggtttaagctcaataaaaatccagtttaattactgcctcagcattgtaatagtaagcaacaaatgcactctagtgggtgcatatagcaatttaaaaagctattcaatctatataaaaccaggtttttcgtttgtcttgttttaaatatttacaagtattattaaaacacattagaaactttattcttagagcaatatccttgtatggctcttcattcatattcatccataccttatagaatcaacaattctatttttcctaaatcatttcataggcaaaacaaactggcttgtctattcaaataaaacaaggataaacaagaaagggagaagggtagaaggaatatattgcaactgatacagaaatgagcttaagttttaagcctggactctctttaaattcatggtcattgtattagtttgttttcacactgctgataaagacatacctgagactaagtaatttataaagaaaaagaggtttaatggactcacagttccatgtgactgggaagcctcacaatcatagtggaggccaaaaggcatgtctacataggggcaggtaagagagaatgagagccaagagaaaagggaaactctttataaaaccatcagatctcgtgagacttactcactactatgaaaacagtatggggggaacccataattcaattatctcccactgggtccctcccacaacacttgggaatcatgcgagctacaattcaagatgaaatttaggtggggacacagccaaaccatatcaatcactaacctcaagagtacccttcattctacttagcaaatgtgcctcttttttttccacattcccatattctttggaaatttcatacttcgtctttttcataaaccttcagcatctttccccaacatctttgcatttaactttctgtcatttcctcttctccatgtaaaatgaagttcttagaaaatagatttcataaactctcatcatcacaactcttgactactccacatttcccagcacttgcatctatgtattctacctgcctccctaaaatttcttatagacctatgcttcccaatacaatagctgctgtccacatgcggctgtggagcataggaagtgaatgaggctagttcaaagtgagacgtgctgtcaggtaaaactcacattagattcacagagagtataaaaattaaatgtaaaatatctcattcaatttgttatattaagaagctatccttcaaaaatgaagcagaaataaaatctttcccacacaaatagaaaccaaggtaattcatcaccactagatcagccctacaagaaatgcttaagggagtcctacatctggcagcaaaaggacaatatctatcttcataaaacacggacaaatagaaaactcactggcacagaagaaacaaaagaataacattttggatatattgggttaaatcacatattagagtgaattccacatgcttcttttaccttttttttttttttagtgcagctgttagaaaatttaaaatgacctacgctgttcatattataattctattaggcaacatttctattagaactctccaaacttccatcttaagccaatctctccaatttcgtagattttttaaaagcagactttagttaggaacattgttctagcacatttcctatctcctacattgccagtttgttttctctcccacatcttttccgattgtatgtagatatgatgttattctccaggttttaaaaagacattcacgtaattcttcttcccaatgagtatcccatttctccagtttcctttttagtaaaacttttcaagagtgtcccaaattcttagtgtttgcattctccttttctcattctttcttaaacttacttttatttggcttttgccctctccttgtcatcctctgcttctcaacaacaaaaaacctcaatgacaacaagctgtttttcttatggtcactattgactctcatatggtgtaaatttagtggtcaattttaggcagtcatctttctggacctaccatcagttttggcagaggtatctctccttcttgacatcgttccttattgagcttccaaaacaccacatactcttggcttcccttcaacgttctgctgttactccttctcagtctctgtttctggaatattcttttccccctgagcacttatgttttacatattctcttttagtcttttctttatgcatatttcttggtgatctcataaaaccccaagaattctcaacttttatcttctgccagacctctgcaagaactccagactaatatatacaaatgcctgttaaatatctctttttatgtttctaatttgccaatcaaacttagcccttctaaaactgatattctgacctccctgactccaaaactgctccagtggcagtttcttcgtcatctcagctgataaaaactcttttcctattgctgagactaaaaatctctgtggagtcaattttaagcctctgggtctcctcttactgatcatattctattgggcaccaaaacttgtctttcatttcgaaactcaatacaaattccagccatttcccatcaccaccatttctaccactgggaatgtacctcactggccccaattcttacacagctctttaactgtgctctctggttctacgcttgctcactgtatcgtgttcgtagcatagaaagtggagtgatccttttaggacacaaattagatcatgcctaacttctacttaaagccctgcaatggttctccatcacaccataataaaagcccaagtgtttgcaatggtgtggctgtgaaacccacatcatctcttttcctccagcactctcctgccgttttcttttactcattttatactaacctttctttgttctaagttggctgaagctacactggtttcctctttgttcttggaaaaaaaaaagttcacgctttaaaagtaggcactggtcgtttgctctccctgaaaagtttctcctctggatgtaacataagaataacgttgttacctactactagtctttgttcaagtgtcaacttcctgataagtaccctgagacaattaatcagaatccctttgccattcccatgtctttgtcccatcccattgtaataaactattctttagttaaaatatggaaaacttgatctttcaaaattcaaatatgtgcattaaaacatttagattaatcattcgcccactccccacttttctgtgatgagtaacaagatttcctctttgcttgactgccaactttctccaaggaatctagaataaataatgaatattttcagtcataatgtttatttgaacttctcagggaaaaacctgaggtatgggagaaaaggggaaagaaaaattgcgtatttaattaacaatggcatgtgaagagagaatgaagactgattacactgtagaaagccttctattggattttgtacttttttctgttgcctgaaatgccagaagcaaaatctgtatcttcctggtggatgctgcactaaatactgaggtgcagacacttgtggacacagaggctcaggccaaaatcacagaggattttatttccttgttacttaaaaaaaaaaaaaaaaaaaaagaatgtttttgaatacacagtatccctaatagtacaggctattgttttttctttaactaactattattattactattattattactatttggagacagtgtctagctttgttgcccaggctggagagcagtggcacagtcagagctcactgcagcatcagactcctgagctcaagtgattctcccatcttagcctccagaataactgagacttacaggtgtacccactgtgcctggactgatggtttttatagagtcaattttattctcattaggttaaggaagtcactaaaagaaaatattttaaaaatacaaatgagaagagaagagactgaatcaggaagcattattcattttgtctgtgattagcagaagtaacctttggagtatgttgtgtttccttagtgaaacacaattatttcacctataaataacactcataacttgactttttaccccctttttgtcccattgattcttatcttctgttgctcatattgttggtttgtggtttgtttcttttggtaatgtttgatctcttttcaagtctatagtaaaagtgaattaagtatcattcagagattttcttgaatcaaggacaaggtaagagtaatttttatataacttcattaaattaagtgcactagaagtactgggatctttagggaactataatgtttgaccagatcaaagactataccaaaggcatgctcttaaaattgtctaaatctaaacacagtgggctggctttttatggaattattaactattttaaaaagttggctatgctagctcttcctatactagaataatttttaaaaaccacaaaatggtagacctagtttattctatataatttgatcatttctgctggttatctgaactttttcagataaggcttctaccatctccaatctcataggtacattctgcatatacttagtattttttctaatcattttatggaccaatgtgaatatataaaataggatttcagatacacggtggccattgtacatctttctttgattgctaagtggaatagggctctctcaaaataatttacattgctgtgtttattccaggaatagcttcagcagttttggcgtggattgtctttaaatctatatcacaatgttgctgctacagataatcataattgaaattaattgtggcctgaaaactatttctattaaaataatagtctacatcagcaatttctttgatgcataaaaccaataataatttatgtaactacatttatttcagtctaaatggagatgtttattattaggctgaacaaggggatatatttgcctgtatcatctcacttttttagaatgaaataagtggttctagaaactttccctacatggtcaaaaatgtatcaaaaattgatatttatcattttgcacttttataataatggttcaactacgaagatgcagctatattgtgaccagcagtgaagagtttttaaaaagataagattaaaaatttgtatacataggaaagattcatagcagtgcctgcttttaaagctctcaggatggcatcaagtatcattaatatccctgacagtatttctttatatatgtcatggacaagtatagattttgataagcagtcaccttctggatcaatattttataagaaattaaatacctttaatgatagaaaactactctggacagtttcatctttttgtaatgaagtttttaaattataaaagtaataatttattgtaattagaaattacagagtgctaagaaatttaatatttgctaatttcattattcatatttttcacttttttgtgacaatgcagtgcactgcaatttggcattttatgtcagtatatattatgggagggtttacacatttttataacattgagatcttatctttggaaattttgagtccaggttttgtcttgtttactaaatcctttctgatactgaaatcactaggaccgttttctatttttttctaacacttttaagtttattctcctaaattgaaccctttaattattctggagtatatttctgcacaatgcacaatacggattttctgaaatatatgccatctaatttatattttccaatattatattgtaaacattttcaaattttaaaaaaagaatgaatttacataccctcagggttctataattaagattttattatattgttttgtcagacacttttaatttattgatctttcgtccattaacacatttcctttttgaataaatttcaatgtatattgaagatatcaatacatttccccttgaatactttgcatattattaacttgaatctgcaacacgactatagactatagtttttatgtaaaaattgcatacaatgaaataaataaatattacatgtattaaatgtatgtattaatcctagtcccgactcacagacacatctttaggtctagttatgttgtttgctttatctattgaaaacaggttgttttcttcttggctctttgtgtatctcatgtttggttgaaagccagaaactatttgtagaagaatgctaggaaccaaggtaaatgaaaattacacagagaaatgggcacacattttcatctgtcaagcagtcagcgtaaggaattctgtcttgtcatgagttgaactaggtttgtgttttgtttttatcattttcagtgctccacagacatcaaattcccagtgttttctttttttgtttttgttttttgttttgttttgtttttctttgtgaccgagtctcgctctgtcacccaggctggagtgcagtggtgtgatcttggctcactgcaaagctccgcctcccgggttcacaccattctcctgcatcagcctcctgagtagctgggactacaggtgcccaccaccacgcctggctaattttttttgtattttttattagagacagggtttcaccgtgttagccaggatggtctccatctcctgaccttgtgatccacctgcctcggcctcccaaagtgctgggattacaggcatgagccactgcgcccagcccccagtgtggttttaattaaagatgggctgctcttgccttgggcttagagtgatgcttagatctttcttctgagttcctgctttgtccctaattttgttcagtccctggacacttggtgcaaaagtagggatcttatctttactcttgatccttccccagcagcaagcttctcttgcttctttctctgggttaggctgctgagtggtggtggtggggatccaattctactgtttggaccactaaaactctgcacctgggatttaaaactaggctttctcagcaacccctactccccagcagcaaacctttgttctgcattagctcagaatgttttggcagataaagttttgtatcttttgctgccaggcaaagcacttttgtttctactttccaccaggacaaatggatcttatctcaatggttatatttgaaaataaaggtatgaattttacattactaaagagaattaaaactaaatttaacagaaattattgcaatatttatatttaagtttcttgaggacacacttaaatattacatttgtaatttgccatgttgacttttaatttataagaactatatcattggattaaagatagtttgaaatgctctgcattcaaattctagtaattccttatgtatatatttctttcttctggatcaaatattcttgtacaaattttaatttttaagtagaaaaaaatatttggagttatgacttaccttcccacacgaaacttttaggtggttatgatgatacaaaatttaccaggtcttctacctgtgcattgcttttatttttctttggataagaaaaaataatgctcactctatcttactggctcatctatctagaatatatgtacacaaacacacagacacttgtattttcttccagaaaccaaattctagaaatttttgaaactataattttcttcttcgtgcactttttttttgccataaacacgtggataagttgtggacattagtaacaaatcaggtatgtcatggcattatgaagtttaaaagtatctgtatgaaataaactctgtacctcattgactcaattcagatatttcttcgttaattaactgaaaagctctacccaaatcatacagccataaagcctctcttttcatctttcaccatcatgaaatactaaatttccttctctactaccagaaatccagtgtttattagtaataaagctaagactcagaagctaaggtatttttccagcaaaccttagggaccctttctctagtattccagatgcacattacaaacagtaggaaaggtaggaagtctttctaaaaaattttccatgtgggatcttgaagacagaattatttactgcccaggctttagttcattgtttcatcattctttttttgaataacatttcataccttatgctttttcttgttttatttttgttatgtgctcagaatggcaaacctgaggtcagaagcagtctatagcttgacagaggatgttttggtcagaagcaggctccagtgtgacagtgggtgtctctggtagctgaaagacaagacattaattaatacctgacaaggtttgcaggcagttgggaaaccctcctgatgaagagcttcttgttctgcttcaagcagccaccatgtacatggccaatcttgtgtgtggaaaaggctctcaagactgttagtcaccatgtgcccactacataacaggaagagagagcttgattttaagcagtgttaggatgctagactaaaagccagtctgctagatttccatacgtgcacttagtcaagttccagccctttctagaagattggctgctaagattactgccttacccttgtggaacagtctcaggctaggaacagcaaggataagtcctcagatgttatgggacattttcctaattcaattggcatgccctaaggaattccataacataaaaacaacctatctcaaagaagttcaaagctttgagaatttgaacccaccaacatgtaatgttatttaaaaaattttaaatattagaagcaataaagttttcacatatgagatcatctaaaatctcagtaaaaccaggctgtttccttactcttgaacaccttacccactgttctaagattttaattagtaacaatatcgttggttattctaatgacatttataaatggttaaaataaactaatatcagtcatgaatacttaaaacagaacaaaacagacaacactgtcaagttttataaaatattaattacctgcaaagctgttattaatgctactagtgtcaaacaaatacaatttggaggaaaaaagtaatacatgtcactttattaccagaatcctcactgcttccttaaaaaagaaacattatattctatgttcaggctcttgaaataaatacaccaaaagtcatagatatattgttattttatggatattaattttaatgtagatgatattataaatttatttcctattatacatagctgatgagtaactttattggttatttaaaatacaagttgtctcatttatttacacagcagctagaagtttcactatttaaactcccagcttaatttttaggtatggttgcagtcataaaaataagtaaattttatacataccatacacaagattaggtttacattttctgtttgcacagttacctaagcctttttatttttagaatgtgtcacaactacatcaaggagatgcttccagatcaaaaaccctgaaaataaaaactttgccttttctggtttaatgtaagagccaggtattaactttagatgtaaacaatccactactgaaagttacttaagtacactagccagacaacaacatcaccatctaggtgataagttgatatcaccaatgaaaatttggctgttataattctcaacacaacattatcagataaagctacacaaaatctgagctggatacaaatccctcccttcttgagaagctgagatttgaaagttgttttcatgactacatcacagataattgactaattgcattctacagtcaaaacatgctgacttgaaagtatactaacaaaaaaagttcaacaagttttccaagctaacgtagattcaaaattgatttaactcttttgttaattggtcacattttattttgttaatatatttgtcttccaatggtatatttttaaagctaaattagtactttcggtaatattcaaaacctaagcccaaactacatttaatgagaagatatttttaatttcaaatgttacaatgcgtttctacttacaatagtttatttaaattgcgtctttagactagtggtgttatcaatagtatctctctacttttgctctaaggtattggttccaatggagaggaacaatgcaaaataatcattcatattctgacttggatcaagaatagtttttgtctttaatgtcatcaaatagaaactttattacctttccttttcttattaaatagttctttaaaagaaatttccaccgactagttaaacatatttatatttatgtactggttaattactgcttatctgaaatgcatagatcaaaagtgtttctgatttcagattttttttatttttggaatacttgcaacatgcataatgagatatgttggaaatggaactaaagatgaaacaaaattcatgcatgcttcatatacacctcatacccatagactgaaggaaattttgtgcaatattatacattatagagtgtacttacacaaacctggatagtatagcctactacaaacccaggctatgtgatgtaatctattgcccctacactacagacctgtataatatgttactgtactgaatagtgtaggcagttgtaacataatggtatttatgtatctaaacatttaaacatataaaaaagatacagtaaaaataagatactataatgtgggaacactgtcatatatgaagcctgtcattaactaaagcactatgtggtatgtgtattcctttgtgatttgtattttcccactaacaagtattaggttttcaacatcgcttttagttctttgaaatgtcagctaaatttatctaggcgtcactttattttattttgttatttttatatgtccctttagggattcattgtactttcaaaatatatagtttctaaactgtctagctctagaaaattctcaggtatttttaagtttaacctcttaaactcgcttccattttttccattccttctactctcagtaatgttttctgaataactaactggtgtttttttttttctttagtaattttcttttcagcttttaaaatatactttgtctcatccatgaattgaaaaattttaggttttataatttacccttctatacttttataaagtttcatttattcaaatatgtttattagtgtttatagtatctacttccgtacttatactttcagtttcatcttattttcttaatgttcttacagatatttatttattttatattacataattaataatatcaatgtctttatttttctaattgttctgcttacttttgtttggatttttgttaatgggctttattatttcatgtgtcttgtaattttatgttttgggtatgttcatttgagattcatgtttaaaattatttggggaatatagatatgaggcattttctttgaaatggagacaaaaagaaaagtcctattttcttctgtagtatacaaaacaaatctcagtaagtgcatttttagtttttgtttgtttgtcttaaattctgtggttagtgaatcatctgggtccaaacctatataaaaggtagttcatggtcacccatactcagaggagaccccctcctctgtctagtaccaagaccaggtcagatgaaatctctttttatttaagtgtctaccggcgagtttgtgttgggggtataaatgggggtgtttgagtgtttatagttcacccatactgtgcgctgagtctcttcatgaagactttgatctgacatccctgattgaggttctttaacatttttgacgtggttacagagaacaaccttggcaaattcctccaaggcaatagtcaactttatcttgctttttcttgatttacacgcctcactgttgcttatttacttacttattatagttctacctttgattattatccataatttgttggacactccaccattccttaatgagattttgaattatgtaaatatatgtatttttttctaaatttttggttatttttcttttttaattaaagccaataatttgtccatatatgtaaataaactcatgaatcatgtaatgtatcatgtctttataccccagagtttgctatgatagtgcattatacagttcatcccatcttgtttgtttcagagcttttttcaacaaacctgttgcttattacaaataaattagcaatgtggcctggccaatttccttttacaataattttcatagaaatataatagatttcttcattattaggatttccaaatttttaagttaaggaatagctataactataatttcaaacatatgtaatcttaatcaaaatatattgtatgaaaatgtgaaaaccagactttcaccactatgtaatacatccatatgacaaaactgcactggtaccccctaaatgtatatacgtatagaatagaaaagaaaacaacctaaattccttaccttgagccttatgataatattgcaacacaggaacaactcaaaggtgggaattctgtggagggaagaaatataaaggttttataaaataggctgaggaatacagtcaattttaaattttgttctaagaatcattcactgaattcttggaagctgtggaaaaacttgggttaccatagacatgaagcagattgtcgtgggaagcaaagactgtagtcacagttgggcaaccgttgcccaggcaatttgggtttagccagacgggtggtgttatggactgaactgtgtccccgccaaattattatatcaaagctctaaaaccaaatatatttggagataaagtctttaaggacataaataaagcaaaatcaggtcataggggtgggaccagaatccactagaactggagtccttataaagagaagaggacacaaaagcactttctccatgcccagagaaaaggccacatgaggatgcagcaagaaagtaagccaggaaagaagtccccatcagaagtcatccaggttgatgcctggatgctggacttttagcctccagaactgtgagaaaatacatttttgttgtttaagacattagtctgtggtattttgtcagggcagcatgagaagactaacatagggaaagaaggatgatcatgagctaaagtcctactaggattagtaaaaactagtctttcatccatctttcataatgatatgtatggttctaacgatgttctgcaataacatatactttcttgaattataggcaacgatgaatatgtccaagctggatgtggggatggaaatgcaaattaacgtctttgagacttggaacagcaatctctgtctcctgtccatgctatctggaacattgtcatggtaactaatgaatgtacccccttttggtagacaattgatctgtttgccttttggaagtacttgttaggagaagagagtaatttgaaatatgagaagggaacacaaatgaaagaaaagtttctgttgaggagataaaacttgactaattatactttaaaaatataatttagtagagttgaagtatcattattctaaaccaatttatagtaagtatgttttcaaattataggataaagtatttcaaaggcaaaattttaacattattttatttaagtactctaagcacctgtgagattaaagagttctgtagaccatgatttaaaagatcaaatctacagataattgtgtcaactctaattagtaaatttagaaatacagcggtgtgaagagtctttcttattttgttctatgaattaccagaaatctctgtctcctttatgataaacctgaatggaattaatttcaaagtgcatgtatgtgtttaatttactaaacaagataaattaaataacaggctttttcaaggagattggatacctcagatttgataaaaatcagaaatttaaaaaggaaagcagcaatgaaatactcataaaattcaacactggaagatattgaacattattctcaaagtattatattcctttacccacgttctttcaatttaagtttttactttaatctcttttgccttttgtttttaaagtgatgcttttatttatctacttatgctatgaaattgtctacatggatatttttgtgctcagaattttaaaataatgcatttattcaaatttgtctaactctgttttttgatccaagtcttatttacttcaaaggaaattcaccttttaaagaacatcactttgaaaactctttaaatgctttcccttgtttgggggttgtgggaggtgaatatgagtactgcattttcctctccctctaagcttaaccttggtaagccttgactcagtaccagataaattaactccatataaaacaccacctagtactatatttctaaaatttaataaaggcttctacttgagacattattttatttttagaaaatttggattgagtgtttttgaggctgaatatatatatatatatattaacagcacttcatagattcactatagtcactccttcttatggatgggactgagaagataatgtatcttccagaaccggaaaaggtaacgtgggcaccaggagtacataccttctatattacactgatgatacaatatggaaatccagtgttgtcacaacaatctacattttgagtatttaagcaatacattggtttgcactccagctgctttagattttgacatgtcttagctggcatcgtgtgtgtgtgtgtgtgtgtgtgtgtgtgtgtgtgtgtgtgtgtgtgtgtatgtgagcatgtgtatgaaaatgtcgattatataaaacatatctttggggttgtgtattttggttgttgtgttgttttaattccattcattttggtcatgtgtgcataactgtatctatttgatggtggggttgtttgaaaatgttccttaggaggatgtaggatgtgatatataatcttcaatacctgttaaatatccatggccttgaatctccagtaagttcatctgccttttatatctttgctttcttcttgtaatatgtgaaccaactgcaatacctcctcctgcttgattctcggaaataaactattcttttgcaaagcatttagcctcttttaaaaagcattaaaacatagcttcctgataactctattgctgcctttctcatcttgattatggatcattttgatgtgatgttagtatgttacaaaagagaagattgttttctttaccataaggtactaattgctagaagacactttacaagtgataggtagctatgtggtggaggaggcagttgctttcaaaggacctgtgcatcatacattttaagacttggcacttgagtattattttctagattaaaaaattacacatttgatgatgatgctctttcacaagtaccgacatcttttaagaaaagacaaattataagacaagtctgcagcagcaaatgagtcaaatgaagctaacctaattagcactaataggacagtaaattttattatactatttattgactccttgcatttactaaaaatgataaccaggcttcagccatgttatacagcatcgagtctgtagtacatctctaaatctgtactgcaataaagcagactatcagcattatttggtgaaataacgtattacccctagattagtcagccactgtggtatagaaaagagaaaaaaagcttcaggtaattaaagaaattgtaagtacttgacattttacatcaaagttcttttgtcacaattgagatgttcctacaaaatgtaatacatattttatcacattttactttaaaatgaatttttattagttttatgagattaacatgtgaaaaagcattttatcaaaatttcatgggttctgattgagagattatacttatacagccctcatggttttaaaccttttgaagaaaattaaccaaaatcttggttaatatttttcactgttattaaactgatttgcttgggccgtgtgtgtgtgtatctgtgtgtataaaactttgttagcaataatagaaatatgatagatgtaattaaatacaatattaaaatctatatatttgtgattctggaaagagagcagatcctctctgtctgattcaaaaaccaattatcatactcaattaaaatgtttgtccacttgcagattgatttagaaagagagggacaaagaggcatagtgaaagggagagaaaaaagaaaagagagaaaagaagggaaagtagaagaataagacagagagagggcaagagaagaggtccctttttcttgctaggagtgtttgctgggaaccaggactggggaagctatacttgctcacttccaccactcgtcctgtcactgctttctttgtgaccttgatttaggaacttaattttatgcatctcatgtgtagaacagaaatgttaacaattacttaatatttgatcactgtgatattttattatgctaagatagtaaatgctacttaaaggtcatcattattaggggcattattctctatcatgttgctgttgggaggatttggtgagttaacatgtatcaaacgctaaatgtctcagtcagttcaagctgctataacaaacataccttagactggctggcttgaacaacatttacttctcatagttctggagggagtagcagatctggtgtctaaagggagtttgcttcttgacttatagatggccatcttctggtggtgtcaggtggcagagaacagacacagagaggcaaatctctccagtctcttcttagaaaagcactaatctcattcatgagggctctgccctaatgacttaatctcctcccaaagtccccatgtccaaataccaaccccttgggaattccaagatgttgactgaatgctgataagctaatgtgtttgcaacatttttctataacacaactctctggtgttattttataattttgtaattaaaataggaaaaacactttttaatttaatattttaaaaattcatttgcaagagaaaacacatttcattagttgctgccatataaatttctgattcagtaaacaagagcaaattgtacacaccacatatgacgtactagctatgtaatagtttcacaattgtgacacgaaaatattaagtgcatatgcttttaaaaaaattggattcacagaatttccctcctcaaacatcaatacacactttaaaaaagttgtcagtggaaataaatcacaaccatagaagaccagaatgcttcaactatatccattttaattatgccagtattcgtgggagaaaacaaatctttccctcagcaatgttattttacttcagcagtgacaaaaattttgtcatagaagaaagacagtactacttttccttttatatgctaaacaatagctctgacacattttttgaaagttggtggtgttgccagtctcagaatttatatgattcatttaggttctgattaaaatacatacaaagaaataaagaatacaataagactgaaatttatacttagtgacaaatttatatggaagtaaaatctattgtaaggaagataaagagtgaccttctctggggaaacaaacaacacttacttccagcttcattcttttgttattaggtgccaagcagcgtatgtaataaaattgttttaagaattatttggaggcctaggacaacattaacttctttcagaggagatttgcatttacttctgccaggcacctctcagagaccctagcagtctgtggtctcctaccccaatttcagagactgagattggaggttggaagtagggttgcttcacccttatttctgaggtacagcttttcagggctccttgctaaattcaggcagtttagcagagccccaaactcgttggctgttaatttcaacttttatccttttcttctcacaaaaccctcaaacatcctgctcatattcattgagtgtcagacacctctttcagaattgaaaagaagaatcctctttgaatttccgtctcctaccaagattgtggcctcataagcttcagagccttgtaaggccccagtccggtttatgctttgtctatggttcttagtaggagggttgctctggattttctagttcactttaaggggacaaatattccatattttctataattttaaataattttccattcctaaggctgaataaattccttctaaaattttgaatctgtgagtgaaggtctggcaagtcaaggttacccacatcaaatcagcaaagaaaaccaaacttttgtgcttttaaaattcattatacttgcttgataagcattctgattctaataacaataactggaataacattagacaatgaaaaataatcaccaggcaagatcatttcatgacaagaaaagtattaacttgggagaaaacagtaatttgggagaaaatattcattcatgtgttcatttactcagtaaatttctatcagtgccttgcgtatggatatatacagcactgagctgggtactgggggtttatgtgatgacaatacggatatgggcccttccctccttagaaggcttggaatccagtgtgtgctgaaatgtgtttcgtgttcatgagcagtgaagagtcatcagtgattaggtttctatgtttaaagtaaagtaggccttagaaatcacgtagtcattctgagcaaactatcgcaaggacagaaaaccaaatactgcatgttctcactcataggtgggcactgaactatgagaacacttggacacagggaggggaacatcacacaccagggcctgtcatgaggtggagggatgggggagggatagcattaagagaaatacctaatgtaaatgatgaattaatgtgtgcaacacaccaacatggcacatgtgtacatatgtaacaaacctgcacgttgtgcacatgtatcttagaaattaaagtataataaaaaaaagaaataatgttgtcaaattttcttttcttattgaaaagtgaaaacttgccaattaagctccactgaatttcctaaggcctcaaaggtaagttagtggatgaacgtagagtaaaactcttccaactctcagaagagttcttttcgtggtaataaaatggcctctttcatcctctgggtgctttgaataatcttcacaaatacattttagacattggaaataatgatacaggctcggaattcatagacataatgactgaaaggccatttttgtttatgtaatttcaaaaattaattataattttaaaataaaatatttagactaagttggtccactatgtcaatctactatactcatatacgattgaacttgaaatggctggcatcaaacacgaatgagaacttgaaacattgtaagttaaatattacctaaaaatctgttatagtttttaatcaaaagtttatttactagaaaactcagttctgctagcacttttacattattctcattgttttattgattataatacaatcatagttttatatctgttttcataacaaattagagatttatggcacttaaagtcaataaaatattaacacatatatagcatgcaactaaaatgtcgtgtgtgtttcacattaggtgcaatctatgactttttttcttcaacatttctttgctacatgactaagttctattatcatagttcaagctaaattctaatttttccttttaaataaagtaaaaattttgaacttttcattacaaatgatcattttataatatttaaaggaaataaaacagaggtaatttgcctacaataccaaaggccattttttattttaacatttgcagaaggttgatatgccaaattgcacttgacccaaagtttgctatttttaacagtgaaaaaatttctagtatttttacagaaattaataatgcaacagggaggaaaaagtgaagtcttacaatgcctagaaactatatgccaaatatttggaacaataagtactctaactccagcagcagaattatcttcctggtacatatttaagtgaggagttgtaatgatgtgtacatttcatttcttaatgtacattcacagtttgctaaacattcagtttgctaaaatatggaaaaataacaaaccgttctcatttctaacaagagaacgcagaagttgcaatttttgtcctgcatgcatattccaagcagcacattaaaaaaaggtaagggtccaaaattcactggcttttacactagggtgatagctgctaagggcattttaaatagtgagaaagataaatggtctttgaattataatccctagtgaaatctgaaataagaaaatacagtttctattacaataaataaaatagaaaacatggtctatgcttcccagaacgccatattgaaaggacaaaatgaaataattagaaactaggactttagctcaaaatacaaaatttatgtcggtagctatcacaaactattcttttcctttgatgtatcaataagtaattcattctttgctcacctgcttatgaccctcacttagcttggaaaaaaatgtgtttttcttctagtgactttattgtgagaaaaataaaggaaaatattacaatgttattatgcttgatgaaaaaaattgaactatgcattattaagaattatcattttgcaaatctgtcataagccacatgggatttctagcatcttcatctttatctgtttgctctgttttggcatatccagaaacctgtgagcaattcttagagacacttttttctatacatacatcaaagtggcaactttttaataatccctaagctagagaaggccagatagtatctcctgcctttgtgaaactataaaaagaaagcaggggatattttatttcttttcttaattgccttccaaagttctcaaggtaagcaaaataaattatgtacacaaaaatgaagatcctcaaaggttgcttgttacggtctagatatttttttactttctaacatatatttatagaattgttatactacagaaagctttaggtaacaatgaatagagccaagcaaaattttttttttaagtacagtaatttaggtggaagttagtatgatagagtagaaaaacatgaagattttactggaagagagattcttagcttttggaatgtaggtttccttttaaaatggaacattgcaaactcaagctactttgtgtataggatctgctaatttaatttggcgattatctaaaaaagttgcctcattttgattgattttatttattagctattaatttcttgtcactaaagaaggtgtgtgggtgtgtgtgtttatgtggagctaagcataatcaggggaagggaggtcatttcaaataatgttttccaccaaaaatttatcctggactctaaattattttcacacaaggagggggcagaagggtgcagcagaaaaataatggacactagagtcttgagtttgagtttcacatgtagccacttataggaaagtaatgtaagacaatttacttagattctctaaattcttcttgtgagaatatgataaaccgtatgaaatccctactctagtgcctggtacatagatgattgatgtttctcaataaaagttccaactatttttcatgaataacaaaatagattgtaacaagtatgtgagttgtatgttgccctctgctgcataagaaaccaaaaacataggggcttaaaaccatcaccacgggtctagggttctgtaaatctgggccagccgtggctctttcagctggtttttctcattgtcttgtgagctgctgggtcagcaagggttggactggttagaatggctatagcttggaaaactcaatttttgctccacatgatctcttctcagtaggccagcacagtctttttctcagagtggagaccaaattccaagaaactgaggtgatgcacatcaggcttcatggatcaaaatgaacagccagtgatatagacaccagagtggacctctataaagatgactgactgagaagtctgtaggtagctatcagcctcccctcactgtgagtctgcacacaaagttctggtgataggtttgatcgttggtcattatgggcaagagtcaggaataagaaatgggtgtgttatttaatagagcaagaacaagctggaatttgctggttactctgcctctgccacaagagcctttcaatggtgttcatatagtgatagctattttttacatcctcatgccaaatcacatgcaaagcctttgaaatcaaccctaaccccaaatcgtactgaggaggggactctgggaaacatagctctacataaaccaaatccactccttgtcaacttttcatccattcacatatatctaaattgtggtttttcatatctctaaagtaagtacataaaacattaaacttatttgttttggtgtacagttctataaactttaccatctgtacagatttgtgtaactatcacaaattaaaaaacaggatggttttatcatcctagaaaacatcttcatagttatataatcccccaaccgtatactttcctaacagtgagcctctggcaaacgggagaatcatttcaagactgaattccttcactcagtatcataactttgagattcagacaacttactgggtgtatcaataactggttcatttttattgctgattcatattccattttgtatacgtctaccagttgaaaacattttggtttgaaaaacatgggctgttatgaacagagctactacgtaaattggtgtataggtttctgtttgcactcaactttttatttatctagtataattcttagaagtagattgctggaccatactacagatatagatagagaattataagacattgctaacgtgatttcctaagggctgtaccatttcgcattcccaccagccttgtctgaggttgccactagctctgcattctctcccgcctttagtattggtattattttaaccattctattaagtgtatagtgatatctcattggagttttaatttgcagctccccatagtctaataatgcacatttttgtctattttctgtctgtataccctatttgataaagtatcttttcaaattatttgtccattattaattgtgttttcaatttccttttacttagattttgagaggtctttttatattctggatacaagtcctttacagatgtaattttaaaagatttatgcaggtgtaaaaatctgtccttccatgattttaatagggtctttgcaagaaaatttttaaaaatacagactccactttgtccgttttatagctttgatcaggtataagaaacttttgtctcatcacaggacaggaagattttctctttaaaactttgattttataactttatatttcagatttggatctataaaaaatttaagaactttttgtgaagtttaagatttgtgtcaaatttctttttttttgtatagtgttggccaattattctaactgctgttgaaaaaaatcacagtttctgatgataaatctgaggtcattagaatttttaggcatttctctgaattttcagagtgaatattcccttaaagcatttttttgttaacttttattttactttcaggaatacatgtatagatttgttatataggtacattgtgcatcctgggagtttgacatacagattatttcttcacccaggtgataagcatagactccaataggtagttttttgatcttctccctcctcctacccttcaccctcaagtaggccctggtgtctgttgttctcttctttgtgtccatgtgtactcaatgtttagctcctacttataagtgagaacatgtaatatttggttttctgttcctgtgttagttcacttaggataacagcctcaagctccatccatgttgctgttagggacaggatctcattacttttatgatgttgtagtattccataatgcctatgtaccaaattttccttatgcaatcaatggttaatgggcagttagattaatgtcatgtgtttgctactgtaaaaagtgctgcagtgaacatatgtgtggcatgtgtgtttatgctagaatgatttatattcctttaggtatgtacccaataatgggattgctgagtcaaatactacttctgttttaagctctttaaggaaccaccacgctgcttttcacaatagctgaactaaattagatttctaccagccatgtataagtgtccccttttctcgtcaaactcaccatcatctgtgttataaacatctgttaaacattttgctaaatttttctcccatcctataggttgtctgtttactctgcttatagtttcttttgctgtgcagaagctctttagtttaattagaacccatttgtcaatttttgcttttgttgccactgcttttggcatctttgttataaaatctttgccagggtctatgtccagaatggtatttcctaggttatctcttaaggttttatagttttgggtgtttttttttttgtatatagtgtgaggatggggtccagtctcaatcttctgcatatgactatccagttatctcagcaccatttattgaaaagggagtcctttccccattgcttgttattgtcaactttgtcatagacaagatggtttgaagtgtgtggctctcaattctattcaattggtctttgtaccagtaccatgctgttttgcttactataggcttgtagcatagtttgaagtcaggtaacgtgatttctccaactttgttcttttgcttataattgccttggctattcaagctctgtatttgttccgtatgaattttaagattttttttttctaattctgtgaagaatgtcattgatagctaggaattgaatctagctatcaatgctttgggcaatatgatcattttaaccttattgattattcctatccatgagcatgtaatgtttttccatttgtttatgccatctgttatttcttcgagcactgttttgtaattctcattacagagatctttcacctccctggttagctgtatttctaggtattttattcttttgtggctattgtgaatgcaacaatttggctctcaggttggacactgttggggtatagaaatactactgattttcgtatattaatttttgtattctgaaactttgctgaagctgtttattagatctaggagtttggtggccaaaaccgtggggttttctaggtatagaatcctattgtctacaaatagagatagtttgacttcctcaattcctattttgatggactttttttctttctcttctctgattgctgtagctaggacttctactgctatgtcaaaataagagtggtaagaatgggcatccttgttttcttctgtttatatattaaggagaatgcttccagcttttggcccttcagtacaatgttggttgtgagtttgtcaaagataggtctcattattttgagatatgttccttcaatgcctagcttgttgtgggttttaaacataaagagaggttgaattttattgaaagacttttctgcatctattgagaagatcatgtgttttttgtttctagttctcttgatatggtgaatcacatttattgatttatgtatgttgaaccaaccttatatcccagggactaagcctacttgattgtggtgtatatgctttttgatgtgctgctgggtttggtttgccagcattttgtttacaattttatcatcaaggatatctgcctaaagttttctttttcgttgttgggtctctgccaaattttggtatcagaatgatgctgaccttgtagaattagtccggttggagcccctccttcttaattttttgaagtagtttcagtaggaatggtaccacctcttgtttatacacttggtagcatttggctgtgaatctctctggtcctgggttttttctagagggtaagcttttctttatttcctgattcaatttcagaacttgttattggtatgttaagggaattagtttcttcctggttcaatcatgggaggctgcatgtttccaggaatttatctctttcttgtaggattccttgtttgtgtgcatacgggtgttcatagtagtctctgaggatttttttttttttttgtatttctgtggggttggttgtaatgtcccctttgtcaactctggttgtgtttatttggatcttctcttttttctctttattagtctggctagcagtctatctgtcttattaattcttaaaaaaaaaacaaagccttggatttgttggtctttcataattttttttctcaacttcattcaatttagcaccgattttggatatttcctgtcttctgatatctctggggttggtttgctcttgttttcaggggctcccaagggaaataatacagtcatggtttcttagtttctgtttctgattgggccagtaaagatccttccttattccacttttctgcctatcaccagagacagaaactaaaaaccatggcttcaagctgctaaaagcctaaaacaacaacgaaataatgtgggttggataagattttatttctttagttttgatgtaagattgttaatttggaatctttctaagtttttcacgtgtgcatttagcactatagccttcccttttaacactgctttagctttgtcccatggattcttgcatgttgtatctttgttcttatcagttccaaataatttcttgatttctgccttaatttcactgttttatccaaaagtcattcaggagcaggttgttaaatttccatgtaattgtatggttttgaatgtctttttagtattgatttctatttttattgcactactgtccaaggctgtgtttagtatgatttcagttttttttttggaatttttggaggattgttttctggttgattttagaatatgtgccatgttcagatgagaagaatgtatattctgttgtttttgggtgtagactttcatagatgtctgttactcccattgttcaagtgtctttgctagttttctgtctcaatgatccatgcccttctttgtcttttttgatcattgcatgtttaaagtctgttctgtctggaattagaatagcagcctctgcttttttcctgttttccatttgcttagtagattattctctatctctttactttgagcctatgggtgttactatatgtgagatagatctcttgaagacaacatatagttgggtattgcctctttatccaacttgccactctgtgccttttaaatgggggcatttagctcatttaatttcaaggttaatattgatgtgtatgagtttgattctgtcatcgtgttgttagctgtttattatatacacttcattgtgtggttgctttatagtgttaatggtctatagatttgagtgtatttttgtgacggagagtaacaatctttcctttacatatttagcacccccctaataacctcttacatggcaggtctggtggtaacaaatgcccttggcatttgctagtctgataaggatcttatttctccttctcttatgaagcttattccagctgcataagaaattcttggttggaatttcttttctttaagactggttagtataggcactgaatctcttctggctcttggacattttgctgaaaggtccactgttggccttatggagctcctttcgtagataacctgccccttctctttaaaccatgtttaacaatttttctttccttttgaacttgcagaatgacgactatgtcttggggatggtcatcttgaatagtatctcacaggggttctctgcatttcctggatttgaatattgccctctctagcgaggttgggaaaatcttcatggatgacatcctcaaatatgttttccaagttgcttgctttctctccctctctttaagggatgccaatgagtgtaagatttgttctctttacatgattccacgcttctcagaggtcttctttatttttgtctcactgagttattttggagagctggtcttcaagctctaagattctttcatcagcttcgttgagtctgctcttaatacttgtgattgtattatgaaattcttgaagtgagtttttcagttttatcaggtcattttggtactttcttaaaatggccattttgtcttttagctcctgtgtcattttattggattacttagattccttgaattgggttttggactttttcctgaaagttgatgatctttgttcctatccatactctgaattctatttctgtcatttccaccatttcaacctgcttaagaactattactggggatctagtgtagttgtttgaaggtaagaagatatggtggctttctgagttgccagagttcttgtattagctccttcttatttgtgtgggtggctgttcctttcatctttggagttgctgtcctttggagagatattctgggggacttttatcttctctgatgtcctttggggttttattttggtataaggtgggttcagtcaacttcctttggttctggaagatttcgggtagccaagcttcagttctgtgcttcctcatgctgtaactctaggggactgggacaaagtccctggttttgttctctgaacccttgaggataggaacctgctgtgttgcagggattgacgtgttcctggtcttctggacacaacactatgatggatgtcgctggtcaaagtgcttcatcaaggtggtggcagtggcaactgtgcttgcttgcatgtgccagcaggtatggtggtgcagcagggtgcacacacattgactggtgtggggcactgatgggagactttgctttcattttcacaagtgcttcatattggcaatatattttggtattgtattttggactatgatccagtaggtggtggtgaagagtgttagccatcagatatgctcttacttggctgcacggcttttttgtgtgtgtttcggtgtagttggcagtagtgctccgtggtggatggggaaagaaaagactcctttacatagtccactcctgtgtcttggaggagccccctctgatgactgtctctgtgctcacatttcttttgttggctgttctggtccatggggctccctcagtcaggggctgcagtttgcagccaggctgtatcctcctcgggtcaccctactcctccactgatctgtaaacccgagcatctcacttctctcagtaattcgagagtaagggatcctccctgcttagacactgcccaaaccagcaagttctgctgagctagaagatgtgggtgtgggtggggtcacccaatttgctatctgagttcttcccaggaaaacatggggttgtgcctgcccagagacttcaggcagtagtgggaccactgcgctggaagctttgggaggtgcggcccatctaactaagagaagtggggtgggtggtgttgtcctctctgccatctaggtgttttccagggcaacaggaggctgtactgcttggcagaattcagaaagaagtgggtcctcttggccaaaagctcctgctggcattgctcacctggctaccagtggcagggatgggtggggtcgcctgccctgccatccaggtgtttcccaggatgaaaggatgctgtacccatcaacacagtccacacagaagtgggactgctgggctattagctctagcatgcattgactacctgattaacagtggcagtggtggatgaatcactcaccatccctggtgtctggttgcttctggggacaacagaaggctgcacctgactgactgagttcacataaaagcaggatggctgggctggaagctctagcatgcattgccttcctggctaccagtggcaggggtggagtctgggggattgctggccctgtcgtctgggtacctcctaggacaacaggaggctgcagctgctggccaagttcaggcaaagcaggaccaccaggctggaagctggtactgagccttgtctggtgaagtagggtggagccatcttactgctcccatgaactgcaactgtggcttctattggagctatagtgcttatgcttgtctgtttcagggtccaaggcttgtagaggaccccttggacttgatggttgcctccacaaaagggagactttctgcctcagcttagaagtgcagtggagggggccaaggggcttctatcattcccaagtcttgcaagggtccctgtggaaagtataaatcccccaagggactctcattcatttaccctttcctgagtcggggagcttctcctggctccacattgggccctgttaggctagtgcccagttttgccccctctctgttctctgtgtccccctgatgccttgatggatcttagcatggcttcttacatgatcagcctgtagggtcagtgttcaccagccctatgttttgctttccatgagtggcacacatgagctgctctagtctgccatcctgacccaacatttagagcatttctctataaaaatatattatattttattttaatttatgccttttcagacattcttttttaattttcatagatccactgttctgacctatgtcatattccttctacctggataatttattttaacatatcttgtggacagttctgctggcaataaatttcttgttttccattatctgagaaagtttttacttcttcacttcttaagaatattttctctggacatgcagcttctgattgtcaactttttctttcaaaatttcaaacatttcagtccagtgtcttcttacttgcctggtttctgatgagaagtctgttgtaattattggtcttgttcatccacaggtgacatgccctgtctccccacctcaagctgccttcttggttttctctgtggatttttgtcttcagtggtatgaatatagtatgtctggtttgatttatttttgctcgttagttttatctttatatttattctgttatggtgcagtctgtgcttcttggatctgtgtggtttgttgtctgtaactagttttgcaaagttttgggtaattgattatttaaaaatttctgctgctctaaatatcttctccttgtgggattgcaatgatgatgtatatcttacattgtttattacctcagagttcctgtttgtcatattctgtgttttcgactttttgctctttgcatttcagcgttctattgaaccatcttcaatttcataggtaatttggctgtcctaagtctactcatgggctcattgaaaatattttcagtttttgctactgtttctatttataagatttccattggattctttcatataatttccatctctctgatgatattactcatcaaatattgcagattttctgcctttaattattttaaattcctctctaataacttcattgtctctgttgtatctgagtatggctctgatcattactttgttttctcacattgtgctttttcttgcctgtgggcatgctttctacatttttcttctgaaaattgaatatcttttcacaaggcaacggatgctttagtagataggactttactgtgagaattttaattaatttaatctgtactcgagctatatttgaagtgtgttgttggtgtgggaaccagaggcttcaaactcctctagtgaccttgtttctaatctcccttctgatttgggtgcttcccttttagccatatctcagagaaagtctatctgttgccactcgtaagctgcagcccactgttgtattattaatgggggcttcctagcatggttagagcatgggaagagcattatctaatcttctgattaagtctttgtctttggagtacacaataggcctgtgtctcaggggtgtgaacttcagaaacatttctatttctccttcagggctagagacttttccctctgtcctcctaacccatttcctggttgcaattggacaattttcctaatgtcccttaggccattgttcttgcagattatggctttttctgtgtcctaagcaagactgggaggctgcagctgcacttagtttgcttcccttaactataatggaatttcactactcaggaggcgttactcattttctacccctgtggactgagactttgttctgtaagtgaaaaggatgtctgggcatctcacttgtcccttcccacaactggtactggtggggcgtgtgtaggggggtactttttgcagatccacattttgagagactttgggggttcttgaaggaaaaggctacaaaagcatggtggtatccctacgactattgatcccaagcatttctcactctcatcctagcccatatttggcttccagcaatttgtcagaattttcagtttgatcttacaattggtttctgtggattccagtggcttctgtccaggtaagaaaattctcaaatcctgtatctcgttgcaggtgccttggggatagcagtttgtcccgagacctcaagattcatgaaaaatcactggttttaaatttgtgtagttctttctatctgaactgaacttatgtcaattaattttttttatatatcaatttataatctgactaagcaaattgcttgatattttctttactaaaataaataaaaagtggattgaagaaattaagagcttcttgcttacaaacatagaacatataatgcatattaaaaccttaagtattttgagtttttttttttttgcctttgaaatagtactgggatacttcagagttttgtaaaaaaattttttctttttttttttttttgagactgtgtcttgctctgttgcccaggctgcagtgcggtggtacgatctccgctcactgcaacctctgcctcccaggttcaagtgattctcctgcttcagactcctgagtagctgggactacaggcatgtgccaccaggcccggctaattttttgtatttttagtatagacggggtttcatcgtgttagccaggatgatctcgatctcctgacctcatgatccaccagcctcagcctcccaaagtgttggggttacaggcgtgagccactgtgcccagccctgtgaatatttgaataaagaaaacaaatgtgaatctttacaaacatagttccttatataaagttctagaaatgatagttaatttgagaattcttaaggaaaaaattagattgtttataacaacactagcaaccttaattttttgagcagcaatcagagtttctgtaaacacttgtcattaaagaaaataattgttttttaagatttattaaactttttttagaaacttagacaattttataaaaaaccactaaatcagagattatttggaaactctaattttcactgtactgtttttgtatatttttcatcagttagagagagttttcagtgatggtagaaactaataatattttgctcacatatatttattatttgtgagaaattatttttgaataggtttcttatttcccaattgtttcttttacagagatttattggtttaaatggtgaactggtggatatcttactcacctcttgtaccagaggtttctgccttcataatttttgtatataatttggtaccatcaataatgtgcttttgcaaaagcatagtaattggtgtattaacaaaagcacatctcatgcactcacaaatgattcttattggagaagaaagccaaatatttttccatgataaaacagtatcatttactattcttaacgtcaagtagaataaaagagtactgaaaacataaccatactgtgtaacagtaggacaagtctgtgctttggatgatgctgtggggtgacttgtgccccctccctgaagtttgtatgttgaagtaattaccagtacctcaggctatggctgtatttgggaataggatcttttaaaaggtatttaaggcccttagtatgggcttttatccagtatgatttgtctcctcattagaagagattaagatacagacacacacagtggaaagatcatgtgaaggcagaggggaaagatgaccatctacgagtctaggataggggactcaggagaaatcaacactatcaacgctttgatcttagacttccagcctccagaccatgaggaaataaatttctgttgtttaagcacccagcctgtgacaccttgttatagaagccctggcaagcaaatataggtgattgaggataatcatttttggattacagtacagatctggatgaaggccacctgtctcaatgaaagcaatcatcagtctcattaagttcttgaagataattaataacaaaccaaagaatagaaataatgtaatagccttatgacagtacagtgggaaatctggacaaagcttagaattcatgacttcaaaaactatcatctttttctaaattttttattttgaaaattgttaaattataggtgttgacattagggcaccaactcatttttattagttaatccttttcaaagaagactatggtctatttataagagctccagagaagaatgtgtgaacattgggctgtcacgattctctcctatgctcatatgttaagacattgcaaccatatcatgttctattatttcacaggggtctagatggagtctccgtattctttctgaacacagtgttccacaactcccatggctattggtgatacttactcaacttagtcactaagaaaatgatttttcaggctaccatgtgcccgacactgctataggcacaagaaaaatagtagacaaaaaaggagtcaagcagctggtctggaatccattgatttccctctaccaggaggatgctcagacagaaggcaggtggctttcaatggcatcataaactctttggcaactgaccttctggttactaactaatggtatgtgttatttcattaacaaaataaaaatatttttggtagtttgtttctggtttagcatttcttttggcagacaaacttaactcctgtgggcatgaatccctggaaattttcatgtaaattctaactatctaagtaaaaaaacaaatagatgtttcatgacctaaaatattgcttgatgtttcagggtgactgtgatctgcatttggagacttcatccttcaatctgggacagaaagcacatttccagcagaaagaacctgaggagtcacattctgtcccagctttctctaacctttgcttgtgtttcttgattcttgtggattgaaaatgatgagcaaaccttgattctgtgcactgctttgccattccagaacaacagcatggttttaacaaggagacgtaaccttcacgaccattgtttctaaagtttataacaattagagttatttcttgaagtataaaatctgtaaaactgaatacagtcttctgagctattattacaattgcagttcgtcaatttctcctttgaaaaccttggggcaaaatataatttgaaattcggttattttttagatgttaggagataccagtcaggtattataaatgttataacagctgcagtagatttgaaggcatagctccatactcaaaaatgttaatgtttctgaaattaaacatatgaatatttatacaaaatatcacacatacagattataatatgttgtttcctgtcagttcagactatgccaccaaaggagttagaaaaaacttttagttttcagataattttggtttataatattataaataaataattatgcaactgaattatcattatttatttctacatttttaacaaaaacatttttcaaagcatttttgacttcctgttttagattaaactgatttctttttctgcctgttgtgggctgggtatttttatactaccttgtgtatttaattaaatgcattgattcttgcatcccatgacttccttactgcttttttgttttcagtttagctaaaacatgctcaagcagttttattttcaaatggatacgtgggggaaatttagatgcttttgcaagaacaaaaatatgtttaattgtttgtacacgtaatttataatttggttgggtaaaaagttctagattccaaattcttttccctcagaacattgaagatattgctctattgagctttgaactcagtgctgttaatggattctttgatgacagtctggtttgcatttatttgccaataacctgatcattttttaaagccattagtatcctctcttcatcttttattctttgaaatttcaacatgatgttctaaggtgatggtcctttttaaatttatcctggtggttacctggcagagccttttattacaaacgcttttatctactttttaagcttagctatttttcttattagtcctttgttttcattcttcatctatatattctgttcctttattctaatgtaatatattttgccatcctggtttaattctatgtatttcctaacattttatgcatctttttatttttatattttttctttgtattatgggaaattcttttaattttaatatttttgtataatttcagggcttttaacaaagcaaacttgttctcatattcttcaacttctttatatgaccctattatttttaaaaaatataatatcctctcatatatttttgtgaataaaaattaaagtattttgaaagttgttctcattcccttaaatatgcctgttttcagtactaacttttttgtttattaatctttccctttcatgctgtgcacttaaccacagtgtcatgatttgtgttcttgtacatgattggtaaggccactacctgctaccaggcatctcttgtaacgctcagatcctcacactccacattcgctatgtcatgacctgtcaagatccttcacatgatagctgcttgtattttaaaaattaatagaaacccaataagtgcaacagaacaagctgcagctctcctcaccatggttgttcccatagccataattgctattcatcatttccttcctctaccactaattctagattcctctcattcttagccagtatgtctgctggcccgtgaccttgcccagcatcctgctgtgatcctcagtcataaaactatttgcttaccagttttgtattcaccaccttctccagtgcagcacccacaagacccattcccaagcatgttttctgagttacttattgtgtctattgaccacatctcatagctccttttgtgaataacctccttagtcttgaagggagaacaagacttctttgatcaagtcatgcttaaatgcagccctagttttagtcaagtagcaatgaagtgagtttgatgcagatttgaagacaagtatcatcttgcaaagcatccactagagaataggactttccatggtcttcaggggagtggaggctgctttccaccagcaaagtggagaacataatttcagaagctagaggccttggacctttatatgtgtgtttgaaacacatccaacaggatgttcctactccaggtctcctgggaccacaccttcactgtcaaagcctgaattgcggtgtaggaatgcactatttttttattgctgcaaacaaaatactacatccttgtcagcttcaaacaataccattaatgtcaaacaaaattctacaaacttgtaagcattaaacaacaccattaatttattaactctgaaaatctgaaacctgttcatggccaggatagattctttgttcaagttctcacagattaaattcaaagtattggcttatctaagttttcagctgaagattaacatcctctcccaagctccggtgcctgtgacacaattcagttccttttcattgtgggactaaagtgtttttttcttgctagatgacagctagatgcagcacaaagaggctgcccacatttcttgccatgtggcagcttctatcttcaaagccagcaatggagaatctctcttgtgttgaatctctctcgtgaataaatttcttttgccaggaggacttcagtgttattaaaagactgactgatttggccaggtttcttatgttcatgtcacctggttagagtattaaatacgtctgtaaaattcctttatagcagcacctagattagtgtttgattgaatacctggaagagtggtgtgtctaccagggatgggaatcttgagggccatctcagaattctgtcttccacaaggagacttgcgagggctgtgaattcagctttctctgcacttctcttccctcacaatgcattccttgaattgatatgcagcacagtcatctttctagatacaagacatggggcccttaatactatccatagagactgtactgggttgactggtgttcctccgaaattcatgtccacatggaacctcataatgtgacccagttcagaaaaagagtctttgctgatgtcattagttgagattaggtcatactggattaagtgggtcttaatttaatgactggtgtccttattagaacaccacagaagctaggaagagacaagacagaatccttccctagagttttccaagagagtgtatagccttgccaacaccttagatttacagcttctagaacaggagaaaataaatttctactgttttaaacatacagtttaaaacagtatgtgttactatacaactaatgctgaggaaactaagatacaggctttctgactttctgaccatgtcctgagtctgtagttgtttaaccaacactgttattttcttcgattagtactgcaaaaatactaaaaattaataaaccaatatgacagtccttatgattagcattgccactgtggagatattgcaaaaaccagtgtatactttcctacctatatcccgtcccacatgaccatgggtgagaatcccttagctctgtgctacagcaaacaaacaggtgcacaggttttctctatatatgtatatctatatacatatcattcttagctctatatctctttttattcctatatcaatctatctacagatttattttaaggaattggcagacatggtatttcggctcccatctgaaggaagtctggaggcacaatgccttcttcctcaggggaaatcagtcattttctcttaaggccttcaatggattcaataaggcatattcaccttctgaggagtaatctgctttactcagattctactgatataaatttcaatttcatctaaacatgccttcacagtgacatgtgaacttgcatttagtcaaatatacgggtattgtggaccagagaagtgggcacataaaattaaccataatcagctgggcgcgggcgctcatgcctgtaatcccagcactttgggaggcagaggggggcagatcattaggttaagagattgagaccatcctggctaacatggtgaaaccccatctcttttaaaaataccaaaaattagccaggtgtggtggcatgcacctgtagtcccagctactcaggaggctgaggcaggagaatcgcttgaaccctggaggcagaggttgcagtgagccaagactgcgccactgcactccagcctgggagacagagcaagactccgtctcaaaaacaaaaaaaaaaaaacaaagcaaaaccaaaaaaccataaccactagcaattgagttctctttgctatgtctgttaagtcaagaaacccatatttctaggtaccaatcatgttacttaaataacagtaggtaaaaatactgtatactggttatacttaaaaatcactttattgaaagtttctgataaaaattttaatgtttctttttaacttttaacttatgagtgaagaataaaaaaagtactatggtgaaatactatcagtcttggaagggacctcacagctatgtattttagtcctcatttcacagatgaggacattttgataaagaaaaagataagctttctataagtgattgttagtttcatcatgcctttcttatttttcaatcattttcccaacatgacaattagtggagtcagtggctcattactggggacatatggctaggtttgctttgttttatacatgtattatatttgttacggcatttattccagttaaaagatatataatatatgcacagatcgtaagacatgtgctaataattccctgactgattctaatgattttcttggtacttttcttcttgtttcagctctgtatgtttactgagaatttctgaatatcacaaattacaattggtggaaagcttttgtttttaccacctcgattgaatttggccactgtggcaggagatttttacaatgccaaatattcaaccaagatttactgagcccttaatttatatttggcaaaaagaagaatattgattgtttaaagcattgatcttgtcaaaaagtagataggaaaagcacattactatttttaataataataacaaaataatttttcaattagacttatataaggtttcaaaatataacaaatataaatttccaataaaattattaaattcaacaataaacaaataactttaaattaagtccacaagcatgagttgttcttctcctatcacacctgtcaaataagttttttttttttttttttttttttttttttttgagatgaaggttcgctctgtcacccaggctggagtgcagtggtgcgatcttggcttactgcaacctccgcctcccaggttcaagcaattctcctgcctcaacctcctgtgtagctgggaatacaggtgtgtgccaccacacccggctaagtttttgtatttttagtagagacagggtttcaccatgttagccaggatggtctcgatctcctgaccttgtgatccgcctgcctccgactcccaaagtgctgggattacaggtgtgagccactgtgcctggcctcaaatacaatttttaatgtgaaaataatcacttaaatgcatttttcctgtatagcagattattgcacagttaattaactgttttattatatttatgttgcttaaagcttcacaagagtcactgcatttcaacttactactacccaaataattttattaatatgcacttatcttaaagtctatgccttaataaaattttatgtataattatgttaaatattacatgctgtgtatttgccaagctatattatttatgaatattggttctaatggcagcgtttggtttgaagcatcaaacattcattttatattttataataaactataattactagtttggagaaaaaaatgaaagcatacattgatttaaagagctaaatgtcacacatgttacataatagaatggttttaagccagcatcagatgctttacagaatgcttttaggaaagaaaatttacagctaatggaactttgggaaataaaattataagaaataattacctgtgacacattcataaaggaataaggatttgaacaacatttgaggcaggattagcatcttgactcacattttaaaaattagccaacaacctgatttcattcaagaaatgattgttcttttcatttgagattattaaaagggaagtattattattctgtctgaaagaggcttgaagacagaaattccccaagttgggtttattttaaaaactgttggtgggactgtaaactagttcaaccattgtggaagtcagtgtggccattcctcaaggatctagaactagaaataccatttgacccagccatcctattactgggtatatacccaaaggattgtaaatcatgctgctataaagacacatgcacacgtatgtttactgcagtactattcacaataacaaagacttggaaccaacccaaatgtccatcaatgatagactggattaagaaaatgtggcacatatacaccatggaatactatgcagccataaaaaatgatgagttcatgtccattgtaggaacatggatgaagctggaaaccatcattctgagcaaaccatcgcaaggacagaaaaccaaacactgcatgttctcactcataggtgggagttgaacaatgagaatacttggacacagggtggggaacatcacacactggggcctgtcttggggcagggggagcggggagggatagcattaggagatatacctaatgtaaatgacgagttaatgggtgcagcaaaccaacatggcacatttatacatatgtaacaaaactgcacgttgtgcacatgtatcctagaacttaaagtataataaaaaaatttaaaaagctagctcaatattcagagatcaatgtcatccaccatattagcagtcaaaagaagaaaaaccacattattgcatcaatttatgtagttaaagcatttgacagaacccaacacctactcttaacaaactagtattagagagaaacttcaactccataaagagcatctacaaaaaagtcctacagttaacatcatacataacattgcaaaggtgaatgctgtcctgctatatagaaaaaacggtaaggatgcccactctcatcactcttattcagcatacgactagccagtgacataaggcaagataagaaaaagaaatgcacacagattagaagagaataaataaaactaccttatgtgtgcatatgacaggattgttcgtgtagaaaatcccaaggtacccaaagaatctcctagaactagtaagtgagttttgcaacaccacagaaggtcaaaacaagtaagtcaatattttgatatattatcacagaatattttgaaactgaaaaaatatgatttacaatagctttaaataaatctgacaaaacacgtagacgatctataagctgaaaacttcaaaatgctgatgaaaaacctaaatatatgaaatgctaggtttaactcattttccttcaataatctggcatgaattcttatagatatggttaaatctaaaattatatggaaatgaagaaagaactagaataacacaattttaaattaagaagaaaaaaatcgaaagaccatacaaccagattttaaaatttagtgtatttctacagtgatggaaaggctgtggttttgcacagaaatagacacacagatcaatggaaccaatgaaaattgagaaatagaaccagaaatgtagaatcaactgaattttgagataggcgcaaagaaagaggagtgttttcaaaagtgatgttggtgcaattatgcatccatatgcaaaagaatgattcttgacataagccttatacctttcaaaaaatcaaatcaaaatagataattggtaccaattaaaaatatacaattacaaaacgttcagaagacaacaaaagaaaaaaaatctatgtgacctatgaataagcaagcagtttgtgaactcataaaataaaaaagtaataaattggactttttcaaagttaaaactatttgctctgccaaagacactataagataaccacacaatgggcaaaaatattttccaataatatatccagcgaagaacttgtattcaggatataaaaaagggttctttaaacttaacattaagaaaacaaataatccaatcagaaaattaaatacacttcaccaaagggtatgtatagctgacaaattactacatgaacaaatatttaacatcagtaggcattagaataatgcaaattaaagcaaaaattagatatcattatataactactagaatgggataaataaataaataaatgaataaatttgctccaccaagtacggataaggctgtgaagctctagaatctcttacatcttgctggtgaagacacagatgtgtagtaacttggaaaagaatgctggcagtttcttggaaagctaaatatacagttatcacatgcctcagccatcccatttcagcatatttatcctggagaactgaaaacgtatattcaggaaaagaacctgtacacatatttcatatcatctttattagcagtagccccaaaatgaaaaaaatctttgatgtccttgtgtaggagaatgaataaacaaactgtcattcatccatataatagcatatcattcagcaataaaaaggaacaattcactgatgtgcacaattttaatgaatataaaaaactttatgataagagaaaataatctgtctcaatgggttgcatagtatatggttccatttatataaaatcaaaataacaagcggtgttgccagagttaaagtgtggagagatgacatgactatgacagggtaatacaggagtttctttggggtgatgcaattcttgcctattctgattgcggtgttggttgcaagaatcgatacatgtgataaaattttgtgaacttctacaaatacaaacgagtgcataaaaaataataaattctgtataaggtctgcagctaacagtattgtaccaatgtctattttctagatttgataattatgctatggttatgtaagatgctatcatttggggaagtcaggtgaaaggaaggtgagaaccttctcattatttctgcaacttctacaacagtctaaaattatttaaaaatgaaagtttacaaataatatattcagatattttatatatatgtgtgtgtgtgtttatacatacacacacacacaccatggcatacataataatggggtaaatgctagtgtatatttccaagatttccatttttttacatagttggtgccatgttgtaatacatttttttaaaaaatgtaatactgtcttgctctggttataaggtcttggctagaggccagtcaggtctcttcttgagcagctgattaagtccacacccaaaccacttcctttatggggctttcacacctttcacattccaggcctctatgaacctgccctaattgttctagggccaagtatgacaactagagacagagcttttgtcatggagcccatgacattattcaaattatcaaagtgttatgggctgatttgcatccccattgcgtccccctcaatttaatatgttgaatccttaacgcttcatacctgagaatcaactatatttggtaacagggtctttaagaggtaactaagttaagatgaggtaattagggtgtgtcctaattcagtatcactggtgtccttgtaaagaagaggaaatcaggctatatgaacatatagaggaaagattatgtcagggcagtgggagaagaaaccaaaaagaaactctcagaagaaaccaaccttgccaacactttaatcttggacttcaagactccaaaattgtgagaaaataaatttccattgtttaagccacctagtctatattagtttgttatggcagccctagcaaactaatgcatcaatcttcagagagcacaaacacctagctactaaccccattccactcaacatatgtgaactgcctctagcagctccagcttgctgtttaaccgtgtccctgcatgtgacaccttgtgtgaccctacctggcagccttctctcacttgcagctgtaagcagcaaagacttcttcctttcatctcttcaagcaccagtgtgttctgtcctaccatcaatgaatctctaaatttcaaaaaacaaatattaattttagggtatcctgtgaaaagttaagaatgtatattgtagtacctaaacaagccactaaaaatgatgcacagaagtatcagtagtaagctgacagacatattacaataagatcctaggagatattcaagttatccaaggaaaacagggaataaacagcacctaaattgtttaatattaacggacaaaacacccagttaaaagatggatccagctaattgttgtatacatgagatgcactcacaatatacagacacagaactgtaggagtaaaaatggttgtaaaaatgtaactacaaacagtgactctaagaggcctgaaatagctatattaatataaaataaagtacaaaacagcaagtactacctgtgataaaaaaatgacatctcacaatgataaaagtgtcaagcctataggaagacataataaacttaagtgtgtatgtacaaaataacaactcctcaaggtaaagttgacaggatccaaggggacaatgaatttttcttcaattttatttggaaaaatgtgaaacaatgtcttagcaattgatagaattacttaaaaaattgaggacaaaggtgatctgaactaaaccttatgaagaattccaccctgccaatttagaatacagatttttttttcatatttgtgtggtggtgtatttactaatgtagaacatatgttgtatgacaaaatagcatcaaataatttaaaagaactggaataacacagtgtgtgctgaccacaatagcatttagttagctatcaataaaatatcttgtttgaacctaactatttggacattaacataaagcttaataaccaatgggtaaaaagtaacttgtaaacagaatgagctcttcattgattagtgttcgcatgatatgtctttctccaatcctttcactgtaaccaatctaagtctttaaatttaaagtgggtttcttataaacacaacataatagggtattttttaatccactctggcaatctgtcttttaattggtgcatttaaaatgattattaatatagttggattaatatataccatgtatgtgaatgtcttctattcattccatttgttctttgtttcctttttatctttttctgccttctatggttttaattgcacattttatataattccattttatctcctcttagcatagtaactatacttcttgttttaatatttttaatagctgccttagaatttccagtatccattttaactaatataaattcatcttcagataacactatagtgcttcatgtataacgcaggtactttataaaaaagtattcccaatttttcccttttgctccttataatattgctgtgatttattttgcttattcatatgctaaaaacacccaatatatttttacctttatttcaaacaaagttattttcaaattgattaagaaaaaggaaaattgatctcttctttatttattccttctataacactcttcctttatgtagatttgagacttgtaaaagctaaattgcaccacacactagttaaaaacagcaaagaagacttatttaactattacaataagggagagagcttgaactcaactcagctgaagcaaaaggtgaggccatccgtgtttgctaatagccacttatgaaatttaggctcctattctcccacagatctgagaaagtctatttctccttcacttttgaaacagtttcactggatatagattatgggttactgggctttttttttttttttaccactttaaatatttaactatcctttttttgtgcattcatagtttctgacaggagatccactgaatttcttaggcatatgcctctgtgagtatggtgttttccctctctctcctttgagttattttaagacctttgtctttggtgtgctacagtttgaatacgatatgtcaaaatgtaattatttttcctttggtggtgttctttgagctttctagatccatgtttagagtctgacattagttctggaaatttctcagccaatattacatcaaatatttcttttactccattctctttcttctcctcctggtgttcccactatgcatatattacagctattgaaattgttccacagtacgtggctgttgtattctgtcccccacattcagtttctctttttatttcagtttggaaagtttctatgcatttgttcacatttttcaaaacacaatgaatgtacggtcaagatttgtgcatttcattttacactgaagacatgagttcggccaggcactgtggctcattcttgtaatcccagcactttgggaggcggaggcaggaggatcacttgagcctaggagttcaatactagcttggacaatatggtgagacttgtctctacaaaaaaaaaaagttaaacatttttttaaataagaaattagctgggtgtgtttgtacatgcctgtggtcctagctacttgagagaccgaggtggggggattgcttgagcctgggaggttgaggcagcagtgagccatgattatgctactgtaattcagtctgggccacagagcaagatgctgtaaaccccatttctactaaaaatacaaaattagccaagcgttgtggcgcatgcctgtaatcccagctacttgggaggctgaggcaggagaatcgcttgaattcaggaggtggatgttgcagtgagccaagatcgtgccactgcactccagcctgggtgacagaatgagactcagtctcaaaaaaaaaaaaaaaaaaaaaagaaagacaaaaatttatgataaataaattgtgaactctaattaacaatataatgttggagtatttgagtaagtaagttaatttctgctactatttgtgtaattcattgaaagagttggatgattgatagattggcggtggcagatggatggaaggatatgggataaaacaagtcgagtagaattctatttgtagaatccccatggtgagtagatagacattcactataaaattattgtataactgagatattcctaataaaatatttgaaaaaaatacaattgctcaaaatctcctgaggactataattgaacaaaatgaggcaatcaaataatgaggaaaatgttgaccagagaacccatatcaatctgtccctagataggccgcacttatttttgtacaaagagtattatttgttattaacctaaactctagttttgttattgacttaaacactaatttaaggtcagactcaataaagcctctcacatttgaaataaaataattttaacttaatacagtaatagacctttaaatcagcagagtagggttaaacatactatgtcaaagatatcaatgaggataaaaaggatcacatggtgatatttaaaaaacagaaattaattgtatgactgttgaagttaatgactttatactagagggaactcaacgatttaacagactattttgtgttctttatcacattatatagggtgataaaccataaacttgaaaggattctcttttattttctctccttatcagtgccataaacatgcattctaatagtgagtattttccttttgataaagtggcaaatgaaaagttttgtattaagtccagagatagatcagcacatatcaaattagttaatctgcatctgtgctgcttcactttgatatattatctagccatcctgacctcgagcagacatgttcctgctgatccttctggttgtctgatgctcaggacttttttctctgctatttctttagatccctctagcattgggtgcatataatcacagatttcctcgtggctatttttggtttctaatctatctttcagtttgggcacagcttcattctttgatattctatttacagctgcctagagaccatcaccctttgaatgtcaccaggtaacctgtgattcaaaatttttttacaccaactctactacacagtcttggtatcactttttaaatcaaatagactagaaatcttacagtccttttcactattctctctgttccttgttttcttctattcttttattctctctatgacatattcttgcttttcttcaagtttctctggtatgtggatttttcctcatgttacaatcatcatgaggtcaattccatgcccctagaacaatcaattattcagttcatctaacaaaaagagcatataattttgaaagtatatccaagtaacttctctaagattcagaacaactttttataaagtaggaacaatagtgatattaatgaaagcaaaaatatacatggatgacaatggagcctgaaatatattgtttataaagagttataatggcaaagtcttcaatcatggcctctagggaggcatttttgttggattacaagaatgtcttgtcaagtacgtttctggctcatgagaactggcaatacctatatatgaacttaatcaaacttttttgggtttaaaccatctttcttttatttcaccatagaaaaaacacagaaagatgctaattatgtgacaattcttagagaaaaaaggtaaagccaagagccagattattttattttcagagaacataaaaaggaacaaatctctgtatgaaatttttaaagttcattatagaaaatatgagtaaaaggaaatctcatacttctagtgcagataaaagtcctttttgtatgcacttgtgtgatttaacaaaattagcacattactggatagttaatttgccatctttcaagttctttcaaaattaacatcatgtaataagcaattttccatccattaactcatcctcatgagcataatataatgcattttatatgataaattatgcttcatgatctaattgatcttgttaatatttttatattagagttttttcaattttgtaatattgtttaaaaagtttttattttttagttttatgggcacataatagatgtatgtatttatgaggtacatgagatgttttgatacaggcaggcaattcataataatcacatcctggagaatggggtatccataccctcgagaatttatccttacaatttatccaacaattcaattatactcttttagctattttgaaatgtacaattatagtattgttgactatagtgaccctgttgtgctactttttgtaggtcttattcattcttccatttttttttgtacccattaatcattcccatcttccccctaccctcacactacccttcccagcctctggtaatcatcactctactctctatctccaagggtttaattgttttggttttcagatctcacaaataaatgagaccatgcaatgcttgtctttctgtgcctggtttatttcatttaacatagtgatcttcatttccatccatgttgttgcaaatgacagggtctcattcttttttaaacggctgaatagtactccattgtgtatatataccacattttctttaaccacttatctgtttatggacatgtaggttgcttcacaatcttggctattgtgaagagcgctgcaacaaacataggaatgcaggtacctcttcaatatactggttttccttcttttgggtatatagtcggcagttagattgctgggtcatatgataactctaattttatatttttgaggaacctctaaattgttctccatggtggttgtaataacttaaattcccaccaacagggtatgagggttccctttctacacatgctcaccaacattttttacttcctgtcttttagatgtgagccgctttaactggggtaagatgatagttcatggtagtttttatgtgcatttctgatgatcaatgatgttgagcacattttcatatgcctgtttgccattctgtatgtctttttttgagaaacgtctatttaaatcttttgtccgttttataatcagattattagatattttcctatagggttgtttgagctccttatatattctgattattaatctcttttcagatgggtagtttgcaaataatttctcccagtatgtgcgttgtctcttcactttgttaattcttttctatgctgagcagaaaattttttctcaatgtgatcttatttgtccatttttgctttggttgcctacgcttgtgagcaaagttactcaagaaattttgcccagaccaaggtcctagagattttccctaaggttttcttgtagtggtttcatagttcatggtcttagatttaaatctttaatccattttgattttatttttgtatacggtgagaggcaggggtttagttttattcttcttcatatggatcatatagatatccagttttcccagcaccatttatcgaaaagactgtcttgtctccagtgtatgttcttggcaccttttttgaaaatgagttcactgtaggtgtttgatttgtttctgggtttgctactctttcccttggtttatgtgtctacttttatgccagtaccatgctattttgtctactatagatttgtagtataatttggcatcagattatgtaattcctctttctttttcttaggatagctttgactattctgagcctttgtgattccatgtaaattttaggatgttttttatttctgtgaagaatgtcattcataatttgatagagattagattgaatctgtatactgttttgaatagtatggacattttaatagtattgattcttccaatccatgaacatggaacatgtttatattttttgtgtgtcctcttaaatttctttaatcagtgttgtatagttttcattatactaagatcttttacttctttgattacgttaatgcttaggttgtttattttatttttttgctatttaaatgcaatcactttttaaatttcttttcagattgtttgctgttgtcatatagacaggatactgatttttgaatgtttgtgtcctacaactttactgaatttgtttataagttctaatagtttttttcttttcatttttgagacagagtctcactctgttgcctaggctacagtgcagtggctcaatctcggctcactgcaacctcctcctcccaggttcaagcaattctcctgcctcagcctcccaagtagctgggactacaggtgtgcagcaccaccatgcctggctaatttttttgtatttttagtagagatggggtttccccatattggccatgctggtctcgaactcgtggtctcaagcgatctacccaccttggcctcccaaagtgctgggattacaggcgtgagccactgagcccggccctaatagttgttttaatgaagtctctagtttttttttttccccaaatagaagatcatatctgcaaaaaaggatactttgatttctcgctttccagcttggatgccctttattctttctcttatctgattgctctagttagaactttcagtattatgttgaataacagtggtgaaagtgggcattcctgttgtgtttcagatcttagaggaaaggctttcagcttttccccattcagtataataatagatgttggtctgttatatgtggctttcattatgtttagatatgttccttctatacccagtttttttagagtttttatcatgatgggatgttgaactttatcaaatgttttttcagcatcagtttaaatgatgatatggttgttgtccttcattctgttcatatgatgtatcacattgattgttttgcatatgttgaaacatccttgtatcccaggggtaaacgccactcggtcatgagcaatgatcttttaaatatattactgaatttgatttgctagtatcttgttgaggacatttgcatcaatatttatcaggtatattggcctgttgttttatttttatgataagtatttgtattgttttggtattagggcaatactgtcctcatagaatgagcttggacgttattagtcctcctctttttcagaacagtttgaataggatgcgtattagtttctattaaaaacgttttatagagttcagcagtgaggctattgggtcccaggctttcctttactggaagacattttattaagatttcaatcttgttacttgttattcacatgttcaggttttggatttcttccttgttcagtcttagtaggttagatgtgtctagaattttgtccatttcttctagattttccagtttattgtcatttagttgctcatagtagcagttaatgtttctttgaatttttgtagtatcagtttgtaatggctcttttttcatctgtgattttatttatatggatcttctctcttctctccttttttcttttttcttttttttctttttctttgagatggagtctcgctctgtcacccaggctggagtgcagtggtgcgatctcggctcactgcaagcttcacctcctgggttcacaccattctcctgcctcaacccctgagtagctgggacaacaggcgcccaccaccacgctggctaattttttttttttttttgtatttttagtagagatgaggtttcaccgtgttagccagggtggtctcaatctcctgacctcgtgatccgcctgtctcggcctctcaaagtactaggattacaggcgtgagccaccgcacccagcctccatttttcttagtcagtctggctaaaggtttgtcaattttgtttaacttttcaaaaaaaacctttttgtttcattgatattttgtatcattttcttcatttcaatttcatttatttctgctttgatttttattatttcttttgttttagtaattctgggtttggtttgctcttgcttttctagttctttaagcttcattgttagggcatttatttgaatttttcttcttttctgatgtgggttattacagtcataaacttctctcctagtactgcttttcttatatcccatagattgtgatatgttgtgtttttcttatttttttcaataaattttttaatctccttcaaattttctgcatagacccactggtcagaaagaagcatattgtttaattttcatgtatttgtatgatttccataattcctattgttcttgctttgtagttttatacgactgtggtcataggatgtgcttggtattatttaaattacttaaaatgtctcaagacttgtttcatgacctatcatataatctatctttgagaatgatccatgtgctgagacaaaggatgtatattctgaagctgttggatgaaatatcttgtaaatatccattggatccatttggtccatagtgcagtttaagtctgatgtttgttgattttctatttagaagttctgcccaatgctgaaagtgaggtgttgaattctccagctataattgtattggaatctatctctctctttagctctagtaatatttacatgcctgagggcttcagtgttgggtgcatatatacttatagttgttatatcctcttgctaaattcacccttttatcattttatagcatccttctttgtctcttcttatactctttgtctttcatctgatataagtatagctactcctgcttgttttgggtttgcagtgacacggaatatctttttttcagggtatgtgtgtcttcataggtgaagtgtgcttcttttaggcaacagatcaatgtttcttgcctttttttttttttgccattcagctactccattggagactttagtccatttacagtcaatgttattattaataagtggactttctcctaccattttgatatttgttttctggttgttttgtagtctaagcatccatctttccttcctgtcttctttttgtgaaggtagttttctctggtgatatcatttagtttcttgctttttatttttttgtgtatccattgtatggtttttggtttgagattaccatgaggcttgcaaattctatcttataacccattattttaagttgataacaacttaacttagtttgcataaaaaacctaaaaagcaaaaagaaaactaataaaaactctacaccttcattccccacttttagattttttgttgtttctatttatatattgtactgtttatatcttgaaaagttgctgtagttattatttttattggttcttcatttagcctttctacttagcctaaggtgagtaataactaaccacagttacagtgttataatgttctgtgtttttctggatacttattattaccagtgagttgtgtgccttcaggtgattacttattgatccctaatgtctgtttctttctgattaaaatactccctttagaatttcttgtaggacaggtatagtgttgacgaaatccctcaccttttgtttgtctgggaaaatctttatttctccttcatgtttgaaggatatataccagtatatctggagtattcaccagatatattattctagtgtaaaggtttccttttttcttcttcagcactttaaatatgtcatgccactctcttcgggtctgtaacatttccactaagaagtctgctgccagacatattggagcttcattgtatgttatttgttttttttttctcttgctgcttttagaatagtttctttatccttgatatttgggagtttgattattaactgccttgaggttgtctttgtgttaaatctgcttggtgttttatacattcttgtacttggacaatgatatctgtctagatttgggaggttctctgttattatccctttgaataaactttcttcccctgtctctttctctacttcctctttaagtcgaactcttagatttgccctgttgaggctgttttttagatcctgtagccgtgcttcattgtttttcattctttttttgtgtgtgtgtctcttctgactgtgtattttaaaagagtctgtcatcaagctcagtaattcttcctctgtttggtcaaatctgtatttacaaactctggtgcactcttcagcatgtctattgcaattttcggctccagaatttctccttgagtctttttaattacttcgatctctttgttaaatttatctgatagaattctgagttctttcatggtgataccttgaatttcttcaaatttcctcaagacagctgttttgaattctctgtctgaaaggtcagatatctcttttctccaggattgctccctggcaccttatttacttctcttgatgaggttgtgtattcctggattgttttgatacttgtagatagatgttcagctgtgtctggacattgaatagttaagtatttattgtagtcttcactgtctgggcttgtttgtaaccatccttggaaaggctttccagatattcacaaagacttgggtattgtgatccaagctgtatctgctttaggaggcccaataatgctgtggttcatgaagactcgtaaaagtactgcctcgatgatctcggacaagatctggaattctctggattaccaggcagagacttgctctcttcactcagtttctcccaaacaaatggagaaactctctctagtttctgaaccacctgaagctgagggtggaatgacacagtcaccctggtggccatcaccactatgactctgctaagtcagacccgaagccaatacgtcactgggtctcacacaaagcctgctgtaagtactccctggctactgcctatgttcactcaaagccttgggactctatcgtcagcaggtagcaaagccagccattcctctgtccttcttttcagggtggcgagtttgccgggaacctggagggtccagaggtgctgtcagggagccagagtctatattcaaataccttaaaagtccacctggtgttctattgtactgctgctgagcttgtactcaaaccactagatgctgaccttccactcttccgttccctttccaaaagcagaggagcctcatcccatggccaccaccactacaggcccatggagaatacctccatactactgctgatgttcccttgaggctcaagggctcttcagtcagcttgcagtgaatgctgcctggcctgggactcgccctccagggcattggatccccttttgcccagggcaggtcgggacatgccatccaagggccaaattctggaatcagggaccccaagagcccacatggtgctctacaactctgtggcggagatggtacctaaagtgcaagacaatgtcccctttactttatcctcaacttttcttaagcagatagtgttttgcctcatagccaccacagctaggaatgtgctgagtctcacgtgaagccagccgatctcagattctcacccaaagccgttaatgcagttcctgggtatcactgcttgtttttcagggcccaagggctcttcagttagcaggtgataaatgctgccaggactgggttctttccttcaaggcagtggtttcccttctgacccaaggtgtacctagtattgttgtctcggagcgatgcccaagggctaggaaaagggatatcaggactctgacaggggccctatcctgctgtggcttagctggtaggcaaaatgcaaaacaatgtcctccccactcttttgatttcctctgctcagggagaaggaaggggtttctttttaaactgtaaactgtgcagccttggcttagggttagggtgatggcagcattaccttagcaaccctggcttgtgtctcagtaggttatatgcccacccaatctagtatctctaggcgcagttcagcactaggactcacctagttgttatagttcttgtggcatagaccgcctttctagtttattttatttagatcctcggagtactttagcccagtgttgaggcttgcagaattcaaatttgagctgctgggattgataatttctctctggcgagggctgcttaaaagctccctctgtgggctggcatcagctgagtttgttctgattttcttttctgctgtaacaggacagcattgagtttaatgcctcataattaccgggctctccctcccccagcccagttaaaggctctctgtaccattctgctgctgccaggtggtgtcagcaattcaaaacggtttttcttccctcttcagtgcctctttcagtgatacgacagtaaaaccaggtactgtgagtgctcaactgatttttcatatgtacgaaggtgttttcttttgtgtgtgtagatagttgttaaattactgcccttttggtgagggaaacaattgatggagccttctattctaccatcttgctccacctccaccacgtgttaaaaagttattttatttcaataattatatgttatatctgacaaagtcttgtggtgctttatccctcagaattttgcgaaaacaacacaagcctttaatgacaatgaagagacccacatcgtgacatggatacgataccttaaagattttttacaaactccctctttccgtgacaccaatacactaataaaaaggtttagatcctttaggtagtaggcaaagtaatggacctccagcgcttttactccctaatctttggaacctgtgaatatgtcaccttacagggtagaaagaaactttgcaggagcaataaaggataaactggaaatgagatattattctgaattatccaggtgggtcccacctaatcacatgggttcctaaaagtggaagaggaaggcagaagtttgggttggagagatgcaacagaagaagagaaaaggtgggagttgagagggattcaaagggtaaatgagacacaactgtcattgctggctttgaagagggaggaatgtagccataagccaaggaagttgatggtttctataagctgggttcgggcctcagcttaaagtcagagagaaaatggggatcacagtcttaaaatccaaggaactaaattctggaaaccacctaaataaacaaggaaatagattttcccttagagcctccagaatgaagcattaccaacattaccaatgtcttgattttaatctgttgaaattattattattatctttcaacatacagaactgtagataataaattcatgttcttttagcccactaagtttgtagtagtttgttgtggtactaatagaaaactaatatattacacctactatattaacaataataatggtataattacagtaatcataatagtttactatttttattgagcacttactatgccccagtctgtatataactatagtaattatattaattcaattcatatttagactctatgagttagagttaaatatcaaagatgtgaggaaactgaggtgctaaatggttaagtaactcattcaaaggcatttcattaaaagcaccattaaaagcagcaatgtcaggatttgtttttaattttagtttggatgtagttatcataatctttatttgtaaacaattgataatatgacataacatatttaaagccttgaaacgtaactattaaacacaaaatcaatgagttattgaaatgcatcattgagatacaacttttaaaactcaacttatatactgtttttattttaatttacttatttctaaaatcaaccagcatttagtgtctattctattttttatatgttcatttctgatttatttaaaaatatatgtataaaaatgcttgtaacaaattaatagattaaaatgaaaaacattttttggcaatatttattaattctttgaacttctgagtgtcatgtgctctaaatcacataataaactctcaccacaaaaattatttttaaacctatattccttgaccataaggtaagatcttctgccaatttagttgagttaaaatgatcttgcaaaaaaaaatttgcctacacatttgtagtatctacagatttacttcatttgaattatgggaaataatctccatagaaactcattgcctgaagccctgcttctcaaaacaaaagcaaaatcacatactctctctcagaaaaagtctcccatatgacagccgggatggctttttgggagggagaggacactagaaaggaaaagatcagaaaagccaacccttctccatgtttctcgggtttggaggagtgactatgcataccctctgaccctacacagtcagaggcttggaaaaaggagaggtaagtattggacaagtagctcaccttaagaaattggggtacaggtgctctacccacctggggagcttccacagaaaaatgctatgtgaccaggagaaagaggcctgccaaatacttttgcctaaatgtccttgaatttagagtgccaggaccagtgggcaagggtggcctgcagcagtggcagaggtaggaggtcagggtgctggatgagtagaggatgaaggatgtgatcaatgcccaagtgtgcacttcgcaagcaaaaacaacattaagctctgagttacagcaactaacacttcagcccaaatattcaacagggcaaacaatactcagtggggtgagagacacagctctggagacgaatataaggaggaactagcacaaagtcagctggttcttcttaacacaacgcagctgacattgaattccattttaggaataggaaggaggaggctggaggacaaagtaacacatttctaaagatcatctttaaataatcctataaaactaacttcaaactaatttggttacgtatttattttgtttcctcttatcataagagtcaggtcagaggaaagttcagactagtcagagatacgagtagctccatttttttcagacatctgtcctgtactgggagttaaatttgaaactctattatatgttatctggaagtttgcattttattaacttaagctttgtgtacctacaatgatacttgctatgttcatggaggaaaatatcttttgggaaaataataattgctggaattctttttatcatttactagatgccatagactattctagtacatatattgtattttttaaaaatccttataataaccctacaaaatcactcttcacctgctgcaaatgagaaaactctggaacacaggttgtaaataatctgaccaggaccagcattttaatagaaggtggaatcaggattctggaccaaggagtttgaatctagaagctgaactctgaattcataagttgtacttatatcccaggatgtaaaatgacatagatcagttctgagtggaaactatggaaacaagaacaacatgtttaaatataattccccctttttaacctgccattggaaaaagaaagcgagctgttgattgattggttcccttttctcactcaaggtattttatcaaaaaataactcagctggctggatctataaaagtcagttccaaaatatgttctgtcttttcctattcacaggaagctacttacactgctttactgctaacaaatcaaaaattggtctcagacaaacagtcggccagaaaacatccttcttcctttttagccagagagtgaggtatggagtattgattcttccatacaatccaactaaatcttatagtcaaatcttatgtgatatagcaaaatttaaagataccttctttatatacaacgattgtggctcagcaggtgataaaaagtcattttcattagtgattacggaaagggatgtttgtgccttactgtaatagtacctcaactgtcagcaggataattattagtgtggacccatcattttctctttcacaacaactaatggtccgtgaggccggcagcttagacctgccacagacaactgcagttgctgaatattttttcctctgacgtcttcagatggcgaagttgggatggtgggtgggggaagaaaaggaatataaaacaaaggaaaatcagaaaacatgagatattctttcccaaatatcctcttttaggtttcagaaatagtttgtgcctagtctgggtcttctgtctgccactattttgttaaacttacttattcaaggtaaagagtcaggcctctgagacacctgatgagttttgtaagtaaattcaggcagtgcattgaaaccctactgaaaatatgcagccgtgggagtgtcttattctatgatatccaccttattttttttataaggacaccatctggttcctactaaagtgggagcaaaactttgagcacacatggacataaatatgggaataatagacactgtggactagtagagagtggagaggaaaaggtgggttaaaaaactacctatcaggtactgtgctcactgccagggtgacaggatccctgctccaaactccagcatcatgcgatattcccatgcatcaaatctatacatgtacccactctatctaaaagttacaactaaaaataaaataaaatttcaggtaaaagaaataaaatgcttaggcaaagcttaatttccatttttaaaaaacattatttttgattattaaatttaatgttatatttcaaatatgtactttgtggctcctcaaagattcctgtttgttagatctttcaacttttgacctccagtgtctcatgggcaggaatgagcagagagtccaagaccttgagttatttctggaaggaccaccacccacttctcccaaccacattcacctctcacccccttttctgtcttgatgccactagcattagtttcattgtggatattaactttgtttatcttagtcatcaaagaagcccaggactactggatcttcttcaccccaaactccttaattgttaatataacccaatataacccctttggtgatcccctacaaccatttcccaggctttaaccaactcctcaaatccttcctattgctcatggaactcctggcctgtcagcagcaaaatctccagaggattcatctgttctctgagtatgcccttccctttctggctctacaaggaaaacaaaactctatgcaaggagtcactgatccctgcagtcctctccagtgggagctttttcactcctgtaaatcttataactttggtctggagatggggtgtcttccttactccccgtgtccacttccagacaatttacacctctcattcctttaaacaccagctatgaatttagtaatgtcacattgcaccacacacattatctccttggagtcatgtacctaacctttatcactgtcctatactctggacattttcccttctgatgtgtggtcacattatgactcttcttgatgcaatactcacaattcaatgccctgagtgtctcagtatctggatcttctatttgctaatactcctagttcttaagtctatctcagcccttcactgccaaggtctttactttacacatcttctcataaagaagtggccagaaagaacttaggcaaattcctaccacaatgtctattcactacctgcatttatgcatgaattcatatctttatagtttgagtaaactgccctttcacagagcaatgcctctgccattgttctcaaacccattttcctcacctactcatgcacatagtgccagcagttctcccggctgtctcctacgtcatcattttttcttctctcctagataatttcaatcaacatggaaaatgctttcattttccaatctgccttcattgttacacatatgacaatcattcatcctttccagtgccagaccatagcagcttggtgctttaacagagtcaactgaaaaaaactctagttacagtcttgggaaaaatgaagtgcactcctgtatttccatcatctgtgtcattcctgggattgtactctggttacttcacaccttactactactacaatttgctagaaagatacccagaattttactcaagacaaagataaatgactggattagtaaatctgtaaaagttgatcaataacaacagattaataagcaagaaactctttaaaaaaggaaaaaatgatattataattaaccatcccaatgtttgcttggtcagttgcaagctgttattccccaaattgactaactctgtctccaatcaacaaactggccatgaaagaaaaactgacaccaagacacagacaaaggttagtcacccctgggtctcctgttagatttctttcatcttccctaagtttaatttagtctgtgaaataagtattttttgctgttaataaaagagagatggatctcaagagcattatgctaaataagggaaaccagatttaaaagactttatgattgcatttacataaaatattagaaaaagcaaaatgatagtgacagctagcagatcagtggatgccaggttttgggtatgagaaaggagactgtaaatgtaagaagtggactttctggaaggcggaaatattctacatcatgattgtggtggttgttttacaactgcagacatttttttgaaaacattgaattgtaaaaataagtgaattttatagtgtgtgaattataattcaataaaatctaaaaaagtattttgtgaattatatagcctctgtagagagtttatctgaaaggattaatttcaccccaacattaaaaaatttccaagaatctgtgtactatacaataacaaaaacagttgtctcttagtcaaatatcagatatatgtacatttcactccaaaataaattataataatttcatcttttacaataaaaattatataatcaacacttgatacatttattttataaaaatatacatttaaaattttagtttttaatacatttcatatttttattggttgctaataaagtgtcctaaaaaagtaacaaggcattcttgtattttctaaaactcaagataaaatatttatactaataatttctattcaaatttccaaaattcagctctacttgtgatacagtttggctctatgtccccacccaaacctcatcctgaattgtaatccccatgtcaagggagggacctggtgggaggtgattggatcattggggtggttttccccatgctgttctcacgatactgagtaaattctcaagggatctgatggtttaaaagtgtttgtcagttttcctgcccctcctgccaccatgtaaaatatgccttgcttgcccttcaccttccaccatgattgtaagtttcctgaggcctcccaagacatgtggaactgtgagtcaattaaatttatcttctgtataaactacccagcctcaggcggttcttaatagcagtgtgaaaacagacaaatacagaaaattggtaccaggatagtgaggcacttctgtaaagataacctgaaaatgtggaagcaattttggaactgggtaatgggcagagattggaacattttggagggctcagaagaagacaagaagatgtgggaaagtttggaacttcctagagacttcttaaatgactttgatcaaaatgctgacagcgatatggacaatgaaattcaggctgaggtggtctccaatggagatgcggaacttcttgggaactgcagcaaaggtgactcttgttacactttagcaaagagactggtggcattttgcttctgccctagagatctgtggaactttgaacttgagaaaaatgatttagggtatctggcagaataaattcctaggcagcaaagcattcaagatgtcacttggctttttctgaaagcacatagtcctatgcattcacaaagagatgatctgatactggaacttgtttaaaagagaagcagagtataaaagtttggaaaatttgcatcctgaccatgcagtagaatagaaaaacccgttttctggggagaaaatcaagctttcatctgcagaaatttgcataaataaagggaagtggaatgttaatagcaaagacaatggggaaaatgtctccaggacatttcagagaccttcatggcagcccttcccatcaaaggcctggacacataggagggaaaatggcttcccaggcccagggcctccctgctgtatgcagcctcaggtcatggtgccctgcatcccagctgcttcagctcccattgtggctaggggaaaaaggtgcagctcaggccattgcttcagagagtgcaagccctaagacgtagcagtttcaacatggtgttcagcctatgagtgtgcagaagacaagagttgaggtttagaagcctccacctagatttcagaggatgtatgaaaacacctggatgtccaggcagaagtctgctgcagacttctcatgaagaacctctactatggcagtactgaagggaaatgtgggattagaggccccacacagagtccccactgggtcactctccagtggtgttgtgaaaagagggcaaccatcctccagacctcagattgatagatcccatggtagcttgcaccatgagcctggaaaagccccagacactcaacaccagcccatggaagccactgcaggagctgtaccctgcatagccacaagggtacagctgtccaaggccttaggagccaactcctgccttcagcgtgccctgagtgtgtgacacaaagtcaaaagagatcattttgaagctttaaaatttaatgagtgccctgctgggttttggacttgcatagggcctgtatcccctttgttttggccaatttctctcatttggaatgggaacatttatccaaagcctgtaaccccattgtatcttggaagtaactaacatgttttttattttacaggctcataggtgtaagggacttgccttgcttgtctcaaattagacttcggacttggacttttgagttagtgctggaatgagttaagactttgggggactgttggaaaggcatgattgtgttttgaaatgtgagaaggacatgagatttgggagggatcaggggcagaatgatatagtttggcactgcgtccccacccaaatctcatctcaaagtgtaattcctgcatgttgaggaagggacttggtggaaggtaattggatcatggaggtgatttcccctatgctgttttcataacagtaattgagttctcacaagatctgatggtttaaaagtgtttggcagtctcctactccctcctactgccaggtaagatatgccttgctgccgctttgccttctgctgtgattgtaagattcctgaggcttcccaagtcatgtgaaattttgagtcaattaaacctcttttctttataactacccagtctcaggtagttctttatagcagtgtaaaaatggactaatacaacttgtcaaacgcagaaaatgcatttcacaaaattaaacaccaatcatgatataaacactcagtaatccagaaatagaggtaatttcctcaattagataaagagaatctatgtaaaccaacagctaacatcacacttaatggtgagaaactagatactttgatcctaataccaggaacaagacaagatgtccccctcactatttctatataacaacatattgtatgtcatggttaatgaaataaggaaataaatggtacattaattggaaaggaagaaacaatactgtatgttcacaagtaacataattgtttatgtataatattccaaagaattaacaaaataaattcctggaactaatagcaaggttgtagaaaagaagacttctatataaaagtcaattgctttcttataccagcaatgaacaattgttagttaaaattaaaaatgtaaaattaaatttacgttaacaataaaaaattaaatagatatgagcataacaaaatgtacagaataaatgttaagaaaattataaaactctaatgaaagaagtcaaagaacaattaaatgaaggagatatattctttgttcctagattggaaaactcaatattgttaagattttaattattcccatgtagatgtatagattccatacaatctcaattgtaatcccagtaagctattttattgataccaacaaattaaacctaagtctatatagaaagacaaaaaaaaaaaaaacaagattagttaacactatatttaagaagagcaaagttggaagactataactacccaattttaagactcaccataaacctacagtatcaagacagtatcaagtgttgaactggcaaaagaatagacaaataagtaaatggaacagaatagagagcctaaaactagccccagtcacacattgtcaactcatctttaacaaaggggcaaaaactattcaaaggtgaaagataatttataaatcgtgctggaaaaattgaaaatatgtaggcaaaaataataaatttagacacttattttacatctttcacaaaaattaactcatagtggattgatcattgaccagaaatatgaaaggtaaaactatactacttctagaacccaatataggagaagatctaagggaccttgagtttggtgttgagtttttagatacaatacaaaaagtacaatccatacaagaaaaacattgataagttgggctttattaactgtaaaaacttttcctctgtgaaagaccctgttagaatgaaaagagaaacccagattggaagaaagtatttgaaaaacacaagtctgataaatgaagtgtatctaaatatgaacagaacactgtatatctcaaaatagctgagaataaatttcaaactttcaaacccccaaaatgatcagcttttgaggtggtggatgtttttcttagcttcatttaatttttccacattatattcataaattttaacattacttaataccccatgaatgtatacaactataacttctcaatttatagtaaaataaactgccaaagtcatgaattaaaagaaaaactgagaaactgaaaactggattggatcctggaatgtgaaaagaacatccatgtaaaaactggtgaaggaaaggagattgtaaggttgttacaaatacactcttgagacaaactttagacacgtctaatccctgcaagcctcggcatttgcattcacacttgaggggcctatattgctcagttgtagcaagcatccttctaagtcaatttggagagaaaccatcacccttgatattgaacacctgacttgctttcaacaagaattctgtcaagtcagtttagccagaatcccccatcctcactcctgatattccctgtaagaacttttccatccgctagtctataccctgctccttgggtatccagccccatctgcccatggtgtattcagaattgatccaagttctatactgaagtttcttttcccatattgcaatagttctggtgtaaaatatatttttactactttactgtctggctctggttttctttagcagttagtaaactattctgtatgatacttaatggtgaacccatgacattatgtatcccatagaattgcagaacacaaaaagtgaacttttatgtaaactatggtatttagttaccaaaaaagtatcaatattggttcgttaattgtaataaagctcccacacaagtgcaagatattaatagtagggaaatatgtgtgcatgtgagagagggatagatgtaataaatctctgtactgtctactaaattttttggtaagtttaaagctgttctaaaaatggtgactccattgacttatctggaaaaaagctcttatcttttgatcaagagctgaattatgtgtgtatgtacccctaatatgcagatgttgcataggcagttgtagctggatttcagaagagggcgcttagttagagatagagatataagggttatttagagcaatgacaataaataatcgccaaggctgaaattatagaatgaaagaaaacaatagcaagattatttctgaagaaccccaacatttggaaattgggaacgtgagtagatgtgggcaaagtgtaaataacattgacttgagaaataagaggaaaataagaagaatgagatattaaagtgcagaattgcttatgcaagacttagactcaagatatttttctcagttgaaacaggaaaagttatattatgctatgcagccaggaaaacttccatcagtgtattagtatgtaaaatactgtcaaatgtatgtgaaagacaagtaaaaattttcatctttccccaaaataatccaaccctagtaaataattttacctaagagaagacataccaattaatgattgtgtgtgtgtatatattatatatactatatatatagtgtataatatatacacgctatatatagtgtatatatagcgtgtatatatagtgtatagtgtatatattatacacgctatatatagtgtatatatagtgtatatattatacacgctatatatagtgtatatatagtgtatatattatacacgctatatatagtgtatatatagtgtatatattatacacgctatatatagtgtatatatagtgtatatattatacacgctatatatagtgtatatatagtgtatatattatacacgctatatatagtgtatatatagtgtatatattatacacgctatatatagtgtatatatagtgtatatattatacacgctatatatagtgtatatatagtgtatatattatacacgctatatatagtgtatatatagtgtatatattatacacgctatatatagtgtatatatagtgtatatattatacacgctatatatagtgtatatatagtgtatatattatacacgctatatatagtgtatatatagtgtatatattatacacgctatatatagtgtatatatagtgtatatattatacacgctatatatagtgtatatatagtgtatatattatacacgctatatatagtgtatatatagtgtatatattatacacgctatatatagtgtatatatagtgtatatattatacacgctatagtgtatatatagtgtatatattatacacgctatatatagtgtatatatagtgtatatattatatatatagtgtatatatataaatatattatatatatagtgtatatatataaatatatagtatatatagtatatatacacactatatatatagtatatatacacactatatatatagtatatatacacactatatatagtatatatacacactatatatatagtgtatatatacacactatatatatagtgtatatatacactatatatatagtgtatatatacactatatatatatatagtgtatatatacactatatatatagtgtatatatacactatatatatagtgacagattctcactctattgcccaggctggagtgctgtggcacgatctcagctcactgcaacttccgtttcccagctcaagtgatcctcccaccttagcctcccaagtagctgggattacaagggtgtgccaccacgcccaggtaatttttgtatttttagtagagatagggtttttctatgttgaccaggctggtctcgaactcctgacctcaagtgatctgcctgcctcagcctcccaaagtgcagggattacaggggtgagctactgcaccaggcctgccttaatagtttcttattttattccataaaactcactattctttcaagtccttcaattttctacctgaaagaaagcgttggtaactgacctgcttaccatagtaagctctcaattagtggcttttcattaactctattagtcctttagacatgaacaacaaaggaagagtgtgtgaaattcttttgagctgtgtgcattgtgttttaaaaataatctgatgagttcactcatttatcagtatatcacataatagaatacccttatatctattcctaattttaagagtgtatgttatatattttatttgggttaacttgtttgtgtttagatcttgtgacctctatagtaataacattaattgaaaaaaagtacacagttaaatatgtattctactaaaccagtttcttcaagcaaacattagtaatttgaggtttaagacatcagctccttaaattattaagaagtgtgtaatactgtagtaagttatctttgtcctctttttgttaacagacaaataggaacttacatttatggcaagacaaaatactatatatacatatgtataataaaacttaaatgtgttttgttaaactggtaaacaatacataaaagatttacttcttatttttcctctttaaataaagtaaaatattgaatatagtatgtagtgcagtattcacaaaaccaactgcaatgatatcttcaaatcctcaggtttcctgaaaaccaaaagcagagaaattatgttttgtctgtattcaactataattttaatgaaaataaaatgaaagatatttagaattaatgaaaaattatatctacatccctgagaaaaagtctttaaattctctttccatgtagcagcatggatatcattggagtgtcattttcagtaaaaaattcaatgaaatcgaagaaagattgacatatgaagaagacccaataggaagtgagagagtgaagcctgcatcatgttttttctctaaacatttctgccttagacttgaataacagactgtcttatgtctggaaagaatgcaatagaaaacaagagtagtgctaaagatgaaagccccctgagctgtgtgaggacaaagattcatctgaaaaatgacatggcagagaaggtggaagatacattgtgattggacagcattggctttagtgacagcagccatttctactgcaggctttctccagaagtatttggctatttagagtctgcctgtgacacgtaggtggttgggtaagttcagactggatttttaatgagaaggtgatggaaaaagaaaaagaaacgtgttgggaatatgtgttagtttattgtggctgctgtaacaatgagcacatgttttggggcttaaaacaatgcacatttattctttcacagttatggaggtcagagtccaaaaccagtctgaaatgggctgaaatcaaagtatccgcaggtccactctccttttggaggctctagggaaacctgttccttacttcttcctgcatctggtggctgtaggcattccttggattttggccacatcactctaatgtctgcctctgttgtcacactgccttctcatctatgtgtgtcaaatctccctctccttttcttagaatacatgctattgcatttaaggaccgcttggaaaatctgggataaacttcccacctttagatccttaactttattataccagaaagacactttttccaaataagctaatagttacagtttccaggagttaagtcttggaatctgggggccattattggcctgcagagggtatttgatgatgatttcaaagatcaaagcgataagaaacctaagctagatgaaaaagtgagaaagtgttaaaacatggaaaagaagacaactgtaaatcatataatcaatatattaagagagagaaaagtcagatgctaaaccatacaggctattttaatttatattaaaaatacatacatattaatgtgtgtagatgcagctacagtatataaatttatgcaagtatgttaacagtggtttttttcctggtggtgctattggagtggcctttatatttattgagtttgtattgtctccatggtagcacagccaaaacctaaacttaaaagaaaaaaatcctgcaccattttatctcatatatgaagtctttttgatggtctttgcaatataaccatatttcacttgaaacatttgcgggaaaatctgacattgtgaatcaaacaatgtaatagagccagcaacatagactccattaaaccgagaaaatatcttaagttagagcaacacaaacttcttaaacataagagtttgtcatttaggataaagaccatgtaattctgacgacctgtggagttgaacatcaataatcaattgttttgatttggcaatttgttttccctaacttcaatcctccttcaattgctggtaaatataattcttcagctcccccttgatctcagtgagggtctctgacttgaggcttacttggtggttataaaataccttaagctcttcagataaaagggatattagtgcaaaatactaataagcattattattataagtggtctgagcactaaggtgtttgcttagtactggaagctgggaaatacgtagtttgaatgtaaaagtgtcaaaaacatgtagtttgggaagtattttaggaaagtaaagtgatgttttctaattctttcaaaaaataatgcaagaaattaggcaatgactcaatgcaagccaacagataaaaatagtaattaaaaaataaatttttctaaaaggaaaagtcaagctacaaaaaaagaagagtaatttagagcagtattgatccaagggaatgaaactgaatgacaaagctctatcctaggtaaaagacaatgtcatgaaattggttttattggagacacctagcaagatagattttagtgaagatcattattgacatgttatatttgggaaatagacaactaaattagtatgttcctccatcattattatgcattgatggtattaatttgttctgcaaatatggtacatatatgcttaatgtctgccatttagttttctaactacaaaaatatttgcactactgatttttatgagcattatgtggtcatgacacaatagttgctatgaatatgaacagttactgtaaatgctcacacttttttctcactgtgtgactgcccttagagggtcttatttgttgtcttacaaaatgttaacagaacctcaaagtgacaatattctctttatttttaaataaaatgaagggcatgttctgattgctcacaagctgttgtctctgaatttactgacatcttaaattcaaatgtcaaacttcatagtgattcaagagaatgtttttataatgaattgaatagatgaacttttgaaagaagattattatggtcagtgggttaacaaaatgcaagaaattcaggatgactttggaaaatataattttgtataattatctgtagaataaatggtttttaacatagagagtaacttattctcaattaatcccactcaaatatattttctctaaagtgttgtggctgcatgagaatttattaatgggcaacatataaacatcctaactcctcaaatatttcaaggaggatgaggatttttatgcacatttatgcctagggctgtactccttaaacattaatgtatataggaatagcctggaggttctctctctgattcagtaagtctcatttgggctgcacgattctgcatttctagacagctcccaggtgagattgctgctgctgattcacagactacattttggagtagcccaaggccccaccccacagtgcatcacacacagctctctgtgctgaacaaaattatcagcagatgtaaaaaaagcgaggcaatgaaagcttattattcaagtggaaagcaagttatttcatgtatgtatttattatttatttacattattattaaagtagaatgcaagtcagaaagaagcttatagtcagacagcaggttttgtagataaagttcatgaaagtgatttaatggtcagactaaattttccactctttttagtcataatttcttaaaattgatgtgttgtcccctgtatccctgtagaacaataccattggtagaaataaacattgtccaattttttaaaggtagatgtgctttttgttgcttgtaaagtgcatctgtttagatgtgaaaagatagacggtgtccgttttatacctgccagctgtaggcagtgatgctagaaataaatttaatgattttttttcctagaaattggaataaaacaaattaaatttagctttaataaggtggtttaatccattttctaaaattgtaccagtacaataaatataagcatctttagcatttaaaaatatgttgtggaaatcaatcattaaagctaaaaacagattgtggaaatcaattattagaaacaattttaaaatgtttctgaaagtatacaaataaaatatactaaattggtaatatgttgggtgccagtaatcaaatagtataatacatatgtgtgagagggtagattggaagtgaaagaacaaaaatcatccacacagagacagcatagaacagtttttgaaagtatccagtagttctgtagcctggagtaaattacttcaattctgtgtctatcagttttctcatctatacaacagaggtcattataactgcctcaaagtgttgttctatacatgaatacgtgtaaaatctaagaacaacgcctggaagatagtacattctcagtaaatgtcagtgtctcagttcttttagactgctctaacaaaataccatagacagggtagcttataaacaacagaaacttatcaaaaatctggaggctaggaagtccaagatcaaggtgccagaagagtcaatgtctggtgagagggcctctttcctggttcatagattgcagtctctctctgtcctcacctagtggaaaagggtaaatcagctcttctctctggggcctcttataaaggtggttctgccctcatgacctaatcactttccaaaggcctcatctcctaataccattacttaatgggttaatatttcaacatatgaagtttggggagacataactattcaggtcatagcatttagctatcattatctaaatttttgctaaagttaaaagtttctttgtgaagaatcagtatttctaagtgatatttgggaatgtctatagggatattttataagccctttaaaatcaatgtcttcaaatctgtacttatcaggttcagcattaatactctgtctgcctatttactgtcaactcctccccacaacaaatacataatcaataaaacctttgaccaaggaaagctgagtttattagacctaatgtaataacggagaacaccacttaggtagaaactcaatacaatctcagaatagagactttggggaaaggtattgatattgattgaaacgtgggaagctgattgggattggacaaagttcatggcatgataatttgggattggcaggtacagatggcaggagggtggttaaagtgagtcacaataaacaaatagcttcctgttaggggagttctttgcccaggtgggcaatctattgtccagaaaaggagagctgctgtctcagaagaaataactgtctatataaatcaattttcagggattttatggaaccaatgttaaaatatttgtggattataactttatattcctgactgagactttcactgaagaaatggttaagtcatgttgacacaggttgtgtgagttttcaggtccaatagtgtgtgaaggtaatcttaattctgatacctaaagttctcatgccttaatgattgtcatgcctacagttcagatatagacccctaagtgacaacaacaaaaacatattatattccccaattgtgctccttttctcgttcatatccctagtttacatcaactatctaccaggtattttggaagactctatcttctctattgatgtcagatttcatgtcagaactaccaaaatgtctttttagctttatcctcactgccaactctcattgtccttcaaaccacatctataatctttagaatataatcccagtattatcattccactgcttaatatcctctttgtctataggatgaaatacattctgtttctcaagaaataaaactccttatagcttgtggggtgaccagttttgcaggcttaacttcttccttgctcattagaacccttcccttcccttcccttcccctccccttccctccccttctctcttgttcactttcctttctctccttcttctctcctctcctctcactccctccccccctccattccttccttcctctttcttttattttcctctttctttctgttattttcctctttctttctttctctttctctcttctttctttctctctctttctttcctttttcttcttgttctttttcttgttctttcctccccctcctcctctcctctcctcctcctcctcctcctccttcttcttccttttttttctctctctctctccttgctttcatatctctgttcttagtcttgttcctagtgagctagggtatcttccatgatgtgctcagaccaataacttagaaatacgattgttatataaatagcaatgttaaaataaactgttcatttatcatgatgtcttggctaagtggaaagtaagagttggcttctacaggtgagacaaattagatggcactttagtcttatgtatccacttgttcaagtaattcaataagcgttgttggaatagaagtcatttccatctgccactggtgccatatctgatggactgtggtcacactggcagaggcttggctgtggagagcaatggggggacatggaaatgaatgatcttaaaggaatagtctgactggttaataacaatatctagctttggatgaatttaggaattcccatctcttcatataagtattgatatcccggaccacttggacatggagatgtctctagtgtaggcaagtgttatagcaaaggtaatggggacatatgtgtaatactttcagattcagagttgtttgtctgtacacccatctcctacaatatttctgcctacccaacaatcattaaaagaattgaaaggatttttctttctgcatttgatcgggaggagactctatgacatagacatttgaatagtagtctatttctaccagctaatgaagtctgacaaaatgctaggcagtagactctagttctatgaacaaagcccatttagtgtcgtattattactgttaacacagtctctaggaatgagtgggtacttgatgaatatttactaaagaatggaaggaaaaaagaaagaaggagagagagggaggaacagaagtagaggtagataagaaaaaagagtagaagaaagaaaggaaggaatgaaatatttgagaagaatagaggaagaaaacaaaattgaagaaaagcaaagcaaaaagggaactagcatacttaaaggccaactgcattcttgtgtcttagatataaaaaatccctacccataacgtaagataaagggaatatcttaactctttcactatgtgaaatatattcaaatatgtgttttttttgtgagaaaaatctcaaatataatactacattttactatttgctatggcctcttttaaaatgttatttataattgctaggtgagaatgtttcagaaaagcatagctacataaggaaatatacaaatatttatatgttctatattatactatatataatttatatattgtatattatactatatataatttaatatataattttacatattgtataagatatagtttatctatttgtattagtctgttctcatgctcatgataaagacttacctgagactgggtaatttataaaaaaagagaggtttaatggactcatagtcctacgtgggtgggaaggcctcacaatcatggcataaagtgaaaggcatgtcttacttggttgcaggcaaagagagaatgaaagccaagcaaaaagggcaaccccttataaaaccatcagatctcaggtgacttattcactaccatgagaactgtatgtgggaaatgacccccataattcaattatttcccactggggaataattactgtgttaacatattattactgtgttaacagtaatagtatgacactaaatagactttgttcatagaactagagtctacttcctagcatttgatcaggtttcattagctggtagaaacagacgaacattcaaatgtctctcccacaacacgggaattatgggagctatgattcaagatgagatttgggtggggacacagccaaaccatatcattattctatatatataaaaatacccctctctctctaatatatatatatatatatatatatatatatatatatatacacacatatatatgttatatatatatcacatatatagtgtatatatatcacatatatatgtgtatatatatcacatattatatatatatatgttcctcacagggaaaacagaagttataaaagttagattaactggtttgtattctttttcctttactccttccttttcctcttttttcattctgactcattattaaatcctgctttcatttaatatatataaatgtaattctgctttaattatatatagttatattttatatttattataaatattgtaatatataaaaatatttactattacaaagattcagcataaagtaaaataaatcctaacctttttgataatttatgtaaggtatttctacttagtcagaaaaatcactcctaacctgtaatttttcatggtccttttgggaagtttgtttgacgcaaaagggatcattttggaaattataaagcttcaatttctttctttttccatatatattgagttagtgatcatccacccaaaaaatttcttattagggtcattgtctatggttctaatttttttttttataaacaccaacatgtctgagtgacattacagaagtgaaaggaaagatgaaattctctaacttcaaattccttacaactcagcaatttgtttcctagggtatcttaacattttaggctgaataattcttaattatgaggggggtgtaggctgatctgcacattgtatgatgtttagtaggatcccatccattagatgccagtaagctcctcttcccagttatgaccatcaaaaatgttccaggtactgccaaatgtcccttgggggacaaaacttccccagttaaccattgaaaggctgcataagtatatgttagtatagtagtaacatattttttcaactgtgtgttaatatgggtactcatttttcagtggtaagatcaaatacatatttttgaaaaaatctattttgtagtttgcaatgttgcatattaacttcatctttcccttagatctttctacatcaaaatgtaattatgttgttatgcttcttgctgggatgtttgggtaatatcagttgttgataataaaaaataaatttttttatactaatagaatttgattaagacaaaagctgtacctttaagtactaactggaatttataatctaattctgtcaggctgcattggcatgagcttctaagcttgtgttacagagtaattgggcatctggtacacagagtggtgagaaataacatttggtacctggataccatatcttattatagacacttgaaacatatggtatcccaacttctgtttaggaagttagaatggcacagtcactttcataaacaaaagactcaatggcaatcttctttctctcattcggaatcccttatgtgaaatgatattcaactcaactgaaagtaactacagaaaatttcacattttagaaggtaaagtggttttgtgactcctaattgttcctcacagggaaaacaggagttataaaagtcagatttactggtttttgttctttttccctaaaaccttccttttcctttatcttttctgacctattactaaattctgctttaacttcctatcttctaagtagtatcacaattatgaatatgttacacttgagatcatctgtaatctcaagcttaccctaaattgcctcttgctgagataaaaaattcctatgtatctctctgtaggaacttgaagttggaactcaaataggggaagcccttttatggaatgaaatgaactcctgttaatctaggggttctctaagtttggtttcccagtagcggcatgagctgctagatgtttgttagaaatgaaatttcatagtctctgctccagatctactggatcagattctggtagtagggcccagcaatctactttatgaagcctgccaagtggtagtgatgactgcctacatttaagaaccagtgggctcatacatctatatcatcaaactttcaatggaacagggattcagaatttgcaaaatgacatttgttatatctatcttcttggaaagatggagtagaatgttaaaataacacaccacataggatgcaatttaataaaatccactgagattgtttgagtaacctgtcaccatagcaatttcttatccacataacatgttcttccttctcttctctcctagtggtgcacatggggttccacataagtaggcaatcagaccttaaaccatcaacttatcagcatattcatccagtaaaagccaaccttttcctacggagggactaggtgctggaatttcatagcagcttctggaagaattatatttatctctagctagatagccatgtaaaatcagccacagctaaatgttagaagaaacttcaataatattctacagttgaggtggtgatgaaggggatcaggagacatacagtgatggttggatgagaagagagaatttaggagattaaattggttttggtagacaaagaatttaggcacacctgaggcctgggacttagggaaaatgtggtcatggaaattgactttcatgtcaacttcccgacaagccattcaagaatgtcctccatctgttcccagggatgggtttgcagatcactgtccctagaaatatcaggaggtgttcagagggtaaagaatctgcccagtttgaataataaaatgacaatgatgatcttgaggttaaaaacccagagaaatttgctatccctagagagaaagctatggtgtgtcctaccctgtatagctctatgtagaaagctctgtcatctaaaatcattacctgaattaagagaattagactatgtccctgtgtttatcactaggtgataaaatgattggtgtatgtgtgtgtgtgtgtgtgtgtgtgtgtgtgtgtgtgtgtgtttgagattgatggatggataagataaaaaaggaaaatgggaccaagattgaacccctaggatttgtcttgagaaaccagatgtttaatcatgttgttcacaagataatataaaaataataaagggaatctcatttagtcatattcgtattaggcatataaatcttggacagttttagatcacatgatgctgaaaaaatagctaagattactcatgtctttctaaattagcatgcatgaaaaaaattggttaaaatgtatccactgcttaactaatttgtacaaaaattctctagtcaccattaggttctataaggaaacgtgtaatacatgccagcttcaatattttgcttttttataatattttttcctgtgtgtaaaatcatagagaaaagtaggtcatccatttgactcctggcaaagtaccttagggagacacggataaaatgcgggatttgtagtttgcgataggaccatgttaacgattttttagtggtttgaactttgtgctgtgatcaatatcatttggctgtgtcatatcatctttgtctgactatttccgggcatctaatacaggtcagtttagatcgatattaggaaaagctgttttgaactgtggacaaaagaagaatgattctgagtttgggttctctttaaaactgtgcaatactgtttaataatgcagacatgctaatattaggacattgaaaatactgctcccagtatcgttggaaatttgatgacacagcatacacagcaaacatatgatttaggaagccaactgtactgtatttcatataactacatataaattgttgttagagacattttcttgggaattgttattcttttttttttgagacagagtctcgctgtgtcgcccaggctagagtgcggtggctcgacctccgctcactgcaagctccgcctcccgggttcacgccattctcccgcctcagcctcccgagtagctgggtctacaggcgcccgccaccacgcctggctaattttttgtattttttagtagagacggggtttcaccgtgttagccaggatggtctcgatctcctgacctcgtgatccgcctgccttggcgtcccaaagtgctgggattacaggcgtgagccaccaccgcacccagccaggaattataattctaaaatttggtgaatggacacatacattcttaaccacaatatttttgttcattttttcacatatatttgttaaaaggataaataaaacatttttctgcatctaattcagtcctccaaactgtcaggttctacttttaataccctgatagaaaacaggggaagaatttctacatttagggattttcaaagtgggctaaggcctaacagccattgaagcagcaataatataaaataacattgttcataatgacttcctgaaaaccactttatttattgaattgtggcgacatgaagtcttatattgatgccacttctcatgtagggaaaatacaaacgtcacagctcacgttttcaatgtggtgtggctataaaataagagttactagctttaaaattgatgtaacaaaaaatgcattcaaaggattattactgaatttttaaaaagactgtttggaaggctctatgtattccagtatattgtattgctttaaccatttctgaaattatgcatgcaattgttatcagaatcagtagcaaaacttctttcacttttattatattaaatattttcattttattaaaatagtagaatctaatttcagaaaatttagaacatttagaaaagcatgaagaaataattaaaaatacctgtaaaatgttttgataggtggaaataatagctataaatatatttatttatttcctaccaatgtagtactttgttactaccattattaatatggcttatatataatgtatatgtgtatgtatgtgtatatgtgtatatatataacttagttcatagtatctgtatatcctgttcatattaatattttaaatatttttgaaaaatttaaaaaatatgattgcataagccaatgtaacgtcatttataactagactcaaattgattcttctagtgtaaaaattgaggtgcatatttttaaacattcatatttgtgcatacctcataattttcttaagatatttgctattagagaaatttgggagcaaagtagcgtaaagtttttgtaggttgcctaaaccatgttgccctattacattttgaagattgcaatgaactctgctgactcataaccccagatttgtttccaactatctttttttgtttgtttgtttttggagacagggtctctcagtctatcaaccaggatggagtgcagtggctccatcttagctcactgcaacctctgtctcctgggctcaagcgattctccattcttagcctcccgtgtagctggactaccgacacgagccaccaacgcccggctaatttttgtattttttttgtagcgacagggtttcgccacgttgcccaggctgttctctaactcctgagctcaaaacaatctgcccgccttggcctcccaaagtgctgggattacaagcttgagcaactgtgcctgttctcaactatcttatattgaacaaggatacaattattaaagatgtgacaactatcaaatggccataagaaatattccaaatgaatcacaacttggccagcctgatagtgtaagcagctgaatcacctctagaagtcatatttagaataagtatctgagacaaatgaactcctaactctttcagaccacttttaggagggtcttctttgtcttgccttttgcctttatgattgtaatgtgattgaaattacttataactcttataaagatctttagtagggggcaaatgctttttgtcatttaatacaaaataaaaatttatttggtattaagtctaatggatattaacattcacgtaagagaaaatcttgttttgaagataagtgtaatttttgactgggaaagcaaagaatcttcaatatcttttaaactatctaaagtttttaaaaatagaagttctggaaatgtttcgattggattacatatgcagattcctaaagctggttgctcctcaggtaacccttctcatttgagatttcaattcccatggatgtattgagtgagggagatgaagaaaaatagatgcctcaataagacagaaatggatagaggtagagacacagatagtacaagagtgagaaagtgagatacagaaagaaaaagagacagagacagagagacagaaattaaagtgccatattttcagtgattttgaaaatgttgtagaaaaatggtgtctagtttactgttctcatttcatttcatgtgatgatctttaactcctgctctttttatttcccttcttataggaggaaaatcctcccttaccttggcccattaaagtatgcgggcagaataaattgttaactccaacaactggcaaatatactgagaaccgaagttttcccactgaaaagaagaaaaatattgctgcacttgctattattgaaatatgccctattataaataatttcttgtcctaaattctcatcataaggcacaaataacattcacctggaaaatgcaaagaaccacataactgacgcacaaggcagaaaaactgaaatgaaaataaacaatttacaaatttgtacatcagcatttttcaatatttggatagaaaatgtcaatagtacaatatattccatactgtataaattctttctgtgagaaatagtgtctttaatccttccctatgttttagttttattagaatcactaatccatatgcattttctccacacaaactttcacatccttctcttgggatccactccactttctacataaagttaaaatatcacaacagtttcaaaactactctctggtgttttgtattcatctttcacaaaacctaactgagttggctatctatagtttagattcttcctaaactcttacttctgctaccctaactgcagggattctttaaaagccaatacaagttctggaatcattgctttttcccactgtgtccttcaatttcccatttctgagtttacttgtcttccctaaaatgtcttagtttcacaaaaacaacagtcatgtcaatcatatttatcattttctctctgtgccaattacaaataagttatttcataaatttttttgaatctttttatgtgttaattaatttagaaagtgacaaatggcgagaatcctaacaatcacctaaatctttcaatagtgggtgataatatcctcctaaattacattttaacttctatttccagagttaaatgtcatcaaattgtttacatttttgaaatattttgcctagatggacttataaatgtatgaataagatatgttttgttattctgcataatttagacaacatgacgtttatctaacaatatattatgtacttcagtttttaaagggctttatagtattccagagagcacagtaattcactttcactaaacactttatagtctccagagaaacaaaatcaagagaggatacatggatacacacacacacacacacacacacacacacacacacacacacgcgtatatacgtagagagagaaagagatagtggggcagggggagaaagaaaggagcagagggaggttttaagagactggctcacatgattgtgcgaggtagcaagttcaaactgaagggaaggtagcagactggaaatgcaattaggatttctatggtgcatatttgatgagaattccttcttctttgggaaatcttagtctttgctttttatatttttacttaattgaatgaggccaatctgcattatagaggacaatatgctttacacaaagtctactgatttaatcatgtctaaaaaatactttcacagcaatattttactagtgcttcaccacacaattggactctgtagcccagtaaaatggacatgtaaaattaaccatcacagcaatctatccattgctcagggccaaaattagagttatttttgactgatctcctttatatggcacaaccactccataactaattcatataggcttcttgatccaaacatgtctacctctctccacatctaatccactataccatcatagcccagtcacattttttgtgtagattactgcaatggtaccttaactgctctcctgccttccacacttgacctccctcatatcccaccctccccaacacatatatattctccataaaacaatcagagtaatttcatttaaggaaactcctctactgagaacaccccaatagcttcccatctagggccaagtaaaattaacactccttacttcttagaacgctccagactctgggcccttgcctcatttcctaccacagctccatcatatgccacttcagaagcattagcttacttgacgtcctgtgaacatatcaagcatggcctctctcagaacatttcctttctgtcccatctgttcataaccacctttctccaggtatctgtattgcattgtttcttactgtatttaggtttctgcctctaaatcactataacacagagtactctccttatcagtgtttttaaagtaccccaatcaaacactgaaagtcttcatgcctataattctcctttattcttccttattgcaactatcatattcggatgtaaagtgtatatattgtaaacttgtaaacttatctgttggtttactccttcactccctgtgcacaggaataaaagtgtcatgaaattggagaccacaccaaaatctttcactgtggttttctcaagcaattgaagttaattttggcatatagtgcctctatttaaaaatgtgaagatttattacttaatttgcaatatttcttcaattcgaatgcctctttttctacttattgaattatgaattattgaatacttattaattactaaatattcaaaatattttatttcatgctttaaaaatcattttatgtgtgtctattataccccttttataaataacaacactgatattcaaatagttaataactctctgtcagagagcttacaagagataaaacaagaattaagatgctggattttgtaactcaaaaggctatgataccataaatgagttacatattaataaaataatgtttaattaataaaataatgaataaaagtgtcagagaactaacacacatacacattaacaaaataatgaataaaagtgtcagaggactaacgcacatacacacaaatcatcagataaattcagaactatgcagtctaaatgtgagtatagaatgggtaaaagtatcttgactgaataccattgaaacaatgaaatagactagtataaaattactctaaaatgtggcaagaagaaaataaatggactagagacctcatgacttgaagaatgagaatgaattgagtttctgtagctttatttttattcctcatatatctcatactgggtgccagagaactctgcacactcagactgccagcagagataagtaaaaaataagacaaaaagaaagaaaagtgtactctgtctgaccaaagactgctaaaggagaatcccagtagagatttagtgtggagtcccatgcccagtgggaatggtggcccaatctgcctgatgcatcattgccagcagatcctgaatgggccaagttatcccttgttttacacccactggtagtagcagctccttctaactccagtggtgatgtcaatagatacagtgaaggctgtcagaacctacattataaacctaaacattttgatagccagttaaattagaagatttaaatagaatcaagaatgccttaacataatatcaaatataaccagaatataattgaatatcactcatcataccaagaaccagaaaaatctcaatttaaatgagaaaaagacaatacagttatgccaaggctgagatgaaatggtttttagagctatctggcaaagagttcatatcagccattattaagtagatttctcaaatcgttacaaatttcattaacacaagtaaaaataagaagcctcaaaaatagaaatataaactataaaaaatccaaatggacatggtaaaataacaaaatgcaataacaaatatgcactccttggaatgcatcaatagtaaaggtaacaaaaaccaggatgttaggatagatcattggaatttaccttatctgaacaacagagataaaacagaatcaaaaataaaaaagcctcacgaacacgtgggatgataaaaggatctcaatttatgtcattgaaatatcagaaggaaaggagaatgaatgaggtgattaaaaagaattctaagaaataatgaacaaaaatgtcacaaacttggccaaagatagaaacctacaatttcaagaaaccatgtgaataccaaatacgtaacttcaacgaaatctatgccaagacagatcataactaaatctctcaaaactaaagacaagggaaaaatattaaaagcaaccagaatgacattcagaatctaggtttaaggaaagatatgttagccttgactatgaaagcatgttttatataaggaaaattgacaaattggactttattgaaaataataagttggctccatgaagaggatacaaaggtaaactatagacttggaaaaaatattttaaaatacttacatgccagagcactaatatctagaatctatatagaaggttttaaacttcaaaagttaaaattaaataattaagtccgaaaatggcaggtaatattaaacagatagtctagaatcctcaccctcagtggggtagatagaggttggggagagatacttgaacagctgcacaaattcctgcagcctaggccactgaggaatcatggatgttgacaacagctgaaaactgtatgaagatgatactacagcgcccacccagaaatcaaatccagttcaccccatctaaccaaaatcctgtaacacatctggagttgaaaatctttccctacaaaaaccactttacaaaactgaaaaaggcagttgttgtgccagatgcacagatatcaatgcaaggacacaagaaacatgaaacagtaaaaagaaatgacacagtaactgatcacttggaaaaggaaatgtacaaattgtctgaaaaagaaatcaaaataatgatcttaaggaaattcagtaagatacaaaagaatccagatagaaaatacaattcaaccaggaaaaaattcataatttggattagaaattcagcaaaaatatagatatcataaaaaatctcagaaactttgaagctgaaaacttcaataaataagataaatatacaactgagagcttgaaaagcagacgatcaaatgagaagaaagtgcttatttaagaaagaaatttatatttagaatcagaatcaaatcacaaaaaagtgtaaattttgaaaaaaaatcaataaatgccaaccacatgagataatccgaaaagcatagttttttcttagctactttcatcacacaactctatagtacctttattcctttgttttcctttttgtttggctgcacactctttggtcacctattcaagtgacaatgattttataatatttctaatagctaagatagagtgattatttatttatatcacttattgtttcttctaacttttatcttagcctcagaggttatgtgagccagtttgttacatgggtaaattgtgtgtcactggagtttggtgtacaagtaattttcattacccaggtagtaagcatagtacctgacaggtgttttttttaatcctcacccttcttccacactgcaccctcaagtaagtaccagtgtttattgtttccctctttgtgtccatgtgtactttttgttctcatctttgtgtccatatattcttaatgtttagctcccacttataagtgagaacatgtggtatttagttttctgggactgcattaatttgcttagaataatggcctccagctgcattcatattgcagcagaggacctagttgcattctttttttatggtggcatagtaccccatggtgtatatgtaccacattttctttattcagttcaccctcggtgagcatgtagtttgacttcatatctttgttattgtgaaaagtgctatgatgaacatatgtgtgcatgtgtcttaagggtagaataatttatattcctttgagtatacatccagtaacgggatttctgggttgaattatgattctgttttaagttctttggtaaatctccaaactgctttccacagtggctaaacaaatttacatttcctccagcagtgtataagtttccttttccctgcatcctcaccagcattggttattttttcactttttaataataatcattctgactgatgtgaaatggcatttcactgtggttttgatttgcatttatctaataattagtcatgttgagcatttttccttatgtttgttggctattggtgtgtcttcttttaaaaaatgtttgttcatgtgctttgtacatttttcaatggggttgttcgttttttgacttgttgattggtttaaattccttatagattctagatattagacttttgtcagatggatactttgcaaatattttcttccattatgtaagttgtgtgttaactctgttgatagtttgtgagtattttgtgattccatatatattttaagattgtatttgtgttaaagactccaagtctttaacaacatcccacctgtagtcgtttggggcccaggacagtcaatgtcagcatccttcacaactctgaaattctagtatatgttgtatacattacatactttgtacattttttttaaatgacagaaagctagatccgacagtggtaattcattgggacacaacaaatcaccaactacttgggatataatggaaaccttttatcaccacgtggatgacaggaataggtgaaactaatggtcctaacacagggaaatgatcaatgcttgaggtgacagatactcccattatcctgatttgatgattaaacattgtatgcttatatcaaaatgccacatgtatcccataaatatgtacaactgttatgtatctgtaacaattaaaaattaaaaaataaagatcctttagaaagccagtgtttattagaatacacttaaatatttatttaacaataaattaattataatttcccaatgaaatacaaaatacaaaattataaataatctattcaaaattaaacttgaaacttatttgaggggttgacaacaggtaaaataaactctttcccgatcataattcaacttccatttttgtaattatttgtatttaaattgcctggagtagaggcttgcatatcatgatagtgttgttttgtttccctgcactgattggatgctgcttatttaaagaactctggtagtggcactcaaatagttcatagattgataatttttcttgtatatacgacaagcaacaggcagtgatttctgtgaactgcttatcaacttattatagaagaaaagcttaaatatgcatatattcatgtgattcctctgtgcatatttgaatttcaaaaattcaaaattattcaaactattttatctttgttagtgtgtgtcatcggctacttagacccttgtgatatggccctgaaggaaaaatgcttttttattgatttactcactcacagaaactaatgtcatctctaactctgctcacttgctattactgtaaaagaaggtcaataagcaatatttgggatctttactttctttattagtgagttgaaatataatcagtgcaaccaatgtaattttctgttccccaaaatatataaaagctcaaatttcaagaagtatatttgtcaataacaattgatttaatagctcaaatatatacataatttaaacagaaaccaagttgtcaagagacatatttaccttatatgtgtttgacgttcttgtattttgaccaatttaccaataatagcattgcaaattaccattatttttcaacataaataagaatttttgctgaaaaaaattgtggataatatgaaaatttaagtaattctcagtaaaatatattttttaaagggcttgaggacaaataattaactgagtaataatcagtttcattttccctaaaatttttagcaaaatgaatcacaatctctctaggtttttctccagcgtaacttcctgtagcaggtcacacatgtggatgcaacagagagctggcatatgctgctactactttgagatccttgtcaccaaataaccactctgtgaaggacctcttcaaggagaactacaatccactgctcaacgaaataaaagaggacacaaacaaatggaaaaactttccatgctcatggataggaagaatcaatatcatgaaaatggtcatactgcccaaagtaatttatggattcaatgctatccccattaagctaccactgactttcttcagagaattggaaaacactactttaaatttcatatggaaccgaaaaaaagaccgcatagccaagacaatcctaagcaaaaagaataaagctggaggcatcatgctacctgacttcaaactatattacaagactaaagtaaccaaaaaagcatggtactggtaccaaaacagatacatagaccaatggaacagaacagaggcctcagaaataatgccacacatctacaaccaactgatctttgacaaacctgacaaaaaacaagcaatggggaaaggattccctatttaataaatggtgttgggaaaactggctagccatatgcaccaagctaaacctggatcccttccttataccttatacaaaaattagcgcaagatggattaaagacttaaatgtaagacctaaaaccataaaaactctagaagaaaacctaggcaataccattgaggacataggcatgggcaaatatttcatggctaaaacaccaaatgaaatggcaacaaaagccaaaattgaaaaatgggatctaattaaactaaagggcttctgcacagcaaaagaaactatcatcagagtgaacaggcaacctacagaatgggagaaaatgtttgtaatctatccatctgacaaagggctaatatccagaagctacaatgaacttaaacaaatttacaagaaaaaaaaaccccatcaaaaagtgagtgaagcatatgaacacacagttctcaaaagaagacatttatgcagccaacaaacatatgaaaacaatctcatcatcactggtcattagagaaatgcaaatcaaaaccacaatgagataccatctcacgccagttagaatggcgatgattaaaaagtcaggaaacaacagatgctggagaggatgtgtagaaataggaatgcttttacactgttggtgggagtataaattagttcaactattgtggaagacattgtggcgattcctcaaggatctggaactggaaatactatttgacccagcaatcccattactgggtatatgcccaaaggattataaatcattctactataaagacacatgcacatgtatgtttattgcagcactgttcacaatagcaaagacttggaaccaacccaaatgcccatcaataatagactagataaatgtggcacatatacaccatggaatactatgcagccataaaaaacgatgagtttatgtcctttgcagggacatggatgaagctggaagccatcattctcagcaaactaacacaagaacagaaaaccaaatagtgcatattctcactcataagtgggagttgaacaatgagaacacatggacacagggagggaaacatcacacaccagggcctgttgggggatggggcctaggggagggatagaattaggagaaatacctaatgtagatgatgggttgatgggtgcagtaatccaccatggcacgtgtatacctatgtaacaaacttgcatgttctgcacatgtaccccagaacgtaaagtgtaataataataataattaaaaataaaaaacctttctgtgaagaagctgaaatgagattgaagaaactatttggcgaagacaagttctgtaacagaagacctctgtatatgattccagccaatagagtttaatatctgcattaaaagaattgataaaatgtactcaaatcttccccgcctgattagtatgctgaattgacattgatgggaaccagatgactcaactgagcaaagcttgagcaatactaaaatgtgaaaccctggcaatacgactctgagattttgtcctatgcacgatttaacattttatcacaataataatttgagacgcttttatagattagtgattataatatgatggaatttagctttttgtaacactgcttaaagagaaaaattaaaaggttttgtagataatttaatacattgtctaattttattagaaacttcaggtgtgtcatggaaggaaatctgtatctcctcaaagttcataggctgaagctttaattcctagtatttgagagtctctgtctcctagtacctcagaatgtgactgtgtttggagataaggcctttaaagaggtgagtagggtgaagtgagataataggagttgggttctaatccaacaggactcgtgtccttagtaaaagagaagaaacactaggaatgctggtgcacagaggaaaggccaagtgaggagagagagagaaggcggccatcttcaaggcagggagagaggcctcaggagaaaccaatcttgctggaacattgatcttggacttccagtgtccagaactatgacaaaataaattgctcttgtttaagtcacccagtttgtgatattttgttatggcagccctagcaaaccaatgcaagaggacttatgttttccttaaactcctaaaaatttactttgtttttaatttcatttactatatgtaaacatgctttcagaatttcagacttcctcagaatgtttaattcctttccaaaaaacatgtgactcttttaattatagtatatttttctatacttactgaagaaatgattttattattcccaatttagtttccacatttcaaagctggttatgtatagcaagtcatacttttatatataaaaaaataccttgccagtaaccttctccaaagttatcttcaggtttcttaatgaaagggaggattcaattcttttctttgttgtgcttcatagatttcaattaattgaaatagtggctttgacagaaagactaacatctctctttttttttggtaaaaatgagtgtaattttaaaatacataagtgttaaatatttttttttttgtttttttaatttttttttttattatactctaagttttagtgtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccaagtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacatttattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaaaatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaagagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagacaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccgatatccttgatgaacattgatgcaaaaatcctcaataaaatactggcaaaccgaatccagcagcacatcaaaaagcttatccaccatgatcaagtgggcttcatccctgggatgcaaagctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaagtgttaaatattttaatgtttaatctctttgaaattatcattaccaggaagacaattaaaataaagacacccaaatgtagaattattttatattttgcatcccttactggagaggatttaaagaaagacagcacagtcacaaggcattacttcagagaattgatttttttaaaggcttttatatgataggctacaaattatctcctggccagaaagtgaaaaccagtcaaggttggttattatagttttaatcataaacccctccaatgttcaatattttgaaattagttgaaagaattattattattgtctttgaaaatagctgttattggaaatatatgtgtatgcatatgtattatatatgtaattctgatgtttctgtatccattaaccttatcctatgcatttcactacaaacttcatatttgagctactactcaaaagtgtgctttcttttcttatgaaatttctcagtgaggctatgaagaatgctgggactttttatgatgttgctgttgctgttaatacttgtgtcattttattcctctagaagactgcaactgtgtgcctgttgagagatttgactctgtaatttcagcaatccctgaagaataaagtaatctacactttgaagtacaagttttgaaatatttctgaggccagttctttctgtatggaaagaataaacacaccaaatattctcccacttggtgagataaaagagaaattcaggctaagcacaagaatatcatcttgatgtaataatagtgataattataataacatctttatcttgtgtagtattttcttattgtaaaaatcatttcaaataactttaatgattattcatagtgacttcatcaacatgttaaataatactctgcaatattgtagaaatggaatatattttagttttttttgcattcttaaaatatcctttcatatcttcatatatttcagccacagatgtttcacatctgcacatataaatgatagagctacattttactataattgtatcttttgagcccagtttcactcttgttgcccaggctggagtgcagtggcacgatctcggctcactgcaacctccacctcccgggttcaagagattctcctgcctcagcctcccgagtagctgggattacaagcatgagccaccacgcctggccaatttttgtatttttagtagagacagggtttcaccatgttggccaggctggtcttggactcctgatctcaggtgatccgcctgcttcggcctcccaaagtgctgggattacagtgctgctatgctgggccgaaaatgaacccatttctaagaactaccttcctatttactttgatttagcttactcttaaaaatgtttttatcatatactcaataaaacacacactagtaaaaataaaaagtcaactttttagaaaatacaaaagttaagtatatttgatattcacacttttttcttaccaagtaatttatctcttttatgaatttccaaaatcctatgagatttatgatgttctaaatttaccatataaacaggatttttatcagtgttttgaatatgccttaaacatggtttatttctttaagtttctaagtgataatgtataaaatgcaaactaaatctaagacaagaatgatcatattttctaactgcatggttataaaaacgcaagagttttatcaaaatctgattcaaaggaaccaatcccaaggaaaacctaagcaaagccagtaagcatttagaaattacctagtggatatccagcattgtgctgaacttgctgttgaattcagaaagagtgtaggtgaagattctccacttaaactattaataatctaagatatatatctaattaattgtctagaagatacataaaatgatgtatatcagcatataatacactaaatatgtgtattttatgtattaatatatactcatattttatacattcttcagtgtaaagcaaatgatttcttaattttctttacatgtttcatcagaggtaaaaataatgacctttccataaatgcataaggaatgaggtaactggaactgaacaggtcctcatgaaatagttatcatgtttgtaaaatgtttttggtataattatgggtacccatatcacaactgaacaactaaattgcaaggcctgagattgtggggctatgttttaacatcctctgtcctccatcttgcgttgaaccatgctttggttttatcagacatcgactatgtttcagagaaggaataaaagataggaagaaaaaaaagaaaaggcagaaatgggaaatgaaggatggaagcagaggtccaggaagaaaggaagataatcaaattgaagtttgcaacagtcaacaaattaaaacaaagatgactggaattgaatagaaatacagttgataaaaaaagtaaagatagaaatggggcatgacacttgatttggttatcctctgtctctccatgtctgcactccactttatattttttctctgccctctactttactctgggagactgattcccacagattgcaagacctaggcccttgtgctttctggctttcagttaagtggtatcaatggggcgcaaacaaaagataggaaggcaagaagagatgtataacttcctgccttctcattatttcactgtggattggaaaaaactttgttttctcacttatggctttagcttctcttaggtagctttgcccctacaattacaacaattactggtttccaacagcattgttctctctcaaataatctacagatctagggctactaatgactccttgcttttgttagtatctggaagctgtaccatcccctcttaatttccttaatcttttccagacctttgtaaacaggcctttattatttttttaaattacccttttatatgtaccatctctttttctaccaaaattatctgacaattagtactagggtggcctcaagaaaaaacccacaaaactagattatgtaataaaaatgttcatctaatgactcctcaaaaaatctccatgttgaaggaaacgggatttaagagaatatagcgtagagtggtgtatcacaatcacacacattatcactgacactgccatgggcttgaatgcaaatggaggtcaaggcattgggagacaagaataaatgacactcaatggccatgctaaaaagattggtattgattatgttttgcgctgaatgatgttgatcgtattgcaatgatacaatcattaagcaatgatagaaaactttgagcaatgatagaaagatcagtgatagaaaactctgaatttatatctcaaggtacaggtcaacctgtatctggctacctctttggcagatacagattcagggcatatatggctgaagattgatcataagaattggttgtaagagttgcagagttggaagcaaataaatacttcataaggcactggttgagaagaaatgggaaaatctttcaggaacaacacatgtaaggaaatgaggaggcacaacaggcaaagggagaaaccgaaatatgatacatggctacagatgtttcagctgaccttatggggaactgtgaagccaggatgatccttaagagagtttttaattgacaaaaaggaaccagggtttttacccctctatccacgacccagtggatgtaggccttccctgagagggatcatttctcagttaacttattattgcattaaaaaccattcccgaatttagaagcctaaataaaaaataattattttttcatcattctctgtattaccttgtgattcttcttttggtctcacttgaaatcactcacgtggttgcattcagttggtcatttcattgtggccagaattcagccacatttctgccattttcctcctcatgtttaggttgagccctaaacagatttttgtgtttgtttttaaactaaaaggccacttaaagcctagccttagaaatcactgactctcttctaccacatactattggtcaaataaaatcatagagtcagttcaattcaagaggagaggaaatacatttcaagaggagagaaaatacattttgcaatgagcaaattctcactgcaaaaggcaggcaggatggggaatgcagttgcagccatctttagaaacaaaccactgcaggttgcaaccttgtgtgaggcagctctttttggttcataagaattcttgaagagatactcattagtgagccatggcagacaaagtttcctgcatttgggtcagtgagtgccttgatattgaaaagatctaggcagtgtaccagaacttccactaccttgactgcacctcatttcttccaagttcttaactggttggatctcagcaactcccagatggaaaagtgcaaagcatgatcttcttggaagagagttgacactcttacatcttgacaccatttttggcataagtgtggagaacatatgggaatacattctgagggtgttagaccaaagaaggcagaatgtaagatttaatatttctggatttatcactgtgaacacacgcatagtgttagaaggttgacaagttaacttaaaggatattaacagtctgctaggttatttaagtgaagcctgcttgtcaaaacatagatcgttaggtctcactttcagaatttctaactaatacaacatgggccagaactttgggccaggcttaggtggagcctctgctcagtgtgttcaagggctcatcatgtgagatgtggtcctcattttgaacttgggatgctttttcaagtctgtcctggtgattggaagactttaactctttgaggttgtaacactgagaccctcagtcactagatgctacctctctctatatatagttttgaacatcattgtttggttctcttctttgaggctagaatgagaatctctttgatgttttaatatcttttaagagctcaccttattaggccagaattacccaggataatcttattttatattaactcattgtaaatatattaattattaaactgaggcagccatatccaatacaaggacatgtacaccagggactgggaatctcgacaatcatcttagaattctgcacatcagagatggaaacagaatatttccatttctacaaggttcccctttacactggtgctgtcaggttggatggcatacctaggaaaaaaatcaaacagagtagatgagttttggataccataacttccttggcataatgtataagaaggggtttgaaggttcaaggaggtgaggctgttggagaaggtatgttgtttatagccttctcattgaatacctactcataccttaatccataaagacctagaaggttctctcttcaccaaagaatttaacaatatttttgtaaggggcttgtatatttgtacaagaacttttgtacttgaacatttctgctgcagctgacctcttcactccagagttcatagttggagtgcaagaattagatgtgtggtaatgcctaattgatcacaaaggccctaggattgaagaataaggggtataatgagatgacacatgacatatataaggaaaacagttctaggtcaagtcatagcgagtaatcttggcctgtttcccagttcacagacacagactaattcaaaagacagtacattaactggctgagggatgaatataaatcccttaacaaacgtcccaaatacattctgcaacttttctcccaaactttcctgcagagactcttaataatttgtgtggaaataaaacagttcctcttcaaagtttcccttcttgttaaagaataaatcgtaagtgttagaaataatagtttcttttaaagaataacttccttcacgcctccttgctttttgctaataactctttgttaagccctatcctatgtagctgttagatataagagaatgagtacattctacgtccttgtactttaaccaagatatttgttctagacatgctcaggcctgtcccagctcacagcatatgccccttccttatttggaaatgttattacttctctaagtcttttcgtaagcaaatttctcttttcctttgttctcccttgcctttacctatttcagaaagttttaagttattagccagtcgggtttagcttagattgtgcggtctggctccaaccaatggagacaggacaaagtagcagggacaagctgcgtaagagataaaaattgcttccctcctttgttcaggtgtgctctcaccattgttctacctgtgaggagccccctttctgcataaagtaaaattgacttgctgagaaaactttttgtctgaatgctgatttttactggcagtactgaggaataagcattttacttataacaatttctcaaggaaaatgtaaactggggaaacgaaaatgcccagagcttccacagacatataaaatgctcaatttaaaccagtgttaataatatgtaaataaaatgatattaaagacatttagtgcttaggaaggttgggtcataaatgtagctatagccctggttactttcctagtatgttcaatgtgcataggaatcctgactttgatttttatcccaggctatacgcatagtgggaatggacacacattatctgtaaaactctgcttttgagttcctgactcatgaagactattattcatgaaggtccaagaaggccctaaaactaattacccaactcttaacttggaaaaactacacatttaaaggaataccacaacccaaagaaatagaagaaattagtgctaccatctaacacttgaaaaattcaggatggtgacttttttctacataccaagttagtgcacctggttggctatgtcaagatgtggatcaattttggataaagtattaatattaaggttttgttgtcaattgctgatgcttttccagatgtgctattttaattgaagcgaatcagtgtcagctctggcacttggcgtataattattgacctagaaaatatttttttggtattttcttcaactaagaaaactagaacaaatttgccttcatttcatagaaatagcagagtgtttcgggtttcttgtatcaagaatacaatattcctcttatctctcttgtcatagtctggagagatcttgatgagcttgacatcacacaaagcctagtaatggcttatatgcttggcagattaagctaactggattgtcgaacagcataaagcaaatgcacaagaggttataatgacatgtgcgccagagggtgggaaataacatggaagttcagatatctgttaaatcagtaaatattctagggtttccatggcctttggcatacccaggtctttcaaggaggagacaatttgctagaccttatgctgtccacaaaaggcacaatgattgatagtgcctttttggattattgaggtaatatgaattatatttgtatgtgctgtcaccacatatttactgggtataccctacattttccagttttgaatgtgcctagtgctaaggcatgcttcatgccaggtccaagttgcaggatctagatgctgctgcattagatattaggaactatcagaactatgatattagaagagtctgtgtcaaattggatcccttgatgaaacctctcatgagacccagagcagagaaaattaatagagattttgggtaaaaacattttttcatcgaccaataactattttctatttgagagaaggtaggcttactcttggagttcagtaaagaaggaaggtctgacagtggcaaccaagtgacagttctccttcagtttccaacatgaactggttgttatctggcacactaaatcataaattaagctgtgctcagtaatattccattttaaaatataccatcttcacttaaatcaataggccctcaagcataagtgataacatgtaagcatgcaaaacagattcccatgtaacctattttacagcctctctgcttgtcctctagccaaatctatggccccaaaggttattctccatatttagttaacagagaatgaagctatacatatcttcctggtatgcttggatccaccagaagtggtccctattaagggtagcctaaaaacagcaataagaaaaatttccaacagtggatagcactgttggaaaacacatttgatttttcaaattctgatggaaaaagagacggccagagattaccataagttataattattggattggccagctcatcacaggctcagtaaaggccccaaaagagcatccacaaaaaaggtgttctcaataaacatggtaataagtgaaatcttcctgtggatgaaaatcagccaccttcttaaattaacgtgggcttgttcaaagggcccatgaacacagatgttaaggacatcagatatgagatactagtgggctcaacaaattttattttacattatcaagaccaactgggtcactgaacctgctgagggatcaaaatttcaagagcaaaggtcaatgtcaatatatgtttaaataaataaatatttcagagtccaggagaaatatggacataattattgatatattaagaatgagagccaaactactaacaataacaaagacatggaatcaacctaggtaccattcaatggtggattggataaagaaaatgtggtacatatacaccatggagtactacacagccataaaaaaatgaaacaatatcctttgcagcaacatggatgcagctgaaggccactatcctaagtgcataaacccaggaacataaaaccaattactgcatgttctcatttataagtgggaactaaacattgagtacatgtggacacaaggaaaggaacaatagacactgaggactacatgaggatggaggccaggaggagggctagggatgaaaaactaactgttgggtactatgctcactacctgggtgacaggatcaatcatattccaaaagtcaatatcacccaatctacccatgtaataaagctgtacatgtactctgaatctaaaataaaatttgaaattacaaagaaaaacaaagggagaaaagaatgagggctaaattgtctcttcctatttttagctcatcataccaatgaaataataaagaagaatgtcattatggtagccaaggtaattgatttcaattaccaaaggcagttttgattgctgctactgaatgaatgcaattcaagagacatactggagtgcctcttagatttatcatattccataaaaatagacaatgggaaatgagaaaaagatgggaatgctattaacttagatcagttagtttggtttatccaattaggcttgaaaaagaaagaaaaaaagaaaacagctgaggtactagaaaatgtttgaaggaaaatagattgggtgttattcaattcggccttcttaacatctacatatggagagattgtggcagctcttgtataataattaaatatatgtcatcctctcatttttcaaataccttatgtaaagagtgctaggagtacatttagtaattaccataaggatttgtgtatctttggtacttaaagtgtttgtgagatgttcaagcttacaaaattacggttggtgatttaaattagaattgggtaatttattttactattgtgattttactctgagctatatgggaaaaatgtcttatttgtaaaaactgtaaattgctcaaatgaattggacttatagtaataattttaatatacttgattcacaagggctgttaagtcatttggaatattttgctgcttaaactttaaatgttgtccactttggctttgaaaagctttaaatgactgtcaaatagattacattcaaaagtactttttaaaatgattaatgaaattgcattaactaagtcctaaatgtttttgagaacttagtctgttcaactaaagttgatagaacattaatcagatttccctaggaaatgttctagaattataaatagaatattttaatttgtatgtcaaatgaaaatgtttaaaaatatttattgcaataaattaacattgactttaaatctaggacactactggtggacttttttgtgtggaaaatccctggatattaagatataaacattaattcttcagatacccattgtattttttatatgcagaaaaaaattagaaactcatgactatatcctaaaagacatcgtgatacaaagttgactacagttcaacctttatgccacccagccttcttgttctcttgacatgtaacccagtgtctttgacctttcttcaaatgacttaatctatccttttatttaggtctcagcctaaaagtcatcttctaagagaggctttccctgaacccttgactgaaatagtctctgtatcatgatggtttccacctccataagaacaccaaaacctggataatcttctctgtttgttttttcatttagtgtatgtttctatcggaagataaatttttgtgacagttaggtccttgtctacctgtttcagagctatatttctaaaagttagccgtgtgatcttggattatggtatattcatagttaacacttgttaaatgaggttaattttccccttcctttccccctttattggtatcaagcttctgactctaaagtctgcaatgtcagccagaaagatatgctgtgtcaggttctaagatataaatattagttgaggttattaagtaatacaattttataaaccaagtagctcaactttagttcaaaaaagttttttaaagaaccattcaggaaattagaatatagatataaacaagcttaacagtctcccaggcatcatgaagtttaaaatctctatattgaactaatttcaaactattaagcatctatctgtatatacttttgtgggtctaccaatgcagttaatacaagaatcgtattatttaatctataaaacgtaggtaatgaaataaaactttgctctggcactcattgtacaatgcataatgaactaaggagatagaatttttattcttcaaaaatgccatttagtttttacatgtgcattgtaacaaagaagctcatgctctttcaatgtttttattcattttttaaatcttatttagtgacaggccatgcacaagttcctatcaataaatgaaatgtaattgctttaattatggtcatttttaaactgtcatttttttatttgaaggataattatcaacaactgttaaataaaggattaaaaaattatataaaaaaccctgattcctgaaaaagtacaaaatccgagccaaatataattgtctttgatggtaaaacacaggaaagcataaagaaataactttgataaggatcaagtgctttgtcccttgtcactgttaaggatcaagtgttatgtcccttgtccactgaaatccttacattgggagtttctacaagtgcttttccatataaacattgtgaagtacttttacctcattccatagcatcaaccacttacatctcaaatgttaacatgatggttgtgtttggtattgtaaagactaaactatgaataataaataacacttacaaataatacatcattacataggagaatgttggaagtaatgaagtcaaagcactaccccttcttcccttatgaattttagctactttgtaaaagaacataggcagcaaagtcggatttagtcataagatagagtcatccctccattactccacaggttcctggtaaagtctgttggagtataaattttaatcctgaagagaaattgaggttaccaatgagctaatccttcctactcttcttacccaatttatacgttagggtctgtccgggtgaacccatagaattcctatagtttgtggtttatatatttgtagactgttcacatcttttggattacaagagaggtgtgtgtgtgtatgtgcgtgtatgtgtgtgtgtgtgtgtgtgtgacagagagagagagacaaagaaagaaagagagagagagagagaggtgtgtgtctgattatatgagatacgaagaaataaagaagcaaagaccaagtcagaaaggtccttaccattttcctctttcagtccctaaagaaggtggcctagtagctttcaagtgtccaacttttccagcagatataaagcataggtttggtcttgctccaaaatagccaactagacaccgccagaaagaaaacctcccacagagagacaaggacatcaagaagactggcacactcctagcagatcttcagagggaaggccttgagagcagacagaggaaaaacacagatgctgggctgaagtgggaggaagctgggaatctcgcacagggatattatgctaccatgttcctgacccccagtgactcctgtggagggtgtgagttgaacaggcaaggcagaacctgctctcctcatgggcctctggaatcccagcaggaggaaacccctcgaccaccatggacacttgagtttgcagggaaagttacttatagaagtggtaggggaagaccatctgctgctgcagagcacagggggtttggtgcaggagtacctgtagtggagcagagccagggatgcacaaccccctaagcttgacttgctcccatggacaattttagccctaggagaactgttggacctgaacccttcagggtggtcttgcccatgagactgggcaagtacagcctgagcacctcatggtctaatgggctctcctgggttcccaataaggttgggcctccttgaagtgtagtccccaatacttcctggaggcccatatatagctcctgcattggtggactgcacatgactggcagagtgctccagcagagatggccctgtggacccacacaagcctgcctgtgccctgcccccactgcagccttcccccggcactctgtctgcaaacacttgcccaacagcaccccctacattgctttgctggagcatgtgtgcatgggtgcttgccttccccaccggtgccaatgtgctgatgtaccatgctgtgccactacggctggcgtgagtgcatcccactacctcttcccccaccacagtaccactgtagtcagagcattggcaggaacagagcccaccagctccacccccatcagtaccctgctcctgcatcaacactgccaaaagcatgaaattaagcacagaaaacagtggacctgaccccagccctgagttgccactactgccttcataaaggcacacaaaggataaacactgtcttgagcccacaagtgcccacccccatgctaacatccccaatggtgtgaacacatgcactgtagctggcaggggccccttcattctactgagctctatttccaccactgctgctatgaaggcccacatatgggctggcactctggcacctgccagcaccctgcctcagccattgagtgtgcactctgccacactgccactgccactgctgctggcatatgtgaataaggatggatccaactgccactgccctacaaagtgttttggctggcaccacccctcacagtgttgttaccaagggtctgggggcacctcagccccctccagtacagcaggttcctaacgttgaggagccagtgaataaagccagggcctgatgccagtcccccagagtaagagcacatagtctagaggtcctgagatgaaccttggatgcctaaaatttcccagtaatgaagccagtcaactggccacaatcaaacccccaaggtcatcaaataggataaaagaaaaaaaaaaagaccaatccaagggacagcaacttcaaaagaatgaaggaacatcagcccacaaagatcagaaagaaccagcacaagaaccctaataactcaaaaagccagtgtctcctttctcccaaaagactgcaccagttctctaacaagggttcttaaccagggtaggatggctgcaatgacataaatagaattcagaacacgaaggggaaagaacatcatcaatttcagaagaacattaaaaccaaatctaaggaagctaagaatcacaataaaacaataaatgagtggacagacaagataactattatagaataaaacataaccaacctgagagagctgaaaaacactttagaagaatttcataatgcaatcagaagtattaacaacatactagaacaagatgagcaaagaatctcagaacttgaagactggctttatgaaataagacagacaagaataaagagaaaaggatgaaaaggaacaaacagaacatctgagaaatatgagattatgtaaaaagactgaatctatgagtcattggtgtccctgaaagagatgggaagaatgaaaggaacctggaaaacatatttgaggatattatccataagaacttttccaatctagccagagaagacaacactcaaattcaggaaatgcagagaacccctgaaaaacacttcacaagaagatcatccctaagacacataattatcagattctccaaggttaaaatgaatgaaaaaattttaaaggtaattagagagaaaggacaggttacatacaaaaggaagcccattagactaactgcacccctctcagcagaaaccctacaagccagaagagattaggggtctatattcagcctacttaaagaaaagaaattccaactaggaatttcatatccagcctaattaagctacataagtgaaagagaaataaaattctattcagacaagcaaatgctaagggaatttattaccataagatttgccttacaagaggtacttaagggaatgctaaacatggaaataaaagaccattatctgtcaccacaaaaacacacttaagtagatagtactctaacattataaagcaactgtacaatcatgtccacaaaacaaccagctaacaatacaatgacaagatcaaattatcacatataaatattaatcttgaatgtaaacaggctaaatgccccacttaatgggcactgaggcaaactggataaagaagcaagacccaattgtatgctgtcttcaagagccatctcatatgcaatgacacctataggctcaaaataaagggatggagaaaaatgcaccaagcaacagaaaacagaaaaaagtagaggtactaacttcaggtaaaaagaatttaaaccaccaagataaaaaaaggcaaagaaaagcattacataatggtaatggttcaatttaacaagaagacctaactgtcggtatttaggatagttatcctaaatacatatgcagccaacacaggaggatccggcttcataaaggaaattcttagagaccttcagcaagactgagactcccacacaataatagtgggagacttcaacaccccactgacagtattaggcaaatcatggaagcagaaaattaacaaaggtattcaggagctgaactcaacactggaccgaatgaatctgatagacatctacagaactctctacccggaacaacagcgtatacattcctctcatctgcacatagcacgtactctaaaattggccacacaatcagacatacaacaatcttcagcaaatgaaaagtattagaaatcataccaactgctctctcagaccacagtgcaatcaacatagaattcaagatgaagaaatcactcaaaacaatacaattatgtggaaattaaacaacctggtcctgaatgactgttgggtaaataatgaaataaaggcaaaaaccaagaagtcttttgaaactaatgagaacaaagatacaacaaaccagaatctctgagacacagtcaagacagtgttaagagggaactttacagtactaaatgctcacatcaaaagaaaaagacagatctcaaataacaacctaacatcataagtaaaagaactagagaagaaagagaaaaccaaccccaaatctagcagaagaaaagaaaaacaaaatcagagctaattgaaggagactcagacatgaaaaacagctcaaaagatcaacaaaaccaggagctgttttttttttgaagtaacaagatagaccactagctagactctaacaaaaaaagagagaagatccaaataaacacaatcagatatgacaacggggttattaccattgaccccacaaaaatgcaaataaccattagaaattattatgaacacttctatgcacaaactagaaaatctagaagaaatggattaatttctggacacatacaccctcccaagagtgaaccaggactaaatggaatccctcaagagatcactaacggtcttgaaaattgaatcaaaaatagatagcctagtgatgaagaaaaaaaaagcccaggaccagatgaacgattcccagtcaaattccaccatatgtaccaagaagagctggcatcatttctactgaaatcatttcaaaaaattgagatgggtgaacgccttcctaacccattttataaggccagcatcatcctgataccaaaacctgccagagacacaagaaaataaaacttcaggccaatatctttgaggaacatctaagcaaaaatcctcaacaaaataataataaaccaaaaccagcggcacatcaaaaagctaatccatcaccatcaagtaggctttattcctagatgcaagatttgttcaacatatgcaaataaataattgtgattcatcacataaacagaactaaagacaaaaaccacatgattatctcaatagatgcagaaaggcttctgataaaattcaacatcccttcatattaaaaactcttaacaatctaggtattaaaagaacatgcaacaaaataataagatccatctgtgacaaatccacagccgacatcatactgaatgggcaaaagctggaagcattcccattataaaccagcataaggcaaggatgccctctcacaccactcctattcaacatagtattggaaatcctggacagagcaatcagacaagagaaataagtgaaggcatccaaataagaagagaggaagtcaaactatccgtgttagtagacagcatgattctttacctagaaaaccccatagtcttggctcacaagctcctaaaactgataaattcagcaaggtttcaggatacaaaatcaatgtacagaaatcactagcattcccatacctcagcaatagccaagtcaaaagctaaatcaggaatgcaaacccattcacaattgtcatgaaaagaataaaatacataggaataccagggaggtgaaagacctctacaagaagaactacaaaactctgctcaaagaaatcagagatgacacaaacaaatggaaaaaatattccatgatgataggaaaagaagaatcatgttgttaaaatggccacactgcccaaagcaatttagagattcaatgctattcctatcaaactgccaatgacattcttcacagaactaaaaaaaaaaaaatctattttacaattcatatggtaccaaaaaagagcccaaatagcctaggcaatcctaagcaaaaaggacaaagctggaggcaccatgctaccctaattcaaactatactacagggccactgtaatcaaaacagtatggtactggtataaaaacagacacaaagacaaatagaacagaatagagagcccagaaatgaatttgcatgcctacaacaaagagatctttgacaaagttgacaaagatatgcaatggggaaaggactccctattcaataaatagtgctaggataactggctagccatatgcagaagatttaaacgggaccccatccttacaccacattcaaaaatcaacacaagatggattaaaggcttaaatgcaaaacctaaaactatgaaaaccctataaaaatttgccaaaaaaagaaaataggcaatactattctggacatagaacctgccaaggatttcatgacaaagatgccataagcaattgcaatgaaagcaaaaattaacaaatgggatcgaattaaactaaagaccatcttcacagcaaagaaactatcaacagactaagcagacagcctacagaatgagagaaaatatttgaaaactatgcatctgacaaaggtctaatatacagcatgtatagggaacttacacaaatctacaagaaaacaaacaagcaacctcattaaaaagtgggcaaatgatatgaactgacgcttctcaaaagaagacatacacatggccaacaaccatatgtaaaaaggctcaatatcattgatcattagaaaatcaaaaccacaatgagatatcatctcacaccagtcacaatgactattcttaagaagtcaaaaaataagagatgctagtgaggttgaggagaaaagggaacacttatacgctgttggtgggagtgtgaatttgttcaaccattgtggaaagcagtgtggtggtccctcaaagaactaaaaacagaacctccattcgacccagcaggcccattactgggtatatgcctaaaggaatataaattgctctaccataaagacagatacatctatatgttaattgcagcactattcacaatagcaaagacatggaatcaacccaaatgcccctcagtagtagactggataaagaaaatgtggtgcatatacaccacggaatactatggagccatgaaaaacaagatcatgttctttgcaggatcaggatggaggtggaggccattatacttagcaaactaatgcaggaacagaaaaccaaatactgcatgttctcacttatcagtgtaagctaaattacgcgaacacatggatacaaagaggggaacaacagacactgagtcccaccagaggctgaaggatgggaaaaggaagaggagcagaaaaaaacaactattgagtactatacttaatacctgggagaaaaattaatctgcacataaaaagctcaggaccagaaggcttctactgatgtgttttaccaaacatttaaagaagaattaatgcccatccttcataaactcatccaaaaatagaaatgttagtacacttctcaactcattctatgaggcccttataccaaaattagacaaagatatcacaaaaaaacaaaactacaagccagtatgacttatgaagatagattaaaaaatcctcagcagagtactagcaatccatttccagtaactatccctgaatttggacctctacttcacatgcacacaaaatttaactcaaaatgaataaagacctagaatttaatgctaaatctataaaattcttaaataaaaactaagtgcaaaaaaaagcacaggtgtgcacaaagtaaccagatgaattactccaagagatgtccatagtatgattagagtcaattccatttattaggaatagaggaaacaccttccatgactatgattatggatatctgccttttttttctctgaggctagttgaaactgtaaagtattttaaagtaatataccttttttatctttcagtactaaacatagtgggactaaaaatgtcaaaatgcctttttcttgttaatgaatataggaagaacaagagtgaatgtgtaacttctatatttctatgttaaaatatagttgattaataattttcttgagaagaggattcattataaaatcactggattactgtcaaagtcttttcttcaagtattttgtatagttgtttttatttctgttgttctacacttccctccttacaagaacatagatttacaacattagatttaaaaaattttaaatacaatgggatattgaagcattatttgtgtcaaatgcacatcatctgctacaagtcagtaacatctctgtttatcatgaaagattttgtggcttttagaaatgtcagatgtcatcaaaatatattgccaggtaaaagcttgagtggagtggagaaaactttttgttgtttagggttgaaacatttttgagtcttgcgtatacattaggctattgttttgtcggtaagaaagactatcaattagtaatattacgtgactttccatataggcatgaattggcctctgctatacttcttaaaatatcttaacctagggagagagaaaaatgtgactaatttcaaaaccatcctactgttaacttttcaagatttggaggctaggaaggtaccccaaattctttaagcacttgacagaactttaatctttatctataatatttttcactttaaaggagacaaagaaaataagatacaattatcacaatttggaaagaagaggtttactcatggcttttcttaatttttgagtatctttagttacacagatgaagtaaatatttctatttaagactcaacccggcaccactggatattttactgaaataacgacaatgtaaaactaaatggcactttagtcaaactgctacactctcaaaggttaagtcagaaaatgatgtaaatttttcaatactcctggaggagctgctgcaagctggagtcaatagtgataaatctctgtaaatttctgggcaggttgaagatttcagatattggaaattaccacaggatgagttcttaaggtcattttttaatttaacgttatgtgtttttagtgcttcattttattctgtctgtttgtacatgaactatttttttctttgcttactttgtgtgtgcaagttttacttctgataaaaaagccatagtgtcaattttcagttattatactgtttacctttaccgccaatggaaatatacaaagaccacccagatgagaaaaacaaggtcatttattctttacttcctatagcaagggagttggacattgtcactcgtgtttgacagagactcagaggcaggcagaggagtgggaaagttttatagtggagaaagggaagggcttgggtgtgccctgttggtctggagaagctgcacatgggattaattagaatcagaacatcccatgtgacggtaaagggtgcacgtttggctttctctggttggccctatttgaaagcagggacaaaaattaaggaagctgtcagttactaatcaattcctggccttttctgactgattgttacagaagttattattcagcatcctggattttcatggagatagtattctgactccctgcaagtctgcctcaaagctggcttcatgagttctttattgtagataagatcttggtttcttgggcagcttgctgaaggttgtgggtcaaagatccatttctatatatggtctggccattgtctacttctatattcaatctttcaaccttcatgtattgtttccaacccaaaagaccttctgttttctgatcatgggtgattcctatagactcatctctaccacttcctttcttactcatcttacctgaggtgtgatggccttccttaccttaggcctttacattttctatttcttctttatgaaatgctccgcagcaaaacatgcacatggctcttttgcactctgttatctggtctctgctcaaatatgactacttcagtaagattttcctttatcagcctacacaaactacaccaaatcaaaatcattctgcccaatttacatatttcctccttgtataaataatcatgactgtgttccagctgttcaattttgtttgtttattatttctcccttactagaatgtaaactacatggcctcatggatactgcctgttttgttcactgctatatctcttcttctttggacagtaaattaagcagagtaattggtcatgcattatcagttaaacacagctacgtacctgtgctctgtgatttaataaatttaagcagtaatttttcatccaccacacgaattatgaaaccttacttcattgtttttctactccccatttcctatatcttctcactattttaatttgttttattatctttagtttatcaagacatattcatttcagaattatccttaatttaattgtaaagtcagaaaaaagtaaaatattgccaactaaaaacattcctggattaaaaaaatgaaaaaaacattttttgccatcttgtttagttcatgtctcccaacatcaaaccacacattgcttccaaatttgtaaccattactctcttctattgtatatgttttcaaatgattctatattaatcatggtaaatgaatgctaattcctataacaagcaaacttattaatggaagatatcaggaacttgatatattaaaggtttattaaaattaaaagtatgattaaaattagttgtttctcaagaagtcactgtttagaaataaatttctctggaagtcacctttcagaaaaccaggaatccaatttcctttataataagcaatggaagattcaatatcatggtatctgcacaaggaggagattgaaaatgagcaagagctatgcactggtccataagtggtaccatcaatatgctcacattttttttaagatttaatgaagtacaccaaaactaacatgatgggaagttgcaaaatacagtctgtttattcaggcaaaataagtagaagacagggccttctaaggataatagctgaagtcaatcaaacagaaagcatataaacaaaaatcacttcaaagtagtttttgaaaaaaatcaataatattaataatactaactttagccagatgaagcagtaaaatgatagaagacacaaattattactatcagaaaaaaagtagataatacagcagatcttacatgcattagaagtataaggggctattataaacaaatgtttaacaataaatcaaaaaatttagatgacgttggcaaattccttgaaaaccccagtatccaaaaactaatataaaatgatgcagaaaacctgaattgcagtatatatggaataccaaccggtatttgtattaaacccaagtactgccaattttaaagtatctctttaagaaaactacagagaaatatttttctcctctatgatgcctgaattatcctgatgccaaaataagacaaatatattgaaagaaaataaacagaagatgaatacatgtcataaatatcaatggaaaaattcttaacaaacattagcaaataaaatttagcaatatatttagaatgaattgtaatgatttattagagattatagcaagagtgaaaaattctgtatcaaaaaatcaaaaaaatttgaacatgtggatatgcacatataaagccttagaaaatttacaaaaaatttgctagaacaagtgaagactttaggttgtggaatacaaagtcaataaacaaaaaaacttgcatttctataaactgaaagatcataagaagatggaacaaattactatttttaatagtttataaatacaaaatactttgagcaagatttggacactgaaaattttgaactaatgctaatagaaattgaaaaaattaaaaacgaacagagatatgtcagttcatggattcagagacagtattcattaagatgtcaattacctggaaagtaatctagagatagaataaaattctaaacaaattcccttatgtttctcttaaattaatgagatgtttctaaaagttatattaaaatgtaaaatatctagaattatctaaaggaatccttaaaacttaagaataaataaatttagatgacatacactacattattgcaagtttaaatataatataaatatagcatataaatataaatacagcaatcaagaaagtgtaataccagcctaaggatacatacagatcagtgagacaaaatagaggatatagacatagacccacaaatgtgtacatgttgactttcaacaaagatgccgagttaactcagtaggggaaagcctcatcttatgcacaaatggttctagtgaaattggataaccatactaaaaaaaatgagcctcagtctgtatatcataccataaataattaaaaatggagcaagaatcatttagtaatacaaatcctaaaactctaaaatctctagaagaaaacaggataaaatcttcacaatagacctgatacagcataaaaataactatatctttaaaaaacagtcaaatggacttcatcaaaatttgaaatttgaaatgtcaggggatgaaatatctgtacttcaaaaggatacattgttaaaattaaaataaaagttatatttccgtgtgtgtgtgtgtatgtattggtttggttacatggatgtgtaactttggcaaaattcatttaacagtactttgtaaatgggtgcttttattatatgtaaattacataccaataagcttcactttaaaaattaatatgtaagaatgatgttttcaggcaagcaaatatgagaaaatgtgttgccagttaacctgtacgaagtaaattactaaaggtaattttatcaagcagaagaaaaattatcccggaccaattaaaatattggaggaaatgaagggaactgaacaatttaaaaatgtggatgtggaaaagcaaataaacacaaatgatacacaattataataataatgctttgggattataaaatatcaaaatataaaacattctgaaaaccaaaaagcaaaacagtggatatgaggaattggtgctaaagtgttctaaagttctagcaacattcaaaaattagtagaagttacagtccataaaagttttattttatttattttattttattttattttttatttttttgtttgaatggagtctcactgtatttcccaggctggagtacaatggtgagatctcggctcactgcaacctctgcctcctgggttcaagcaattttcctgcttcagcttcccaagtagctgggattacaggtgcttgccaccatgcttggctattttttttttttttttttttgtatttttagtagagaaggggtttcaccatgttggtcaggctggtctggaactcccgagcacaggtgatccacccactttggcctcccaaagtggtgggattacaggtgtgagccaccatgtctggccaaaagtgttcacttctagaacagtctacaatgttgtaatcattggggttttcactaaaaataatatgaaagcaattaagaatgtataattagcaagtgagtggatgggcaaaggagaataatgaaaactgaaaaaaatcaagggaagataagtaaatcttaaaaaaaaaacccacataaaagcagtgggtcaaatagaaaacaaatagctttatgatataaacccagatatagtgatgattaaattcatgtaaatatactaaaatgtttttacttggtggcacacatgagggtacagaatggttgaaagaaaaagggtaaagaatgtatttcctaaaacactaacctaaaggaagtttctgtagctatattcctttcagaaattagtgtagtaataatgtagtagtagactacaagcaaaataaaataaaataaagcattataggaaatgaaattttttataataaaaacagctaatcctaaatatgtatgctgtcaataatatatacattaaaaataatgtagaaagtagaaataagcaaatccacaatagtcggaaaatttaatatatctctctaattagctggtagaacatagtaaaagtaccataaacaaaataaaaactcaataggagcatgatacttataaaacataacaggcaaaaagcaaaccttcctaatatatacagagttcttaccaatcaataatgaaagaaccatttgcccagtggaaaaaaatggtcaaagatatgaacacacagttcagagtgaagcaactacaaactgcactcagaaaaactctcaaaataaacatgtctagtggcaaagatttcagaatatttataatacactacgatgcaaaggtgtaaagaggtgcaagttgtcataaaatgctgagggggacgtaaatatgtaaaactctcaaggaaaacaaagtggtgaattctatcaaaattctaaatgtacatactcttaaattctgctcctcagaatttagcatactgatatgttagtgctcttgaaaaatgattcatctgcatacagggttacttataacagcattgtctgaaatgcaaaacactaaagcttatctaaatgattaccaatgtgaaactacatatataatgtttgcatatatatcatatataatatacatatacattttatattcatacactaacagattaattatatataaatacctgtaaatatttatatacacttatatataaatatctagaaataccttacccaaaatacctaataattatgccagaataaaagatcttagtaataggattaggagagagatttttcatttgccttttaggtaatagggtgtgaggggaacatttcattgttcccatttttacttgttgtgaaggtcaaataatttggatacaaacattccagaggaaaaaaactgaggtggaactcatttcactgaattgattattccattaatgtgccacgtgtttaagttaaaaaattggattggaatgaaaaactgcttagttaataatattattttactgaggcagtgatattgtatctcttcaaattctgtttcagaagaaaaacagatatagatgtagtgccatctaagtcaatcaaaaaatatctgaagctaggagctatctacaccacgaaattctggccaataaatatctgcattaagcagctttattgaaacaaaaactgttttttctagccactctaatgtcactctcatcatcatgtttgtttcagtaggttctaacaaactatatgtgttaagcccaacctatttatgcaatctgagcttcccacaggattcacactctctgctatctcatatccaacctaccctatttattaagtcatcagcatggattttgtaggcagttgaattttaagaatacctgttccaaagcattaaggataagagagggatctcgaaggaagtcaatcagtgtgatggcttataactcagttaatctttacattaatcaagtttaagcctgaaaacaagtactttaagcaactttattaaattagactaaaattacatttccttatgtgtgaaccaatatgtaatttcttagatagttttgaaaatactttctaaacctaacattagagattgaaatagtaatcagaaataattatttaactatgcaaaacacaggcactggataccatatgtataatacaaagacaaagaagctgtaaacatgttttcagcaaataacataatcttatgtttggtacctttaatatggacagttgtcatataattagataagaggaatattaaattccagttccagaggggaaatatacatgcttaaaaatcagaaaatgtataattaaaagactcactaaaataacagaaaaaatgtcaaccattcccatacaaattaactgagattataacctggcaatacttactactggttaaagtgggaggaggtgaatgtgaaaatggtactctttgtctcagtcatcaaaaagtgatgggcacaaggtcctaagtcatctgttcccattgccgattctttttctattttacattgtctcctttcactctcctcattactcactttgcatcaacctgcttgacctctgtctccttgaacaggcacaaatacctgtagatctttaactattcttctttcttctgtctaaatttatttgccctatggattgctcaccagattcatacatgaagctcatattagaaatagtttccttaaccatcaaatattaaaacgctcacccatataaagtctgttcccatatttgacatatatttttatgtatttgttggtttgctttttgactgtcttccccaccttaatattcatgaatatcgatgtgtgcatatgtgtgtgtgtgtgtgtgtgtgtgtgtgtgtgtgtgtgttttcattactgcaggttccaagaacaatccgtggcacaaactgttttgtaaatatatgttgaatgaatcaatgctccctcaacttggcaatctgtcctaaaaagtgattaaaatgtagccaaatatatattaaaaaagaatattcattgcaatattttcagtcataatgaattattgaaatgacccaacatcctataatgtacaaatttttagtcaacttttaacatagaaacatgaacacatattatacacagtgaggtgttttaataatgttggaaaatatgcatcatataatgttacctatattgtacaaaagtatgactgcaattgcaaaagtaaacaagaaaataaatggggaagaaatccgtaaaaattatgaatagaatcatggagaaattgatgccaagtttttctttaaactcttctaattaaaaaatgtttaaaaagtaattattactaagcaaataccattaatgaaagtagtctgaggattaaaaaaatgagttttttttgttttctttttttgagaaaatgaaaatgatcaagtcacttgacaaaatccctacaagcttcaattttctatacccttttggaattattttatgaccatagactttattttttacgccaaatgcacaacacataaatttgttcttttagttatgagagaaacaaagctctaaactgtggatggaagagcctaattctagcacccccagtagaaataagaacactgtcatgccaaactttatcgagtaattaaatagaagtcttaggatctttaaatcactgtatctccatgtgtttgcagtagacgtctaattcataagatgacttactagaaacattttcaaaacatcatataccaaatactgtttatgtctcatgtatgtatgtgcatgtctcacgtatgagtgtgcatgtatgtctcatgtatgcgtgtacacatacacacacaattacatatctgaagttaagaaagttcttccacttcatttaaaatggtgtaaccactatggaaaacagtatggagtccgctcaaaaagttaaaaatagaactaccatataatccgacaatctcatttctgggtgtacataaaaaaattgaaatcagaatttcaaagagacatgttcactctcatgtttgttgcagcattattcatagccaatatatggaaacaaatccaatgtgcattgacagattaatgggtaaagaagatgtatataaatacatttacataaatgcagagaaatacatggactattattcagcctttaataataggaaatcctaccatgtactacaatatggacagacctgaaaaactaatgtgttacatatactaagttagtaacagataaatactgcatgattccacttatatgaggtattaaaaataatgaagtaggaaatagaatgatgtatgccaggatctggggagagggggaaacagggaattgttgttcagtgggtataaagttaccattatacaggatggagaagttctagagagaggctgtacaacatagtgcctacagttaatatggtattgtgcgtgtaaacatttttgaagagagtagatctctaaattaagccatccttgcattgctataaagagatacctgagactaggtaatttataagaaaagaggtttaattagatgacagttctgcaggctgtacaggaagtagaatgcttgcatatgcttctcagggaggctctgggagtttttacgcaaggcagaaggtgaagcaggaacttgtgcaccacatggcaaaagcgggaacgagagagagagagagagagagagaaattggtggagagagggatcacatacttttaaatgatcagatcttgtgagaacccagagaactcacttatcaccaagaagatggcccaagccatctgcccccgtgattcaaaaccttccaccaggctccacctccgacatgggggattacaattcaacatgagatttgggcagggataaatacctaaactacatcattctgctcctggcccctcccaaatctcctgtctttctcacattgcaaaatacaattatgccttcccaatagtttcccaaattccaactaattccaacattaactcagaagttcaaaggctcatctgggaaaaggcaagtcccttccacctaggaacctgtaaaaagaaaaccaagttatttacttccaagatgcaatggggatacaacattggataaatattctcattccaaaaaaaagaaatcagccaaacaaaaggtactacaggtcccatgcaagttcaaaacccaacaggcagtcattaaatcttaaagctccaaaataatttcctttggctccatgtcccacatccagtgtacactgtcactaggggtggactcccaaggctatggcagctccacccttgcgtctttgcagggttcagcatcaatggctgctctcacaggttgttgaatgcttacagcttgtccaggtgcaaggtgcaagctgccagtgaatctatcaggaggccagtggcctccttctcacagctccactaggcaaaaccatgttggggctcttcatggggactccaattccacatttttcctcttcactgccctagtagaggttctctgttagggttctgcccttgccgcaggcttctgcctgagcacccagactttcctctacatcctctgaaattcaggcagagggcctcccaagcctcattcacttttgcattttgtatgcctacgagcttaacaccacatggaagccacctccttttttttaaaggaggaaactcacatttaccgaggcaatcagtgagcagtgtactacagcttttccttcctgtatattttccataaaaactattttaattgctatttaatatggtttggatttgtggccatgcccaaatctcatgttgaattctaatacccatagttggaggaggggcctgatgggaggtgtttggatcacggggaatgaacatcccccttgctgttgctgtgatagtgagtgacttgagatctcgttgcttaaaagtgtgtagcatctcctgcttctccctcttcctcttgctccagccctgtaagaggtaccactttcctctttgccttctgccatgattgtaagtttcctaagatctccccggccatgcttcttgtggagccatgagccaattaatcctcttctctttataaatgacccagtctcaggtaattaattatagcaatgtgagaagggactaatacgttattatttttgacagataaaatttgcatatatgaatggagtacaatgtgatgttttgatatatgtaaacaatggaataattaaatcaaattaattaacatatctatcacctcactttaaaacagacaagagaataattactattacctggaattttatgatttttaaaactgttaattgtttgtgtaaagatcttggtgcagtgtccaaaagtagcattatatatgttttcttcttaatgtttatgtttaactcagtctttttactaaattgcttattctttcaggtttttcctaacttctcttcatcatggctaatcatggctaatatataaattatgatggtgtttacttgttcttggcgtgatggggctctggggtctatgttggtccttgcatgtgcacttcctctcatcctctgacttatggtcaattggtcacctgtgggctcactcatgcagttggtggcctcttggtaccatatgtatctctgaagcacatctgctgtgtgacagtagcctaggctgacctcactgcagcctctgtcacattcttgccacccagtgcccatcatccatacttccaaaagggagagaataaaatttattttattttattttattttattttatttttttgagacggagtctcactctgttgcccaggctggagtgcagtggtgcgatcttgcctcactgcaagctctgcctcccgggttcacgccattcttctacctcagcctcccaagtagctgggactacaggcacccgccaccatgcccagctaattttttgtatttttagtagagacagggtttcaccgtgttagccaggatggtctcgatctcctgacctcgtgatccaccctcccaggcctcccaaagtgctgggattacaggcgtgagccaccacgcctggcctaaaatttattttgaatttgctattccttttacccacacaattcaggaaatacttgaccacatttgtggagctctggagcagggagattggaacacacatttctaccagtcttcctttacatcccataatgtagtggttcagaagaggtttttttccttactttctactctgtggcctctccactttatctaaagcttaatggttgggatgtgacagggtgtgaagagagagaagctgtcctactaacaaatattacacaataagaaataatgatggacacaatatatctattgttcttatgttcatatcatataaagccactgctcactcctcctttaccctgcccagctgaagttgatatgtatcagcccttttccacgtcttaatgaaattctctattcacaccatgcctcagtttatcctcctaacattgaaaattttatgtataagttatattatggaaaatagaacgtccattcaaatgtcagttatcaatgtttaaatcaaatgtctcccattttcaatgaagatttttgtatctaccttttgaaaataaggatgtacttaaaattctggtcaaacagcaaaattcacatttctggctctgtattaaattgcatgtctcattaggcagtaacttccttgacagtacttttcaccttaagtcctgcattttcagttccttacatagtcacagatgcatagcacatatttttaaaatgccaaatgaatgtttgtttaatgaattgatagtagctaattcatattcttgaatttagtaaaaaccttttttccacagcaaataattgttggatgaataaattttgttaatacatttagaggaattgtcattgtgttcaaaaaataaccatggagagtgaaaaggcagccactagaattgtttggcatttgtcccctgataaaaagggaccaaatcaacaagtaaacaactataatttgactggagtgactgaagatgtatgctggagaggaccaggaaaacacaaaagtttgtggaggttgtaagcccagaatagcactatacagaagggggcaagccatcctgcctctgccacattgttttccccaacaggatcagctcagagtcaggggagtcatcttacaggataaaggtgagctggcggccctgtgagatccccatcaccccgtagatgtcagcagtttttgctacagaggatcccctagttctcacaggtcttgaattcaacatggacagttcctgggagtttgccagttgttttgcctgagagaagtaactcccttgacacacccacctcacccctccaacataagctgctatggcccagtgccaactgcagtagattttgccctgggagccagtacccactgatgccctctatctctgagaccccactgtcagcccaatacattcatgcaggtgcccgcagcaccaacaccctggctgcctagagcctagacatgaaacgaggaccaaaatcccaaatctgaatccatgaagaacctgatttaccaggaaaataggtgggtctgcacaatggagaaggcttgtgtgacctcccgctcagcatgtgccagccacttgaaggacagcaaacccagaggtggccaccataccctctttacccacctggtatgcatactcacactcaatccaacatccagcctgacagcagcaccttcttggagagcctgccacacaagctgctggcttgctgcatccacatgcacctggcctgaaaaacaacctggtgccccttcccctagaaaatctacaccattgccgtcataaacttccacagcttatgccaccaaaacaattgcagacattgcagatctggattacagctaaagcatctgtatggaaaccacgttacctcatctacctagaatcaaagccaatacaacattcccaacaattaaccaaatggcagaagtagatattcacatataaataactttgtaaatgcattaaattctccaattaaaggatacaaattcactgcagagatttaaaaaataagactcaaccaaattctgtctacaggagacataatccattgttaaaaaaaatgtagagtgaaaatgaaaggatgaaaaatatattccatacagatggaaaccacaagaaagcaggagtagccatactttgataaaatatactaaaattcaaacagaataaaaagagagaaaattgtaaaaatatatgcatccagccctggaagactcaaatagataaagcaaatatttgatataaaggaagagaaaaattgcaatcaacactcctctttcaacaatggtcagatcacctatacagaaaatcaacaaaaaacccactgaatttgaactaaaccttagaccagaaggacctagcagacatttagagaacaatccatccaacaggagcagaatacacattcttcctgactacacatggaacattctccaggatacatcatatgttaggccacaacataagtcttaagaaatttaacaaaacagagatcatattaagtgtcttttcagaccacagtggtatataactagaaatcaacaataggagaactttggaaagcttacgaatacaaggaaaagaaaaatattcttaaataaacaatgaatcaatgaaaagttaaaagggaaatttaaaaaacttttgagacaaaagaaaatggaaacataccataccaaatcctatgggacacagcaaaagcatttctaagaaagaagtttataataatatatgcctacatcaataaagaaaaagctatctcataaataacctaatcatgtacctcaaggaacaaactgaaccccaaattcttagaaaaggggaaataatgcagctcatagaagaaatgagtaatgtaaatactaaaacaattcaaaagatcaataaaacaaagggttggtcttttggaaagataaaattaacaaacctttagccaggctaagtgaaaataaaaagtcccacacaaataaaatcagagaagtaaaaggaattattaaactgatatcacagaaatacaaatgatcatgagactattttaaacaactctatatcaacaaatttgagaacacagaaaaaacagataaattctggacacatacaacctatcaagattaaattatgaagaaacaaaatctgaccagagtaatataacaagtgagaaaattgaattagtaataaaaagtattcttggctgactctcttttcggactcagcccgcctgcacccaggtgaaataaacagccatgttgctcacacaaagcctgtttggtggtctcttcacagggacacgcatgaaatttggtgccgtgactcggatcgggggacctcccttgggagatcaatcccccgtcctcctgctctttgctccatgagaaagatccacctacgacctcaggtcctcagaccgaccagcccaagaaacatctcaccaatttcaaatccggtaagtggcctctactcttctccaacctccctcactatccctcaacctctttctcctttcaatcttggcgccacacttcaatctctcccttctcttaatttcaattcctttcattttctggtagagacaaaagagacatgttttatccgtgaacccaaaactctggcgccggtcacggactgggaaggcagccttcccttggtgtttaatcattgcagggacgcctctctgattatatactcacgtttcaagggtgtcagaccacgcagggacgcctgccttggtccttcaccctcagcggcaagtcctactttcctggggtaggggcaagtacccctcaaccccttctccttcaccctcagcggcaagtcccgctttcctggggtaggggcaagtacccctcaaccccttctccttcatccttagcagcaagtcccgctttcctagggggcaagaaccccccaatcacttatttccacaccccaacctcttatctctgtgccccaatcccttatttccgcaccctgacctcttatttccatgccccaaccccttctctgcttttctggagggcaagaaccccccaccccttctctgtgtcactactcttttctctgggcttgcctccttcactatgggtaagcttccaccttccattcctccttcttctcccttagcctgtgttctcaaaaacttaaaacctcttcaactcacacctgacctaaaacctaaattccttactttcttctgcaatgccgcttgactccaatacaagcttgacagtagttccaaatagccagaaaacggcactttcaatttttccatcctacaagatctaaataattcttgtcgtaaaatgggcaaatggtctgaggtacctgaagtccaggcattcctttacacatcagtcccttcctagtctctgtgcccagtgcaactcgtcccaaatctttcttctttccctcccgcctgtcccctcagtcccaaccccaagtgtcgctgagtctttctgatcttccttttctacagacccatctgacctctcccctcctcgccagcccaagctaggtcccaattcttcctcagcctctgctcctgcaccctgtaatctttttatcgcctcccctcctcacacctggtcgggcttacagtttcgttccgtgactagccctcccccacctgcccagcaatttactcttaaaaaggtggctggagccaaaggcatagtcaaggttaatgctcctttttctttatcccaaatcagatagcgtttaggctctttttcatcaaatataaccctgagacgcttcacagccctaggccctaaaaggtcaaaaggcaatattattctcaatatacattttattacccaatctgctcccgacattaaataaaactccaaaaattaaattccggccctcaaaccccacaacagaatttaattaacctcaccttcaaggtgtacaataatagaaaaagttgcaattccttgcctccactgcgagacaaaccccagccacatctccagcacacaagaacttccaaacgcctgaaccgcagcggccaggcattcctccagaacctccttccccaggagcttgctacaagtgccagaaatctgaccaccaggccaaggaatgcatgcagcccaggattcctcctaagccgtgtcccatctgtgcgggaccccactggaaattggactgttcaactcacctggcagccactcccagagcccctggaactctggcccaaggctctctgactgactccttctcggcttagcggctgaagactgatgctgcccgatcgcctcggaagccccgtagaccatcacggacgccgagcttccggtaactctcacagtggaaggtaagcccgtccccttcttaatcaatacggaggctacccgctccacattaccttctttccaagggcctgtttcccttgcctccataactgtgggtattgacagccaggcttctaaacctcttaaaactccccactctggtgccaacttggacaacactcttttatgcactcttttttagttattcccacctgcccagtttccttattaggccgagatattttaaccaaattatctgcttccctgactattcctggactacagccgcatctcattgccgaccttctccccaactcaaagcctcctttgcgtcttcttcttatatccccccaccttaacccacaagtatgggacatctctactccttccgtcacccttaccccgctcaacgccaatatcccatcccacagcatgctttaaaagtattaaagcctgttatcactcgcctgctacagcatgggcttctaaaacctataaactctccttacaattcccccattttacctgtccaaaaaccagataagtcttacagattagttcaggatctgcgtcttatcaaccaaattgttttgcctatccaccctgtggtgcccaacccgtacactcttttgtcctcaatacgttcctccacaactcactattctgttctccatcttaaagatgcttttttcactattcccctgcacccctcgtcccagcctctctttgctttcacttagactgaccctgacaccccattaggctcagcaaattacctgggctgtactgctgcaaagcttcacagacagcccccattacttcagtcaagcccagatttcttcctcatctgttacctatctcggcgtaattctcgtaaaagcacacgtgctttccctgccaatcgtgtccgactgatctctcaaaccccagcaccttctacaaaacaacaactcttttccttcctaggcatggttagcgtggtcggaattcttacacaagagccaggaccacaccctgtagcctttttgtccaaacaacttgaccttactgttttagcctagccctcatgtctgcgtgcagcagctgctgctgctttaatacttttagaggccctcaaaatcacaaactttatcagtcctccaggcccaagttgactctttagctgcagttgtcctccaaaaccgccgaggccttgacttacttactgctgaaaaaggaggactctgcatattcttaaatgaggagtgttgtttttacctaaatcagtctggcctggtgtatgacaacataaaaaaactcaaggatagagcccaaaaacttgccaaccaagcaagtaattacgctgaacccccttgggcactctctaattggatgtcctgggtcctcccaattcttagtcctttaatacccatttttctcctccttttattcagaccttgtatcttccgtttagcttctcagttcatccaaaactgtatccaggccatcaccaatcattctatatgacaaatgtttcttctaacatccccacaatatcatcccttaccacaagacttcccttcagcttaatctctcccactttatgttcccacgccgccctaatcccacttgaagcagccctgagaaacatcgcccattctctctccataccaccccccaaaaattttcgccgctccaacacttcaacactattttgttttatttgtcttattaatataagaaggcaggaatgtcaggcctctgagcccaggccaggccatcgcatcccctgagacttgcacgtatacatccagatggcctgaagtaactgaagatccataaaagaagtaaaaacagccttaactgatgacattccaccattgtgatttgttcctgccccaccctaactgatcaatgtactttgtaatatcccccactcttaagaaggtactttgtagtctcccccacccttaagaaggttctttgtaattctccccacccttgagaatgtactttgtgagatccacccctgcccaccagagaacaaccccctttgactgtaattttccattaccttcccaaatcctataaaatggccccaccccatctcccttcgctgactctcttttcggactcagtccgcctgcacccaggtgaaataaacagccatgttgctcacaaaaaaaaaaaaaaaaaaaaaaactattctttcagaaaaacaaaaaaaaaagagcctaggatctgattatttcactcctgccttctatcatacatttaaggaaaacctaataccattcaaactacttcagaaaattgaagagaaggagatattttcaaaccaattttatgacgccagcattacctttatttcaaaatcagacaggaacacaacaaaaaaaggaaactactggccaatatttctgataaacctagatacaaaacatctcaacaatatactagcaaaccaaataaaacagcacattacaaagatcattcattatgatcaagtgaaattcatccctgagatgcaagcatagttcaacatgtgcaaattaataaacatgttatactacattaacaataaaagtcaaacaaatcgtcacttcaacagacacaggaaaagtatttggcaaaattcaacattcctctgaaaaaattagttatagaaagaatgtacctcaatataataaagaccatgtctgacagaaccacagctaacatcacacgaaatgaggaaaaactgaatttaccctaacatcaggaacaagacatgtattctcatttttgccatttttattcaacacagtgctggaagtcttagccagaaaacctggacaagagaaagaaataaaaggtatccaaattggataggaggaagtcacaatgtttctgtttgcagtgacatgattgcacatacagacaactctaaagaacagttccccaaaagaactgctataactaatacacaaattcagtaaagaagcagaacacaaaatccgcatgcacaaattagtagcattaaaaacaactatttttaatttttgtgtgtacatagtaggtgtatacatttgtggtgtacatgagatgatttgatacaagcatgcaatgcattgtaatcacatcatgaaaatagggtatctatgtcccaaagaatttatcctttgtgttacaaataatctaattatactatttttagttactttaaactgaacaattaaattatcattgactatagtagcatttttatatcctcatagtgaactatctgaaaaaataaaaaaattctatatccaatagtcacaaaacaaaaaaagatacctatgaataaacatgaccaagtagatgaaagagatctacactaaaagccataaaatattaagcgaaaaaaaattgaaggaataaataaatgaaaagatagcccatttgcatggattggaagaattaatattgttaaaattaccatattactaatcttcaaatttaatgcaaatcctattataataccaatgacattcttttagaaatataaaaaaatcttaaaattcagttatagtaataaaagacgcatgatactggcataaaaacggacacacagaccaatggaacagaatagagagcttggaagtaaattcatacaccaacagccatctgatatttgacaaaggtatcaagaaaactcaatgaggaaaagacagtcttttcaataaatgttggtacggaaactggatatctacatgcataagaataagactagacctctacctctcaccatatacaaaactaaattcaaaatggattacagacttaaatgtaaaacctgaaactatgaaactgccataagtaaacataggtgaaatgctttatgacattgggctgggctagtgtttttaaaataagacctcaaaagcataagcaacaaaagcaaaaatagacaaatagaattacatcaaactaaaaagcgttcgcatagcaaaagaaacaacacattgaagaaacaaccttcagaatgggagaaaacattctaaactatacatctggcaaagggttaatatctagaatatgtaagaaactcaagcaactcagcagcataaaacacaaataacctgattttaaaaatgagcaaaataccttgagacatttctcagaagacatacagtggccaacaggtacatgaataaatactcaacatcgctagtcagcagggaaatgcaaatcaaaaccacaataagataccactgaactcttttttgaatggctattatcaataagacaaaagaaaacaagtgttggtgaggatgtggaaaaaagggaacacttaaacactgtcagtgacgtcttaaattagtacagccactatggaaaactgtatgaagcttccttaagtcattaaagatagaactataatttgatctagcgatctcactaccagatatatatttaatgaaataaaattactatatcgatgttatctgcactcccatgtctactgcagcactattttcaatagcccaagtgtcttacaacagataaatgaataaagaacatgtggtgtgcgtgtgtgtgtatatgtatgtctcatttctttatatacatatagtttgtacacacacacacaatgtgtatgtgtacactatgtatatgtatacacaatggtatactatttagccataaaaaatgaaatcctagaatttgtgacaacacagatgtatttggagaatgttatattaagtgaaaagccagacatagaaacacaaatactgcaggatctcattcattgtttggaatctaaaactcaaaagagttggtattatagaagtggatagcagaatagtggtggtcattgggtgcaaagttacaattagatagaatgaacaagatctggtgttctactgcacagtaatgtgatgatgtttagcagtaaggtatgagtattataaagtagccagaaaagaggcttttaaatgttcttaccagaaataaataataaatgtatgcagtgatgaatttactgactactctgatttgctcatcatagatatgatcaacataaacatgtttcctcaaattgtatcacataaatatgtacaattacggtgtgtcaatataaataaataaatgattaaataaataaacagcatcacaggtcatgatgacatggatttgtgtatgaacacatagtagaaatttgggattaataatactcacatgatttattggaaataagcatgtaaagatggcggtattagtcagggttctctagcgagataaaactaataggatagacaaatataaaggggagtttattaaggagtattgactcacatgattaaatttgaggtcccacaataggctgtctgcaagctgaggagtaaggaagccagtctgagtcctaaagctgaagaacttggagtcccatgctcgagggcaggaagcagccagcacaggagaaagatgtaggccagaagactaaacctgtctagtcctttcatgttcttctgcctgcttttattctggctgtgctggcagctgattagatgatgcccacccagattgagggtgggtctgcctttcccactccactgactcaaatgttaatctcctttggcaacaaacaccctcacagacactcccaggaataataatttgcatccttcaattcaatccagctgacactcaatattagccatcacaatgccctttctatttttagaatttggggaacgtaaaatatcaagcactgtagcccccttttctttgggctttacttattgcaaaacagttcccattgcaaatgacactgatatacaagtatttttatgagattcatttcctcatacttggcaattatcaattatctttggaggataaagaaaacacttatagcttgacaagtcatgtgtaccatttcagaaatttcccttaaattgatagaacaagtaaataacatgtacaccatcagatttaaagttctctgacaaaaaaaaaaaaaatgatgaaaggagtttgctcctgtttccatatcaaggattgttttaaaagtgtttcttaagaagaatagaaaaatttatggccttaaatttttagaatcttgagaatttactgagcctcagccatcagttttatatcttatagaagtagttgttcatattttttaaatggatcaaatcactttgaagaaactcaaaccattctactggtgcaactaaagctaacagcgatggtcgaggtcactggaaattgaaaaatgcaagtccaaaagaggaaacagtgacaaaaagctatcacctatttgtgacattagagtgaagctgaaaagggcattaaagggaaacatattctattgttattttaaaatatatttagtattttataattccaaatggatacatataaaaatacatgtttttcaagctcaaccacagcatggaaaagataaatttaatagataaagtcatctgatatgtcagaaacacaaatagttttagaaaattgaaggagtagcaaaataaagacccataatagaagggcatccatgaagtatatgatatggagagaaatccattccactgactttccagttttgttctttatcaggcttatcctcaggcttaccttggtataatacagtatatctttctcagtatagcccatagttaagaatacaaagaggtaaatcagaagctgtaaaaacatactgtgttggtacaaagggagagatgtcagtaatttcatcacctaacataaaggataaaaggtgcttacatcctgataaaagacaaatatttagggaactgaaattgtccatttcaaaccattagatctgaaaccagtttacttataaactttacctataaattttgtgtcagtatggctagaacaacacacaaaacctagtgtgtggtctgtcagccaatatactatgatttaggaaatgtaaagagagaaaaatgatctattgacaaaagtatatcactatatacacagacaaatttgtataattacaatgcaaattttatgcttttatttatttgcctaagcaacagattttctctcactcactaagtgtactttcctttagacatcttatatattttgtcatgaaagggtgataatataaaaatgcaatgccgctagtaatttattcaaatggtagaccatttattttaggtttgtctgaacattttaacctatctttttcttaatacaacataatattgaatatattatataagaatacactactggctgggtgtggtgtctcacgactgtaatccaaacactttgggaggccaacgtgggccaatcaaaaggtcaggagttcgagaccagcctggccaacatgctgaaaccacatctttactaaaaatacaaaaaattggctgggcatggtggcgggtgcctataatcccagctagccgggaggctgaggcaggagaattgtttgaactcgggaggcagaggttgtggtgagccaagattgtgccactgtactccagtctgggcaacagtgcgagactctgtctcccctgccaaaaaaaaaaaaaaagaatacaccattaatagtaatatatattggcaaaattagtttatgcacacctctataacattttccgtgtgtgtctgtgtatgtgtgtgtgtgtgtgttagtgagtgagtcagagagagagaggtatactaatgttttcatgtcttaatggtttgtggcataatatgttatattcaagaaatgcaacagacaagtaaatgactaaagaagcatctggcactactaaaataccttggaaataataataatttcttcatttgggaaagtaattttaagctcatttatgtttatatattttgtatatatacatatatatagtgataacgtaatactaactatgagaaattttaagatgtagctgaccaggcttattcaccatttagttctatgtgtgtgcatttgcatcataccagtgcaatgatagagcataggttatgtaataagactctggagttccagtgtgaactttgccatacgttacctgtgtggagtgaattaccaaatctctctgtgccatagttttcttatctataaattgggttaataacagtgtctgtctcccagggttgctgtgaggatgaaatgagttgatatatgaaatgtgcttagatgattggtgcatatgttctattagctatagtagtaatgataaaaataattacatgtaatatattaattttaatgatagttattattgattttgtttaaaagataagctgattgataatttattttatcattaaatatatataattgctgtggaagaaccaactaaagttttctaatagtaagcacatatggaattccataggaacagtttttttattcaaaatgtcatattcatttgcttatttgccatcttcttttctcacttgaaactttatgatgacattatctccaggtcactaaagtatatagtagaatatatttagttaccctgttccttttcttggtctttctccataaatgaggttatctacaactgtagccttcattaccatctatagtttgatcatttccagaactacaaatgcagctaagaatatgactggatagatagatagatagatagatagatagatagatagatagatagatagatagatagatagacacatacgtacatacatactacataggtgatagatagatagatttatagatagatggctagatgattttgaaagtatctttaagctaatatgtcccaaattgaactgatcatcttccactcacaatgtgctcttcctatttgaccacaggtgtaaacggcatcatgtttctgccctgtcctggaactcagtcagtatttttgcctactcatctctcttgtggttcatgtccctcatcaggtcctcctggctctgcctcctgaagaagtttcaattatcccccttccctctacactgatgttgctgtaagttaggggatgttcacctcccacctgccttgctaaagaatcttataactatttttcttccatttataagattaaaaactactcatagatctgtgttttcttcaatataataatgactttaaaaatactgagtaattataatgtgataggcacctttaaattactttacatatctttttaattatcaggaaaaatctgatgagaaagataatgattgttttatcaatttatcgtgaaggaaactgagaaagaaaatttaagtaatagcactatttcacctagttagaaggtgctaggccaaataaaaattgcctaatcatacttagaaggccattatttatgcccttgattcacttcaatgtgttgctcagctaatgtgcttgcctctggcaagcctctcttgtccgcccaacactgggctaaatctcatagaattctcaacttcagaaaacacagtattcattcaaatttttagaatactcatagctattaattccatatctacttgtctccctattactataggctttgtgagagagaggactgggcatctgtgttcatgtttatcattgcatgtgtctgtcacatgtcagggaggtcaattaacaatttttattaaaatagtgaaccacttgaggttacccatgtctcttcatggtggtttaccaaatttctagcatacttttctataagcataacacctatgtcatttaaaaactgagctattaaaacatagtaattgtacgcacacttgggaggtgtgggtgaatggaatgaggaaacaatgatctaacataaaagggttctgagtctctttgtatagatttcagggggatgaccgcttatcacaggcctgagattaattcatgggcataatctgttgttaccttcagtttctccttcaggcttttgttgttatcaggccagatttctgtatttgaaaacaggtatctttgctttgcaatagctttctctttttacctattcagaattgtttagcccttaagcaaactttcacacacttattttattgccatatctgaaaagggaaatggctctctctgttattcctgggtgttaaccttttcagaataaaattgttagttgtgaagattttacacatgtatcttgatttgttaatgatggtttcatgcaacatgctctgtgggttaaaatgtatatatgtgtgagagtaatacatgacatattggaagaagtctatgctatttatactgagagaaaggaaaaaaagcatataaagctaatttgtgtcaagtgctggatatcagccgatgtgttttcatttgccctttagaaaaccctgtattgcaggtaagaaaattgtgacttagacaggaggtgctttatgtaagaccatgcatgcaggcagtaagaaaaattttaatgttcaacacatagtgataatatatgctatgaagaactgcaattatatgtaaggtctaatgttcacactcaaagacataaacattagttgagaagaaaaatgatattcattaaaatcaaaggcagcaatcagaagaggtaaattacaaaggttatagaagggagtgtcttagtccattagtacagctataacaaaatacttgtaactgggttctttatacaaaacagagatttatttctcagttctgtaggcttggaagttcaagatcaaggtgccagcaggtgatgtttggtaatggcttggtttccgtttccaagatgggaccttgttgctgcatcttctggatgggaggaactctgtgttctcacatgacagaagggcaaaaaggggtgaatactgtgtgaagccttatttttttttttagcttttaagttcagtagtacatgtgcgggtttgttacgtaagcaaacctgtattgtgggggttggttgtatagatgatttcatcacccaggtatcaagcctagtatccattagttatttttttctgatcctctccctcatcccatcttctaccttttgaaaagccccagtatgtatggttcacctctctctctccatgtgttctcatcatttggcacatacttataagtgagaacatgcagtatttggttttctgttcttgcattagtttgctaaggatgatggcctacagttccaaccatgttcctgcaaaggacatgatctcattcttttttatggctccacagtattctgtggcatacttgtaccacattttctttatccactttaccattgttgggcatttaggttgattccatatctttgctattgtgaatagtgatgaacatatgcatacatgtgtctttataatagaattatttatattccttgcaccattggtggaagagtaaattagttcagccattgtgaaagatagtgtggtgagtcctcaaaacctaaagacagaactaacatttgacccagcaatcccatcactgggtattgtagttcccataatccttatgtgttgagggagggacccagtgggaggtaatcgaatcatgagggcagttaccttcctgctgttctagtaatagtgagtgagttctcacaggatttgatggttttgtaagggaatttcccccacttcactctgcacttctccctcctactaccatgtgaagaaggacatgtttgcttccccttccaccatgattgtaactttcctgaggtctccccagccatgctgaactgtgaatcaattaaacctatttcctttataacttaccgagtcttgggtatgtctttattaacagcatgacaatggactaataaaggttgttttttcttgtaaatttgtttaaattccttatagatgctggatattagacctttgtcagatgcatagtttgcaaaatttttctcccattttgtaaaatgtctttttattctgttgatagtttcttttctgtgtagaagctctttcattcaactagatcccatttgtcaatttttgctttcactgcagttgcttttggcatctttgttatgaaatttttgccatgcctatgtcctgagtggtattgcctgattgtcttccagggtttttgtagttttgggttttgtatttaagtcttcaatcttgagttaatttttgtatatggtgtaaggaaaaggtccagtttaaatctgcataagactagccagttatcccaagaacatttattaaatagggaattcttccctcattgcttgtttttgtcaggtttgtcaaagatcaggtagtaataggtgtgcagccttatttctgagttctctattctgttccactggtctatgtgtctgttttgtaccagcactgtggtgttttggttactgtagccccatgctatagttcgaagtcaggtagcgtgatgcctccagctttgttctttttgtttaggattgccttgcctatttgggctcttttttggttccatatgaattttaaaatagttttctctagttctgtgaagaatgtcattaatagtttcataggaataacattaaatctctaaattgtttcaggcagtgtggccattttcatgatattaattcttcctatccattagaatggaatgtttttctatttgttattgtcatctctgatttctttgagcagcgatttgtagttctccttgaagaaatcattcaccttccttgttagctatattcctaggtaatttatactatttttggcaattgtgaatggtagtttgttcttgattttactctcagattaactgttctgtagaaatgcttgtgatttttgcacattgattttgtatcttgagacttgctgaaattatcagcttaacaagcttttgggctgagactatggggttttctagatattggatcatgtcatctgcaaacaggggtagtttgacttcctctcttcccatttggatgcactttatttctttgtcttgcctaattgccctagccagaacttccaatgttatgttgaataggagtggtgagagagggcgtctttgtcttgtgatggttttcaagggaaatgcttccagcttttgcccattcagtatgatgttggctgtgggttttttacagatggttgttataattttgatggatgttccttcaataccttgtttactgagagtttttaagatgaatggatgttgaatttatcaaaagcccttttctgtatctattgatataatcctatggtttttgtctttaattctgtttgtgtgatgaaccatttggtatgctgaatgaaacttgcatcccagggatgaagcctacttgattgtggtgaataagctttttgatgtgctgttaggtttagtttgtcagtattttgttgaggattttcacatcgacattcatcaaaaatattggtctgaagtgttctattttttgttgtatctttgccaggtttggggattaggatgatcctggtctcatagaatgagttagggaggagtcccttttttgcaatttttttggaatagtttcagtagaaatgataccagctcttctttgtatttctggtagaattcagctgtgaatccatgtgatgctgggctttctttggtttgtaggctatttattactgcctcaataacaaaacttgttgttgatctgtttagggacccaatttctttctacttcagtcttgggagggtgtatttgtacaggaatttatccatttttctagcttttctagtttatgtgcataaaggtgttcataatctctgatgattgtctgtttttctgtgggagggtaatatctgccttgttgtttctgattgtgtttatttgaaccttctctcttttcttctttatttgtctaactagtggtctatcttattaacatttttcaaaaaaacagctcctagatttgttgatcttttgaatttttttttctacctttatctcctttagttcagctctgattttgtttatttcctatcttatgctagctttgggatttgtttactcttggttctctagttcttttagttgtaaagttgcgtgattaagttcagatttttctgattttttaatgtgtcatttagtgctataaatttccttcttaacactaccttagctgtgtcccagggattctggtacattgtatctttgttagtttcaaagaacttcttgatttctgcctcaatttcattatttacccaaaagtcattcaaaaacaggttattcaatttccatgtaattgtatgattttgagtgaattttttagtcttgatttcaaacttgtctgtattgtggtctgagagagtgtttcttattatttctgttcttttgcatttgctgcagagtgttttagcttcaattatatgatggattttggaataaaggccatgtagtgatcagaataatatatgttttgttgttttttgagtggcgaattctgtagatatccataagatcaatttgattcaatgctgagttcaggtcctgaatatctttgttaattggctgtctcaataatctgcctaatattgttagtgggatgttaaagtctcctattattactatgagggaatctaaatctctttgacggtctctataaacttcctttataaatctgcatgcacctgtattgggtgcatataaatttaagacagatcttcttgtagaagtaaaccctttaccattatgtaatggctttttttttgttgaagcctcctttataaaatcctaaattccactcactaaggctctgccttcataacttaatcaccttctaaagatcctgcctcttaatactgtcatattgactttaaatttcaacacatgatatttggaaagaatattattcaaaccatagcgaaagagaactttaaatgtaggtagtgaggaaactccttttcaaaaacaatagcgcctgaagtattcttagttgaaaacaatcaatgagtagattgtgattacttatctttattttaagaaaggcttgtagtgggactctaggaagcatgcttggaagtttgaggttttcttaactggacagtattttttttccttcagcttttattttaagttcctgggtacatgtgaagtacgtgcaggttcattatgtaggtaaatgtgtgccaagatggtttgctgcaaagatcagcccattgcctaggtattaagcccagcatccattaactattcttcctgatgctctccctcctccctcccacctcccttcaacaggcctcagtgtgtgttgctccccaaaatttttctacttgttatcattgttcagctcacacttataagtgagaacatgcagtttttggttttctgttcctgtattagttagctgaggataacagcttccatctctatccatgtccctgcaaagaacatgatcttcctcctttttatgtctgcatagtattccatgatgtacatgtactacattttctttacccagtctattattgatgggcatttgggttgattacatgtctttgcgattgtgaatagtggggcagtgaacaaacacgttcatggatctttataacagaattatttatattcctttgggtatatacccagtaatgagtttgctgggtaaaatggtatttctgattctagatctttgaggaattgtcacactgtcttccacagtagttgaactaaattacactcctaccagaaatgtaaaagcattcctttttctctgcaaattcaccagcatctgttgtttcttgactttttcataatcgtcattcaaactggagtgagatgacatctcattgtggttttgatttgcatttctctaatgatcagtgatgttgagctttttttttttttatgtttgctggttgcatgaacgtcttcttttgagaagggtctattcatgtcctttgcccattttttaatggagttgttttgttcttgtaaatttgtttaagttcctcgtagcctctggatattagacctttgtcagatagatagattgcaaaaatgttctcccaatctataggttgtctgttcaatcagatgatagtttattttgctgtgaagaagattttcagtttaattagatgccatttgtcaattttggctttcagtgttttcatcatgaaatctttgactgtgcctatgtcctgaaaggtattgcctagattttattctagggtttttatagtttgggtttttacatttaagtcttgaatctatcttgagttaacttttttataaggtgtaaagaaggggtccagcttcagttttctacatatggctagccagttctcccagcaccatttattaaatatggaattctttctccattgcttgtttttgtcaggtttgtaaaagatcaaatggttgtaggtttgcagtcttaactctgaattctctatgctgttgcatttgtctatgtgtctgtatttgtaccactaccatgctgtttgggttatggtagctttgtagtatagtttgaagccagatagcctaatgtctccagttttgttctttttgctcagcattgtcttggctagacaagctttttttccccatatgaatttaaaaatagtttttttctaattctgtgaaaaatataagtggtagtttaacagaaatagcattgaatctataaattgctttagggagtatggctaatttcatgatactgattcctcctattcatgagcgtggaatgtttttccattgtttgtgtcctctctgatttccttcagtagtgctttgtagttctccttgaagatgtccattaattcccttgttagctgtattcctaagtattttattctctttttagaaattgtgaatgggggttcattcatgatttggcttactgcttgcctgatgttggtgtatagaaatgctagcaattttgcacatgtattttgtaccctgagattttgttgaagttgcttatcagcttaagaagctttgagcatgagaaactttggggttttctagatataggatttgccacctgcaaaataaacaaacaaaaaaaatgatttcctctcttcctatttgaataccctttatttctttctcttgagtgattgccctggccagaacctccaatattatgttaaaaaagaggggtgacagagggcatccttgtcttgtgctggttttcaaagggaatatttccagcttttgcccattcagtgtgatactagctatgggtttatcatatatgaatcttattttgaggtacattccttcgatatctagtttattgagaatttttagcatgaagggatattgaattgtatcaaaagtcttttctgcatctattgagataataatgtggtttttgtcttacattcaattaatgtgttgaattacatatactgatttgcatatgttgaaccaactttgaatccttgggatgaatccaatttgatgttgttggataagctttttgatgggtgctagattctgtttgccagtgttttaatgaggatttttgcatcagtgttcttcagggatattggcctgaactgttcttttttgttgttgtatttctgccagattttggtgtcagaatgatggtggcctcataagataaggtaggaacgagtccctcctattccactgtttggaatagtttcagaaaaaaatggtaccagctcttctttatatctctggtggaattcagctgtaaatccatctggtcctgggcttttgtttttttgtgattggtaggtgatatgggtttagctgtgtccccacccaaaatctcatcttgaattgtagttcccattatacccacttgttgtaggaggaacctggtgggaagttattgaatcatggaggtggttttccccatgctgttctcatgatactgagtgagttctcacaagatgtgatgatttcataagcatctggcatttcccctgcttgcacttctccctcctgccaccttgtgaagaaggtggctgcttccccttgccttccaccttgattgtacattttctgaggcttccccagcaatgcagaactgtgggtcaattaacctattttctttacaaattacccagtctcaggtatttcttcatagcagcatgagaacagactaatacagcaggttatttattactgcctcaatttcagaacttcttattggtctactcaaggattcagtttcttcctggttcaatctttggagggaatatgagtccaggaatttatccatttcttctagattttctagtttatgtgcataggagtttttataatattctctgatggttttttttttatttttgtggggtcagtggtgatatcttccatataatgtctgattgcatctatttgattttctctcttctcatattagtctagctagcagtgtactttattatttgttttaaaaaaactcagctccttgatttattgatttttgaacggtttttgtgtcggtatctctatcacttctgctctgatcttggttatttcttgtcttttgctagctttgggttttgtttgctcttggttctctagttcctgtagttataatgttaggtggttaagtttaggtctccctaattttttgacgtgggcattaagtggttaaatttccctcttaatactgctttagctgtgttgcagagattctggtacattgtctgttctcattcgtttcaaaggacttttttatttctactttaatttgattatttatggaggcatcattcagggacaggctgttaaattttcatgtatttgtgtgttttgagagagtttcttaatctttagttctaatttaattgtgctttgtttgttttgatttcagtacttttgcatttgctgaggagtgttttacttcctactatgcaatcaattttagagtaagtgccatgtggtgatgagaagaatgtatattctgtcgtttttgggtggagtgttctgtagatatgtaacaggtccacttgatccagagctgagttcaagtcctgaatatctttgttaattttctgtctcaataatctacctaatattggcagtggggtgttaaagtcccccattattattgtgtggaagtctaagtctatttgtaggtatctaagaacttgctttgtgaatctgggtgctcctgtattgggtgcatatatatttaaaatagttagcttttttgttgtcattgaattaaacccttttccagtatgtaacggccttctttgtctttttaaatctttgttggtttaaagtctgttttgtcagaaactaggattgtaacccctggttcttttatgtttgccttttgcttggtaacttttcctccatccctttattttgagcctatgtgtatttttgcacatgagatgggtctcttgaagacagcataccattgagtcttgactctttattcaccttaccattctgtgtcttttaattggggctcttggcccattaacttttaaggtttattttgttatgtgtgaatttgatcctgtcatcatgatgttagctggtcatttttcacacttgtttatttggttgctttatggtatcactggtctgtgtacttcagtgtgtttttgctgaggctagtaacagctttttctttccatatttagtgcttccttcaggatctctttcaaggcaggccttgtggtgaagaatttcctcagcatttgcttgtcttaaaaatatcttcttcctccttcaattatgatgcctagtttggccagatatgaagtcctgggttggaagttctttttttaaaagaatgttgaatattgttcttcaatctcttctgccttgcagggtttctggtgagagatccactattagtctgaggggctcccctttgtaggttacctggtctttctctctggctgcccttaacatttttcctttcaatttcactttggataatttgatgataatatgtcttggggttgatctgctcatggagtatcttactggagttttctgaatttcctgaatttgaatgttggcctgtcttgctaggttgtgaaatttttcttgataatatcctgaaatacattttccaacttggttttattcttgtctctttcaggtactccaattagtaagaggttcagtcagatataaaaaatatgtgttcttttttttctatcacattgtcaggctgcttccacattctcaggtatcttacagcaatgtctcactaccttggtaccaatttattgttttaatccatctcacactgctataaagaaatacctgagactgggtaacttataaagaaaagaggtttaattgattcacagttcagcatggctgaggaggcctcaggaaacttacaatcatggtggaaggcatgtcttcacagggcggcaggacagagaatgagtgcaagtaggggaaatgtcagatacttataaaaccatcagatcttgtgagactcactcattactatgagaacagcatgggggaaatcattcccatgatccaagtatctctacctggtcctgcccttgacatgtggagattattataatttaaggtgagattatggtgaggacacggagccaatccatatcaagcaggcaccttctttacaggtggcaggaagaagaagtgcagacaggtcagaagaacctcttataaaaccatcagatcttgtgagaactcactcactgttatgagaacagcatggggaaagctgtctccaagattcaattacctacacctggttcccccttgacaaatggggatcatgcagattaaaattcaaggtgatagttgggtggggacaaaaagccaagtcatatcacccctaaaaaagtaacttgctaaaaggaccctttaaaaattatgtcatataaccctgtgggacactagctagttttgtatccaacctagaaaatttatcctaagatttattttttaacttgtatgtgcacgtgcacacacatatacatttgcctgagaatcatgattttgagcatttccaaattataatttaacatgaagtatggctgtttacaataatattaagtgaaagaaagcagaaggaaagaaatctaagaagctagaagaaaatttagtgattattagtttataagtgtggggaccaagcttatgagagattagataaaggaaaactacatactgaaatcagtctcttgtattccagagaagaatctcatttaacagttagtttcacagcttaactgttaagttcctgggcctataacgttcatttttttatctttcctctctgttctccacattgccagcaggattctgactgtgggtaccaatggtaggaaactgcaggattgggagagataatgggaaatatgcctctttcttttctaatgaactctttgacctttctgattgcaagtgtagattttccctggggattgcacctccaactccaactgaaccactgcctctgtctctctggcctaagtgtaaaagaggctctttttttttttttctcctagtgtctaggatgcttcattgtctccttagatctccaactattttattagctttgcaaataatcacctgcatgaatttaccatgattgtaaacaatactcaagtggggtaattttcttattggacattaatggtctatttgatttccattttattgagtaaagtcagattttttttcagggttattccaaccaacaaatctattgttgaattttgattggccttaaatattaaatgagaaaccagtgaacatatttgattttactggggcttgagagtgttagaacagatgacaatatgcagaaacttacagaataatgagatcaaatattggaattaacagacctgggataaaggagttggcaaagaaaagggaaagtaattaaaatgacaacaggtgaggtaaaaaggggatttttgtaggcaaatagaatttgatgcaaaattctgactaattaaatccttgcaagtataaacatattaattaaacttgtacacaaacaatttatttatttgctgtgtagaactagtactacctaaattctagttttttaaaaaattaatattatttgtaatgcacatagtacagcttttgatacatggtgtaggccaaaattttgggttagtatggtggttagtactgctgccactacaacaaatgctactgttatgtgtaatgcgaaatatattttgtagaagaatcagtagttttgataactaaatatataggagaaaaatgagagaaaagagtcaaatagtttcttgaaaaagttaaaccaactttattgggttaatcatggagctgattttagaaatagggaaaccacaagcaaataaagaacatatacttttatctggtaaaacatgatgtgacttaaaaaactatgtcttcattattatagcttctaggatatcacaattgaaatacaaaggggaggagtgtatgtttattatatttcctgtcttatttctcctccaaatcttttggtcaactagttacttctgaataaccagtgtgtcagaaagattgtagtgcagtttaagtagcatcacaaaactaaaagctggtaaggggagaataattaatgtaataaaagatgtgaaattatatcatataaacaaaagttgaagaatacaggagacatccagaatataaatctagaccagaatttctcaaattcagcatttttgacattatgggctaaataaactttatttgggggttggaggtagctttcctgtgcactaccggatgtgtagcagcattcctggactctacctactagatgccagtagtaacaccctccttcttcagtgtgacaagaaaatattagacatgttgttacctatgccataggtgtcagaattgcctctagttgaaaaccactggttatgttgacattttaaatatatttttcttaatatgtatttttctcgctaagaatctcatgttttagaagcagccactatttcttctgaaaactgttccttcttctccctccaccatctccattcgcttctccaactatggagtcctgagggacttgaaatttttaatatattatatcttattcttctcacttgattggttcagatatgtacatctgatccaaactggaccaatcctaacttttttttccttctggatccagttgacttttctgaaggttagcattttatttaaaataaactaataagatagtcaggagttttaaacttagcatgaataaataaaaaaaaaaaagtccagggcttcttaggaggtgagagtagagtgatgtctgtaccttaccataaattgttatttaaactgaagctaggtctcttatttcttctatctcataataattaaaatatgctattattttgtcataagatgtcctatataagctgccagtgaaaagactcatattgaataacttatgacactacaatcttattctaaaacatggtatttaattctgagtcatcgctgtaataaggcaagtttggttccataactgaaaaggtacttacatatgatttctaaagatggggttatctggacatatcattctaatagcagccaggaatgttggccaacattcttaatgtagataccatgttgtaaatccgatgagattaacaagtttggtaccataagcatgtggtagcctaaagacaaaggtcatcctgagaatttttaaattattgttgaaatgcatgtcacattttttttgaaaggtgacttctgatgtctgatggttgtcaaagtaaaaattgggctggataaacttaaacaagtgatatggttaggctttgtgtccctacccaaatctcatcttgaattgtagtttccataatccccacatgtgggaggaacctggtggagataattgaatcatgggggccgtttctcccctcctgttctcgtgatagtgaataggtctgatgagatctgatgtttttataaagggcagttcccctgcacacactctcttgcctgtcactatgtaagatatgcctttgttcctccttcaccttccaccataattgtgaggtctccctagccatgttgaactgtgagtttattaaacctctttttctttttaaattactcagtctcaggtatgtctttattaacagcaaaagaacagacaaatacaacaggcaaggaagactttatacaagactactgcaacaggggagacagactaaactgaactctgctgaaacaaaagaagtctctgtgtgagcttgcagaagagtactgaaagacatcaaggggtaggttgatcaatgagatgtctggcatgttgagttatttccaaatttgtaaaggtttttccatgtgattaggccatctatacttgcttactagtgcccatcaaagtggaaaagtgcctaccttcccatagagactggaagatagacatgctacctttctcgatgattgcatttcaaacggatggctctgaaattcttgagaaagatattgctgagttgtaaaactggcaagaggcttttaaggagatttatatgcatctaaattgggcagagaaagaatttgcaattacaagtatttgtaaatcctctaagaaaaaggagatcaggagcctatagtcatcaagaaaactgtctgaattaagtcaacataaagaaaatattatggcaatcttattcatgactttgggaaacaaaaaaaggaatcccaagtttcaactggttatttgcttttctaagtgttctaatggttcatttaaattttaaaattatatgatttcttttgatatgcagagtatacaaataaaaatccattattatatcatacatttatttttaaaatataaagtttgatttatgtcttagagtatagttttattgatagtctttattaccatccttagatataacagtaaatgactgtttatactaaaattagattctagtagttagacaagttcttaaatcttcaaggatagttaacataataattgacaaacgtgttgattatcaaaacacatttatataaatagctttgaaaatattctataatgaatagtggagtgggttagtaaagtaatttaattgttactgtagttactttttggtatccactgcaatattttcataaccatattaattggtcttgtcacatacatgggccaatcctcagttgctaggtatttacactactaaaacttggaaaaacagaaaaattttgaagaaaacattaaatcaatcctttaaaataatcttgatatgttaaaaataatttaaaaagtatttgtttaattccatgttctttgatgtttatttattcaacattttccccaatgaatttatattttcttttacactctctttcttatgctaatttcagtaaaatgctaatatatgccattgtcacaagtttttttacttttagttcagctgctcaatatgagacaatttttaaattatacctatttgatatacctggataatattttattagatcatagggagtacaatcaccaaaaacaatgattcgaaaattaccatattatcatcacaagtcaataatgcattagtcgttttatagtctttgtattaggacaacgcattctacttttgcttaatatatgattggaaaataaattattttagagaagcactaatgtttttgatttgttggtgatcttcaaatctcctacatttatagtgttatgactatcaaatgaacaaagatgcctgtattctgagaataagcctcattaggatcatcagcaacatttgacaaacagggaacattgcttttgcaaactggcttttcatatcaggaagaaagtgtttctgttttgtgtttaattacttagtctccaaaatgcaacagtatgactaaaagaattttaaaaaatctaataacattatttcttctttcatatattgtgttagtccattttcacattgctggtaaagacatacccaagactgggaagaaaaagaaatttaatttgacttacagtttcgcatggctggggaggcctcagattcatggtgggaggtgaaaggcacttcttacatggcagcaagagaaaatgataaagaagtaaaagtggaaacccctgaaaatcccatcagatcttgtgagacttattcactatcatgagaatagctgggaaagaccagaccccatgattcaattacatccccctgggcccctcccacaacatgtgggaattccaggagatacaaatcaagttgagatttgggtggggacacagccaaaccatatcattccaaccctggccactccatatctcatgtcctcatatttcaaaaccagtcatgcctgcacaacagtcccccaaagtcttaactcatttcagcattaacccaaaagtccacagtccaaagtctcatctgagacaaggcaaattccttccacctatgagcccgtaaaatcaaaaacaagctagttactccctagatataatgagggtacaggcattgggtaaatacagtcatcccaaatggaagaaactggccaaaacaaaggggtaacagggcccatgtaagtctgaaatcctgtgaagcagtcaaattttaaatctcctaaatgatctcccttgactccagctctcacatccaggtcatgctgatgtgagagatgagtttccatattcttgggcagctctgcccctgtggctttgcatggtacagcctccctcccagctgctttcaagggctggcattgagtgtctgtggtttttccaggcacacatccacgagggcaccacccctgcagcaaaaatttgcctgggcatccagacatttccatatattttctgaaatctaggcagaggttcccaaactttatttatttaattatttatttttttgagatggagttttgctcttgtcccccagattggagtgcaatggcacaatctcagctcacttcaacctctgcccctcaggttcaagcgattctccttcttcagcctcccgagtagctgggattacaggcacccaccaccatggccagctaatttttttttttatttttatttttagtagagatgagatttcaccacgttagccaggccagtcttgaactcctgacctcaggtgatctgcctgacttggtctcccagagtgctgggattacaggcatgagccaccccacccagccccaaaccttaattcttgattcaataccacatggaagctggcaaggcttggggcttgcactctctgaagccacagcctgagctctacattgcccccctttagctatgactagagtggctgggacacagggcaccaagtccctaggctgcacacagcctgggcccagcccacaaaaccactttttcctcctggggctccaggcctgatgggaggggttgccatgaatgtctctgatatggcctggaggcattttccccatggtcttggggatacacattaggctccttgctacttatgcaaatttctgcagccagcttgaatttctccccagaaaaacggttttttcctttctatcatatagtcaggctgcaaattttccaaacttttatgctctgcttctcttttaaaactgaatgccttaacagtacccaagtcacctcttgaatgctttgctgcttagaaatattttccatcagacacccaaaatcatctctctcaagttcaaagttccagaaatctctcaggcaggggcaaaatgccatcagtctctttgctaaaacataacaagagtcatctttgctccagctcccatcaagttcctcatctccatctgagaccacctcagcctggttttcattgtccttatcattatcaatgtctttgtcaaagccattcaacaagcctctaggaagttccaaactttcccacattttcctgtcttcttctgagccctccaaactgttgcaatctctgtctgttacccaattctaaattcccttccacattttcaggtatcttttcagcaatgccccactctacctgtaccaatatattgtattagttcgttttcatgctgcagataaagacatacccaagactgagaagaaaaagaggttaaatttgatttacagttccacagggctgtggaaacgtcagaatcatggtgggaggggaaaggcactttctatatggtggtggcaagagaaaatgaggaagaagcaaaagagaaacccctgacaaacccatcagatctcctgaaacttattcactatcatgagaatagcatgggaaagacttgcccccatgattcagttactttctagggtgtgatatgctttggatgtttgtgccctccaaatctcacgttgacatgtaatctccaatgctgaaggtgagcctggtgtgaagtgtttgggtcatgggggcagatccctcatgaatggcttggtgccttccttgtggtaaccagtgagttcttgctctgagtttacaggagatctggttgtttaaaagagtgtgacatcttcctcctttcttccttgctcccactctcaccacctgacatgcatgtctgctttcctttcaccttctgtcatgattggaagcttcctgaagccctcactggaagcagataccagtgccattctgcctgtatggcctgcagaaccacaagccaaataaacctttctttataagtcacccggcctcaggtatttctttatggcaacccaaacagattatcacagtgtggatacaacattactgtctggtaagcaagcatattttagaattgtcgtgctcattacagtagtcactaatccttatatggctttaaatttaaatgtaagtgctctatacccatctgtggttagtctccactgtcataaaaagctcagaaatagtatatttccataattacagaaggttatgttgaaccaatgtattgtagaaagaactgagaatctcactagatatggcaagagtagtaaagatactcacctttagtcaaaccagagtagattgacttcatatttaattaatatggcagagggtgcagccaattcctaagacaaggagtaaaatctacaaaaaatgattcagagaataggagcatcaaacacacgtatgtgcatgcatgtacacatgtgtgcacatgggcacacacacaagtcctgattatgtttgagataaaaacaaacaaggttaaactgtatattttttggtgtaatggtattttttttaacatatattgatggttttaaaaactgagaaagaaagccagaaaaaagttaatagtttcctctaaattaaaattgctcttcagggaacaaaatattcactagttacaaaaaaaaaaaaaaaagagcagagatatgaccaaatattgaattacagtagctggtcttgaacaaggaattatcatctacactatagtccacttgataaagaaatgcatggaggtcgtcaatatttgtgagtgattgctatgatttggatatttgacccctccaaacctcatgttaaaatttgatccccaatgtggagccaaaaggtaggtgtttgggttatgggggcagatccttcaggaataggcttatgtcctccctggaatgcggaggtagtgggtgagttctcagctgttagttccagtgagagctgggtgttcagaagagcctgtcgtctttcctccccatctctctcgctttctctcatcacacgatccctgtacatgctggcccccattcaccttcagctttgagtggaagcagcttgaggccctcagcagatgcagatgctgggctgatgccaggtttcttgtacagtctgcagaactgtaagccaaataatcctcttttcttcataaatcacttagtctcaggaatgcctttatagtaacacaaataggctaagacagtgatccacgagcaaatgagatgtattctcaacataaggaagtaaagtagaaaaaaagaaagaaatatatttaaaaaagaagaagaatttggaggactatcatgagagtgaacatgatatttatatcacatctatcataatgtccagtgagctcaactttaaaaacgttaaattccacctgctgctttctaactgttgataaaggaactgttttcgtcgggtggggtgggggagcagtgggcaggtgctaaaggaaggtgaatcatttctgttttgacatgttaagagtgagatgccaagtggatatgtaagtgaaaatgtcaaatacgaattctgatgactcataagcctggacttcagaagagaggtcagtgatggaggttcagtgttagagtccttcactaatacaggatgttaaagctctggaactagatgagaacacagggattaaatatggatataaagaagaaaggtcaggcccaaacccggggaaactccaaaatttagagctgtgaaaaaatacaggagctaaccagaaaactatgaacaaaaactcatgaagggggaggtagtctgggattacacatttcattagaagcttaaggaaaaaacatattaaagaagggggagtagtctaggttgaattagctgctgagtgttcaggtaaagggaagaagagaggtgacccctggatttggcaaaagagaaattattatttaccttgacaaagtaggtgcaatggattacagggaacagcaatgtaactaacttgcacagaggggataattcaaggggaataagtaaaggcaatgccaaaatgtgccttgtgtggcaaaaattaaaacatagagatgattttaactctgtcacaggatttctcaatataatagctttattcagatatttaaattgttagttaattctgaatcaagtttgtaataataagcagtactttggggtaatctttatttgaatgtaatgcatacactggaaataattttctttattcatgaaatgttttactatatttattgatctcttaacagagttaattgacactcatttatgaaacatgtctgcatacctctaaagtaaatgcttccagaaacaccaagatgagaagacaatatcttcaaccagcaaattctaatagatataaagcagctaaaactgatatttatattaccattagtttacatagtgatataatttatagtgattaaattacatagtgacataatttatgtcactattaatattaaattaaatataaataatttgaggaaggcaaaataaacaccttttggaaattaaaggtgatctaaggagatatctggtggtaaattcagtaaaaaaggagatgtacttacagttgagttccaaaatatatttaagatttgtaggcagttagagtcaaaagggagaggtatgggcagtaagaattgtttagtgtgcctggaagatgacttctcatttattctgactagagtatgaggtacatcaagggaagtgggaaaattgcttgtgtgattaatttgaggacagggtgggatgttaagctttgctagtttatactctcttctatgttgtgactattttatactaccttttaattaattttgtgataattatttaaatagaattacatattataacaataaaagttattcttattttctcatattctgatggttttgttttgttgcaatacatgatttcagagtcatacttgaaagtgtgtcttcagtgatagcctcagacataacatacattcctatatattagttaatttgacttcaaaaattaaattaggtcaaaataattttatcttagaaacttaaagatatttttctacaatgtttttctaaaaaaaaagcttttctcttttgcaggagttttaattattgcagagagtttatatatatctcttaactagttttccctgttattgacatcttatattagaacagcagatttgttataattgtaggccaatatttacacattattattaccaaagttcatattttttatcagatgctcagttttcctctcatatctattttctgttttcagtctcccatctagtatacatcacattgactcagcacatctctttacacttctcttggtttcaacaattccttgaatattttctgtttttgatgaatactggttagatattttatataatgtctttgaattggcctgaggcttatatgctttgagtagaaagaccagagaggtaatgtgccatttcatcacaccatattaagggtaaatcatttcaacatgacttataattgttgaggctgagtttgctcacctgggtgaggaagtgtttatcaggtttctcctctgccatgttactctattttccctatttattatactctttagaagaagtcccttttttcagatgagttcatgtcctttgtagggacatggatgaaattggaaatcatcattctcagtaaactatcgcaaggacaaaaaaccaaacaccgcatgttctcactcataggtgggaactgaacaatgaacacatggacacaggaaggggaacatcacacaccggcgactgttgtggggtggggggaggggagagggatagcattaggagatattcttaatgctaaatgaggagttaatgggtgcagcacaccagcatggcacatgtatacatatgtaacaaacctgcacattgtgcacatgtaccctataacttaaagtataataataaaataaaaataaataaaaaaatttaaaaataaaaaaagaagtcccttttttcaaactacatttactatgcaaggagttatgctccaccttctagagagtatttatatacattatttggaaaactgacctatgaaagatttctctattgtccttatttatttatgtattcaataacttatttatatcagtatgaacttatgaatattgatttcatattttgggttataattcagtgccacttcgtttttttttttttttgctcaaatgttttcagttttggccactgacaattctttcatttggcttttatgtccatttgttacatccccactcccataattttattttgttttgtttaagtactttcttacttccggcattaagcttgagtctttttattggaaaagggtatgagaaaacaagatctgggtgaaagaggtgcttgttgctattggggtgttatgttttctagtccctctaagccgacactgttatctttgcatttccatttgggaaatttctattgacctgtcttcagcaaattcttcaattcttgataagcatttttgacagtccatttttttgttgttagcagaatacatgaaactagataatttataaagaaaaggaatttatttcttacacttatgaaggtggagaagtccaaagttgacaactcacatctcatgagagccttcttgctggtggagaccatctgaaagtccagaggcagcacaggcattgcctactgaggaggctgaatgtactagttcaggactctcttcctctttttgtaaagccaccgtctcacttccataacttcttaattcattaaaccattaatctattaattcatgaatggattagtccatttatgaagggagaggcctcatgaccccatcaccgctttaatgtcatacctcataatgctgctacattggggattaaatttcaatatgagttctaaagggaaaaattattcaagccatagaagtttccatttttccacttatgttacctatctcccttgcatgttgtctactttctcaattagagcccatcacgaatttcatcggaaacttccaacatctgtgtgttatctttgtctggttctgacgcttgatgtgtttcttcagactgtgtttttctttcccttcattatgcttgcaatttttttttctgtgttgaaaactgggcatgttacatcaggtaagaggagagataaataggaattttatgtgaaaatttagactattctggctaagagttaggctgtatctaacatttgctgtatctgtttatgtaaaaggtttagatttcttaagtatatttgtttctgtcttacttcttgagcttgggcttcccaaatactcctcctcagagagagtctatgtcttgcggatggcttatctgtactttccttttactacagtgaagccctgttgctgtggaggtatgtggtgaaaggcatagcattctataatcttctaagtcccagtattttagtgggtctgagtcttttttctgtgacctccacatgtgtttcttagtggtatagttcttctcaccttcttacccaaccctatgactcagggaggttagaaatacttaaaagtatgaggaaagtctttcctcaaagggatagagttcttgtatattcttttgccttagagagtaagcctttgtagttcaaaatactcaatgtacattttacaatgataatccttccctccttctgccagagccataaggggatctttgtaggatttccaccttgacaatctggtgttgatcccgcaaatagaatccaaaaagtgttaaggtttctctaagactgtggcaccctggaatttctcacagtcaggctagttagtatacacttgacctctggaaatttgtcaaaattatcatatatatgttcctgcctgtttatgatatcagtggcttctgctccaggtaaatatatctcatctatgactctgttatatattcacctctccaaattttggagggatgtttgccctgtaaccttagatctctaatgggtacaagaaaagtggttgatttatagcttgtcaagctttttcttattatgtgtacagaagtgatgacttccactctttttatatgttgaagccacaactagcagttcctcttcattatttttttacttcttattctctcataatcatcattttttctctctctgagaatataacaaattttattaaaaatttgtatctagaaatgttacataatgtttgtggttttaggtctgtttttattcgtcttactggacatacagaaatcatatttaatctgatttttgcttaccattcagctgtgtaaaattttccaacactatgttttttagtatatttttcttcattctccctcttctaatgttttggagcccttatgaaggattaaagatcatttaaaatattcccttctcttattttttgtggcttgtagatgctatttatttagtgtagactgatgacagaacttctggaaaagagagacattgtctagacaggtaaagtaggtctccagcttttctagttccagtggagcctctgcttctcttggtgttcataacttaaatgaacctatccctgcttccatagcccaagtatgtgtaggtcaaacacctcttctttgaacctctttgaaggctttcatattttccatttgttttctcctgaattggtttcacatgatggctttctttcctggacattaattgtctgcctgtctttcacgtattcattatattctggtgtcctgatgggaattcctttatactccagtgatattcttttttttctttaaacatttattttaggctcaagagatacatacacaggtttgttacacgggtaaattgtgtgtcttaagggtttggtgtacagataattttgtcacccaggtaatcagcataatatccaataggtagtttttcaatcctgtccctcctcccacactccaccctcaaataggccccaaaatctgttgtttccttccttgtgtcaacgacattctaaatcttcttttttttttttaagattaaattagttttacccaatttttacctacaaatttaaatcgtagataattgtagaagtcttttttcttaaagacagcatagtaaaactatgcagtgaaacagctttagtggcttgcattaattgtttgtttaatttaatcagtcttgttgtttattgataaaatactttgcaatatacaaaaacaatgaccaagaagtgtaccatttatgaacctaaacatcatttcccattactcctggtatgtttgtgacaaattatgttaaacttattagtcacctcagatacttgatactttgtggtataatctatacttattagggctggagagcactcttcctgaggtgccaacactgaatttatcacagctaaatcacaatgtgtcagttgtattatgataatgaatttctttatctagaatgtattcctgacccagacaattagttactcaatcagcaatgtttcttgacccctaagtataaggaggattaattctactctgcatagtggggagttagaagcagattttctttcaagtagcaatgtactccaattgttaggaaaattatgctcagatgataagtttaagttgaggaaaggatattcctcttctaaaatcctatgtctgtgtgaacaattcattgaatttacagagggaacatagtcaaaacaattaaaactgttacagcataagagccagccaatcaaaacaagtgtctctgatgcaccatacacaggcagaaacatggctaaatatcactcatgtttagcaataaaaggaaaaaagtcatatatatataggtaatggggatggtaatagtgtttcactatctactcaggcacacacaatttgcaggcattggaaaaaatctaaacctacactacctatgtaactaactgaaaacacaaagattactttttcccaaacttcccaaactcttgaaaataaaattcatccaaaaatatttattgagcactgtctacttttgtaatgtgtcaaacactgtgaaatatgcttataagagaattctaaatagactgtgtagcagttttccaggagctaacattctcttagatggagataggctaggcaaatttataaaataaaaaaaattatcagattgtattaaattccattaaaaaattaaacgaagtgatatgatcttgcagaaataattttaagataagtgtccagtaaagtcacttgcaagtgagagttgagtagtcaccatctgaagttctgtacacttattaaacaatgtaattctcacataaatgcagtcagctaagcaatatttttattcccatctttcagatgatggaacagaggcacaaaaatgtcaagtaatgtgccccaggtcagggcactcagatcgtaggtctatgacctttatcactataccacactgcatctcctggtgagaactcatgaaagtctaagatgatgagacagttgactacctgaaaacataatagaataagtttctatttagagatgaccatccttacaaagctagaggaagacgtggatgaggagttgaggttggaatggggtcctggtccaaatcatggagagcttgcaggggatatttaaaaaatatatacatatataatttacatttacatatatgtgtatttgtatatgtaaatatatatgaccagataatatgttttaagaatcttttgaaaagtgataaataacttcaaaataaagatcattactgcaatttatatacacaaagagattcttaagtcataaaaacttgtcatattaccatacgaaagtattgactattatacagcaaatgagatactcttcttctaaagcagtaaaaatattgtttataataatagctaacatttttgagtacttactccatgccaagcattgctgttagatgttctacaagaaatatctcacttaattccataaaacaccaggaagcaatacaataatttacaggacaagatctaattttgtctcgattaaaagcctctgttgtaggagttcttttttcccttgacagtagtgatttttatgtagaatatcagtaagttctgctaatctgattcctgttcagaagtttaaaattatttttaaaataaaaatgttacttgtgttacatatactgaatagaaaaacagaattcctgatatgacttagttgaaatagtttaatggattgggattttgttaagaaaaaaattagatgcatcaccgttagcccatatcatcaccgttttgtttcaacattgttaattgtttatataagaagaggacatcggcttttgattagaaaacctatcctaagtcttttctcatgtttagattttgacactggttgttccttatctctttttctcagtttttcatctatacaactcactgatcattgcatcaggtgatcttataaggaagcagaaggcaggatggggaattttatcacagactgttgcttcctcatgcaagatccactctctcaggaagacgtgctgagaaaaatataattcattttcctggcaaacctctggcctctgagaaacccttgagaaaaccgaagcctacttctgtaagcgaggcagtcagggagaagttgcctcataaagcagatggtggtcagcttggttatgaaacgataaactaaggagacaaatcccagcgatgttttacacttacctgtatctgactttgctcttggacagtcaataccaatcctgcctgttccattttagcaatcagtggaactactctagtcagttgtacaggtggcctcaggtgaaaactcagggcaggacaaatattcaggagatgagacctggggaaaacagatgacaatggacaagttacagtcattccttcatccatcatccttcaataaatgcctggtgagtggactatgacttagccagtgcttcctcccaatgcatctccagaggttttgaagttgaagccctaagctttggaaaggcataagttcttaaattttattaagtactattactgctttctcttttattatattttaatgtcatatctaagaaatcattatctagtgctaaatcacacacatgattaacgctaaatcatgctaaatcctgctatgttaccttctagaaattttatagtattaggttttacatttaggtctgtaatgcactttgaattatttatatgatttgacttatgtattgattttttttttttgcatatggatgccaacttgttctgacaacacattacaaaagaactattctttcttcattgactaggctttgcatcattgtgaataacagttgactacatataagtgtatctgttctgattttttatttttatctaatgtatttgcttattattaggccaataccatccagtctttattaactagtactagctatactatgttttgaagtaggagactgaaactttggcaacattttttgtgaaagttattttggctattctaagttatttgcacttgtatatagtctgttttacacaggttttttaaaaaaattcaaattcccttttacacccattttttaaaaaatattgttagttttaagtttactgtcctgtaatttgtgactttactgtctgtactttgttcctttttcttcttattttttaatacattgactaggtttcctcctagtatatttttattgttggctttaactctatgtcttgtttttaatggttgctttcaagtttacacatctttcatttatctaattacctatttaccttcaggaactattatgcaatttcacatataagaatctctaaacattatactttatttctcacttgcccgaattcatgctatccttgacagacattttaatttatatgtgttatatatacccaaatatattatgtattaacttgctttaaattgaaaaatatcttttaaaaataactaaataaaattaaaatatctttgtttctaaaatttatattttcaaattttgtcacacttcctttctctatgtagatgtacatttttcacatttcaaaaggacctttctcaatatttattgtattacaggtctgctaatgttaatatcttttatttttaaatgtctggagccaagatggccacctagacctagccaggaagggcttcttccactgagagggactaaaccatcaattagactggcacattccaaagagaccttcagaaagaaagcattgagagtggacaggaggaggatgcagactctgggatgaaaggggatgaatctaggaaccctgcacgaggttgtcaagcacaagaactagttcctcaccctgagcggctgctggggaaagggtgagtggaatagatatggttcactctgccacagacctctggtaacctaggtagaggagagagaccctatgacctccatggaaatttcagccgacaggagaaactgcctagagagttggcagagacagaaccccagccttcatggaggccatgggacttggcctgggaacagctgcagtggagcatggccataagtactcattccagaaggctcaccatcatcttctaggtggctttagcctttattagctgtctgaccaaaacagagcagggctatcttacctattggatggacccaggctgatttgagcaccccttgactgctggtttatcccagggttcctgcctggccacacctgcttgtagcacagcctcagctgccagctgaagtgcttgctggtggcccccactggcaaccacatgtccacagctcttgcactaccagcatgcacttgcctgcagcctcccatccactgcttcaccactgcacacgtgcttctccatgttgctgctggcatatgtgaacacagggactccccacagcccactgcctccccaccaaagtgctttttgccagaacccctcatcaaaatgttgttgccagtggactgggaacagctcagtccccgaagtacagcaggtacttaacttcaaggggctagagaaaaaaaagctatgggcctggaccagcccccaagatagagcacacagcctaggagtgttgaactaagccttggctccctgaaattattcagaaatgaagccaattgactaaatccaaattagaccacagtcaaatcctcaagggaatcaaagaatataaaagcaagatgttccattcaaaagattaaagtaactttaaagattaaagtaacattaaccccaacatatgagaaagaactgtgcaagatatctggcagttctaaaaaccagagtatcttcttacctccaaaagattgcactagctcttcagcagtgacttgtaatcaaaatgaaaaggctgatgtctggatggcaatgaagatcatcaagattatgagaaagttgaaaaccaatgcaaataatctaaggaattcaataaaatgatacaagagctgaaagatgaaatagtcattttaagatagaaccaaagtaatcctctagagctgaaaaactcactatgagaattttgtaatacaatcagaattgttaataccagaagagaccaagctgaaaaaagaatctaagagctcaaagactggttattcaaatcaactcagtcagacaaaagtaaagaaaaaagaattttaataattaacaaaacttctgaaaaatatgagattatgtaaagagatcaaatctgtgactggtttgtgtcccagaaagagaaggggaagagcaagacatttggcaaatatattgagaatactgcccatgaaaattttcccaatattgctagaggactcaagatgaaactataggaaattcaaagaaatccagtgagatactatataggatgaccacccccaagacacatagtcatcagattttctaaagtcaatgtgtaagaaaatacattaaagacagctagagaagaggagcaggccacatttaaaggaaaccccatcaggctaacagctgaactttaattcagctgaaaccttttttttttttttttttgagacgaagccttactctgtcgcccaggctggagtgcagtggcgtgactgcagctcactgcaatgtccacctccggggttcaagcgattctcctgtctcagcctcctgagtagctggggctgactacaggcatgtgctaccatgcccagctaattttttatttttagtagagatggggtttcaccaagttggccaggctggtctcgaactcctgacctcaagtgatccacccacctcgacctcccaaagtgctgggattacagacatgagcctctatgtctagcccagctgaaacattttaagccagaagagattgggagcttatattcagtatccttaaagaaaagaagttcccactaagaattttatatccaggcaaactaagcttcaaaagtgaagcagaaataaaatcctattagacaagaaaatgctaagggaatttattaccaccagactgccttacaagaggtagttgagggaatgctaaacattaaaacagaagaatgtaacctgccaccatgaaaacatgcttaatacatagcacactgacagtataaagcaacatcaagtctccataataaccagctaacaacacaacgacgagatcaaatcctcacatataaatattaaccttgaacataaagcagctaaacaccccacttaaaagacacagagtagcaatttgaataaagaagcaagataaaactgtatgctgtctctccacatcctctccacatcgatgtggagaaataggaacacttttacactgttggtgggactgtaaactagttcaaccattgtggaaaccagtgtggtgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcccatatacaccatggaatactatgcagccataaaaaatgatgagttcatgtcctttgtagggacgtggatgaaattggaaatcatcattctcagtaaactatcccaaggacaaaaaaccaaacaccgcatgttctcactcataggtgggaattgaacattgagaatacatggacacaggaaggggaacatcacactctggggactgttgtggggtgggggaagtggggagggatagcattaggagatatacctaatgctaaatgacgagttaatgggtgcagcacaccagcatggcacatgtatacatatgtaactaacctgcacattgtgcacatgtaccctaaaacttaaagtataagaataaaaaaaaaaaactgtatgctgtcttcaaaagacccatctcacatgtaattacacctataggctcaaagtaaaggagtgaagaaaaacctacttatctaatgtaaaacattagataagttgctgatacatttgggatatatgtttctactcaaacctcatgttgaaatggactccctgatgttggaggtggggcctgttgggaggtgattggatcatagggcagatttctcatgaatggttggcaccatctccctggtggtgtcctcatgatagtaagtgagctatcataagatctggcaatttaaaagtgtgttgcacctccccttacccttgttcctgctctggccacatgaggtgcctgttttcccttcacctcctgccatgattgtaattctcctgatgcctctccagaagctgagcagatgccagcatcatcctttctgtatagcctgcagaaacatgagccaatttaacctcttttttttttttttgagatagagtctcactctgtttcacaggctggagtgtagtggcatgataaccattcattgcagccttgacttccaggctcaagtgatcctcccacctcagactcctgagtagctgggacaacagatgcatgttaccactttcatctatttttgtattttttgtagagaagggattttgttatgttgcccaggctggtcttgaactcctgggctcaagtgatcccaccctagcctcccaaaatactgggattactggcataagacaccatacctcacctctcttttctttataaattacccagtcacaggattttttataaaaatgtgagaacagcctactacagattgttattcttattttagactaaacatactttaaaccaaccagtatcagaaagtaaaagaaagtcactacataatgataaagaattccatttaataagacttacctatccaaaatatgtatgcacccaacactttagcacccagattcaagtttttagagatgtacaaagagacttagataaccacacaataatagtgagagacttcaacaccccattgacaatgttagacagatcactgaggcagaaaactaacaaagatattcaaagtgtgcagccaacacttgaccaaatggacctaacaggcatctatggaacactgcacacaacagcaacagggcatacattctttccatgtgtacatggtgcatactcttagattgaccacacacttggacataaagcaattctcaaaaatttcataaaaataaaaatcataccaaccacactcttggaccacagtgcaataaagataaataactatgccaagaagatctctcaaaactgtaaaattgcaaagaaattaacccttttctggttggccccaagaatacttgcccacagtgcttgtggcttggtgtttgccctgagataactttgccatgaaatatttcgcttttcttcttatttttgcatcactctttagtatattgaccttggaaacagaagacattgttctattttatagcattctggttttagtagtggtatttccatgtataaaatatggtaattcttgatagctgaaaatatcaaatcctagaaaacatagtatccctacacatgatattaacattgttctaaaacaattggccaaagattgatttgatgaatccatttttttaaaaaataaatgactccgatgattcaggtgattttgatgttacttctgtttagaaattactccaagagcagtttttatattttattttcatatagaaaatctgtcagatttgcttcaaactcaaagagcatgtttatgtaaaattaaatgattgcagacagtgagctgcacttattttttttaaatggaaaaaggttaaagaactgcctcctaaattatttaaggtaaagaataaaattaatacagaaatcaagaaatccactgaaagtaatgaaaacaaagatacaacatttcagaatctctgaaacatagctaaagtagtgctaagatgaaagtttatagtgttaaattcctacatccaaatgttagaaagatctcagataaacaacctaacatcacatccagaggaactagaaatacaggagcaaaacaactcagatgtgagcagaagaaaataaataactaaaatcagggctgaactcaatgaaattgagacatgtaaattcataaggagaatcaacaacaccaagagctagttctttgcaagaataaatagaatttacagacaaataactagactaataaagaacaaaagaaagaaggtccaaacaaacacaatcagaaatgacaaatgtgacattatcactaaccccacagaaatataaaaaacctctcagaacctattatgaacaccagtatgcacacaaactagaaaccttagaagaaatggataaatttcttgaaacataaaatattccacgattgaactgggaagaaattgaatccctgagctgaccaataatgagttcctaaattgaattagtaataagaaatttactaaccagaaaaaaggtctgtaccagacagattcacagccaaattctaccagacatagaaagaagacctggtatgaatcccagtgaaactattccaaaatttgagaagagactcctccttaacttcctctacaaggccagcattattctgataccaaaacttagcagagacataatgaaaaaaagaaaatttcaggccagtaccctagataaacatagacacaaaaattaccaacagaatactagcaaatcaaatacagcagaatataaaaaactaatccatcacagtcaaataggcgttgttcttggtatgcaagtttgggtcaacttacgcacatcaataaatgggattcgtcacacaaacagaacttaaaactaaagccacatggtcatttcaatggtcatagaaaatgcatctatctcttcatgtttaaaaccttcaacaaactaggtattaaaggaacatgtctcaaaattataagagctatccatgataaacccacagcaaacatcatactgaatgggaaaaagctggaagccttcccactgataactggaacaagacaagtgtatccactctcactacttctgttcaacagagtactggaagttctagctgtcaatcaggtaagagaaagaaataaaataacatacaagtagaaagacagcaatcaaattatctctctttgcagatgatatgattctatacttagaaaaatcccatagtctctgcacaaagtcccctagaactgataaacaacctcagtagttttatgatagaaaatcaatgttcaaaaatcagtagcatttttatataccaggaacatccaagctgagagccaaatcaagaattcaatctcattcacaatagccacaaaaagaacaaaatacctagaagtgcaaataaccaggatagtcaaagatgtttagaatgagaattataaaacacgactgaaagaaatccgaaatgacacaaataaatggaaaaatcttccatgctcatggataggaagagtcaatattgttaaatggacatctgcccacagcaatatacagatttgatgcaattcctatcaaattatcaacattatttttcacataattagaaaaagcaattctaaaatttatatatgaccctgaaaagagtccaaatatccaaagcaatcctaagcaaaaagaaaaagctggaggcatcaccttatctgatttcagattttaattataagtctatagtaacccaaagagcatggtactggtacaaaaatgggcacatagatcaatggaacagaatagagaatccagaaataataaagaaacatacctataacctactgatcttcaacaaagttgacaaaaacatacaattggtaaagaagaccctattcaataaatagtgctgggaaaactgaattgctatatgcagaataatgaaactggaaccctatcactcattaaatacaaaaattaactcaatctgcattaaagacttaaatgtaagacctgaaactatcttaattatcaaagaaaacctaagaaaatctcatttaggcattggactaggaaatgaatttatgactaagacctcaaaagtaaatgcaacaaaaataaagctaaacaaaaaaatcagaacatacataaattaaaaaatcttttgtacagtaaaagaaataatcaacagagtaaatatgtaacctccagaatgagggagaatattttcaaactatgcttccaataaaggactaatatccagagtctataaggaactaaaacaacttagcaacaacaacaaaaacaataacagcattaaaaagtgggcaaaggacatgaacagacattcctgaaaagaagacacagaagcagccagaaaacatatgaaaaaatgttgaatattattaatcatcagagaaatgcaaattaaagccacaaagagataccatctcaaagcagtcagaatggttattaaaaagtcaaaaaacaacagatgttggcaagaatgcagagaaaagggaatgctttacacacagttgatgagaatgtaaattagtacaacttctatgaaaaatagtatggaggtttctcaaacaattaaaaatagaatcaccatttgatctggtaatctcataactagatgtttaccctccacaaaataaattgtgatatcaaaaagacacctgtactcctatgttttctgcagcactattcacaacagctaagtcatggaatcaacctgagttttgatcaacaaattgttggctaaagaaaatgtggcatatatacaccatggaatagtactctgagataataaaaaataaaaccatgtcattgcagcaacatgcatgttgcttgaggccattatactaagtgtttttttactcagaaatagaaaagcaaataccacatgttctcatttataagtgggtgctaaacaatagatacctatggccatatagaggagaatgatagcaactggggactccaaaaatggggagggtgtttgtgggtgagtttggaataattatctattttgcacaatactatttgactgtccaggtgatggatacactagaaacccagactttgccactatgcaatatatatccatattacgaaactgtacatgtaccccccgaatctataaaaattaaaaaaatacattttaacataataaaatatagaattttaaatttaaactaaataagttttattcaaaacctacttcttagagactgccaatagactctatatacttggcaaagattcttgaaatacagaaaataggcaaaagacagaccctggcatgtaatgcagttgtacaaattagaaataaaatgacaagtaatgagtaggaaaaaaaggcaaatgatataaaagacatgtcatgaaataggaaatacatgtcacaggaacatttttaaagatgctgagaaatcacttaacaggtacaacatacagtgtttgggtgatggttacactaaaagctcagagttcaccactatgcaatatatccatgtaacagaattgcacttgaacctcttaaattttgtttaaaatatactcgaaattatttataggtaaattccaatgaagtccacacttattcagttggtaaactttaagaatgttgcaatatcgtattctatagagcacatgtatcagtcagatgacttgtatattatgctcctgagtttaacatattgcaatccattttgttaaatggcttggcattatattgtgaagaccagttttcatatacaatgagtcaataacatacttgtctacactcgtgagaatttttagtccttgtatcccaggagagagttacaatacttaaaatggcactgctccagatgttaaaagacaaaaggaagaagacgaaatataatctgccttgatagagaaaatgaataaattgtaacacattgccacaagtaatccacacattacagaaataaatgatagctacacttagcaatacgaatgtcctgtcctaatctctaatctctagtgaagaaaaagacagttacagaaaaatatatactctctaatattatttttgtggaattcagcaacaattgtgtgtgtatgtgtttttgtgtatgtatgtataagcacatttatatgaagcactcacataaatattttaataagtgataaaatgatatttaaaattttataaaagggacaacaaaaaaatgctttaagggagggcgtaagtagatgaacatggctgttaaagttctagagcactgagcaatggccgttctttgtattatgagaaacccatatggataagcatatgtaaatctcttactgcaccaataaaatctaaattgtttctcttctcatatcaatgaataaaataatatgaatattactagctgttgcccctttttatatctctttttcttctattttatttcttgcaacacctagaatctgatttttctaaatttcaaagtgaagctgaaataaacttagttccttatatggtaagacagagccctttagggaacaaggaaatggatttctttggctacaatgacaaaaaggaaataaatattttaccacatcttgtttcacagggctaaccttgtcctgggccaaactgtcctcaggaaatccagtgctatgttgaggaaatccagtttccctctcagattctttttgagttcttttttactaagtgaataaattatgctgttttctggaagaaaaatgaagtcctaacgaaataatcctcagaaaaatcacctacttaaagtgtatatgttacatatgttataaatattataaatgtgtatcaatgaatttctaataggtaaatataagtaagaaaaattacaatatctacaaatgtcttctaaatgactttagacttgacaaatcagtgtcaattgagattctttttctgttgcttgagggacactttagcaaaatagataaacaatcagaccctggatttagcactgaagtctcgtttgagatctaaatctgtcatgtacaagacttgtaacacaaatcaagttatatgttcacttgtgcctcagtatcctcaactataaaatagtagttcttccctcactgtattgttgtaaggattaattaaattaataaataagggacattttaaaaaatcctgtcaaaataatactatacattgatttgctatttttttccatagcaaatcttttttcacccctcaaaaatttgcatgcattgtaatagatgccagacattaacgactatgccagacatatgcatttcttcctggatggctgttacaatatagcaaggatgacactgtgaacagtaaacataaaaaggcatttatttctcatgaaggaagatggtatgggtgaataagtacatttgggaattgaggtggagctttcttgaggaaacgatattttagattgtacctaaagaataaaatggacactttgggaggccgaggtgggcggatcacgaggtcaggagatcgagaccatcctggccaacatggagaaagcccatctctactaaaaatacaaaaattagccaggcatgcgtgcctgtaatcccagctactcgggaggctgaggcaggagaattgcttgaaccagggagttggaggttgcagtgagccgagatatcgccatcgcactccagcctggtgatagaagggaaactccatctcaaaaattataaaataaaataaaataaaatataaaataaaataaaataaataaaataaaataaaatacataaaataaaataaaataaataaaataaaataaaataaaataaaatggagtaagtaagaggggcaagataattccaatgagaattaaccaaatgggccaagatctgaggcaagaaagggaatagtggggaagattaagttaagagaagagcaaggactaacatacaaatgaaagaagttacactaaatattagcgattttagagggaataaaataggaagccatgaattagtttctggaaaataaaaagaaaatgatccgatttatatgttttaaaaaaatacgttaacatttgaagtaagggtttggagaagaaatagcaagagcagaggtaaggagactagttcacgtgcctttgcatgatattgtgttgggctgagctacagtggtggaggtaggagaaagaatttaaatgactgcagaaaccagttaggtgcagcatctataaaacattgcatgagcatagacaggaggaaaaggaaggtgttaagaatacattgagaaaaaagatggactattatccctttttaaatatggagaaccctttggatttaggaaaaaatatagatatcgggtatgagttgttgagtttctgaataaaatgagacaataaagtaaatatgtcagcctgggattcaaaactgtatgtaagtgtgcgtatgtttgcatgttctatgtttgtagatacatatatatttacatatataagacagatgcaaaatatgacatttcaaagcatgagaatgagtaatgttgcccagagataaaattgagagagataatgtgtccaagacttgatttctataaaattggggaaattaaaatagaaattagggccacgtgttaatattaaataaaaaagccaatgtttctacaagaaatgaagaatcaactatattgaacatatctgcagttccaggaaagatgtggactcaaaagttccaaatgccttggaaatgggtaataagtctaacataagcaatagccaatttcctggatattaaaaactgcaagactaaaaagacttggttgcagagtgtggggaaaatgtgagtggggacaggtttcatgagaacatgaatgttttgagccatgtgaaagagacatgagtacagtcattgagtggatagagtctagggtagattggggcactgtagtacattttcacatagaggtgcatgatctaggagagggatgtgaggaaggttcaggaaaataataagataaagaaagttgctgagaaaatgaacagggatggtgcagtagcactgcaacactgctaataaagacataccagagactgggtaatttataaagggaagaggtttaattgactcacagttcctgtgagggggctggagggggctcacaaacatggtggaaggttaatggggagcaaagtcatatctttcaaggtggtaggcaagcgagtgtgtgcaggggaaccctcctttataaaaccatcagatctcgtgagacgtattcactaccaggagaacaacgtgggaaagacccgcccccatgattcaattacctcccactgggtccctcccatgacacgtggcaattatgggagataaaattcaagatgagatttgggtggggacacaaccaaaccatatcacttgggttccaaagctcatatggagaaatggcctcaggtaagcgaagagcagacaccttaggaaggaaaaactctactctctgctttttaatttattgcttattctggaaatatctcatgttgcactatagttttttctaataatatctgcgttattacatgaagtttttcccaagcatgcttgcataattgtagcctattgtattattttttataatgtagtctgaatattggtagaaaagttgatagaaaagttttgtttccttcattcaacaatgtatagtttcaacataacgactatattttagaaaggaaaatatattaatgtattgccacatgacatatcggttataaatgactattaacattcaacatttttaagttagctttttaacattattgcattgtgaaactcctgaattatcttgagggagaaagactctatatacaatttgaccctaaactacattatcattatcattattttttgagatggagtctcgcattgtcataggggcttgtgtgcagtggcacaatcttggctcaatgtaacctctgcctcccaggttcaagtgattctcctgcctcagcctcctgagtagctaggattacaggtgcccgccaccccgcctggctaactttttgtatttttagtagagacggggtttcactctgatggccacactggtcttgaactcctgacctcgtgatccgcccgactcagcctcccaaagtgctgggatttcagccactgcacccggcctattatttttgtttttttaaaaatgattatttattattacatgtgctgggattacaggcgtgggctaccgtgcccagcctattatttttgtttttttaaaataattatttattattacatatatatgttttatgagtctcacatctttaaaggattatagttgaccaaatacatccttaaaaagttctgtaattcccagacaatattatgcaagttaataaaaatttgttgtgattaggctacacagatttgttgaagatggacatgatttcttcctttgtattatgcaattaagaatttcaatttataacatacattcagagctaattataagataccaagcattttgaacaaaattggagatctatatttgcagatatctgtgactttcattcatttccaagagggtacactgtgtttctggacacgagtgaaagttccaggtgcatgggtgtctcattgaacagcagaaggaggatgaaaagtactgttgaactgtagggaggctaaagaaatactcttcttggagactagtctcataaaacattactgcattccctcacttcttcattcattcatttattctacaattcttttgagattttaatacattccaagaattatgttagctgttatgagttgcataagtattctcatcctgattcttcaagtacaaattgaagtatgagaaagacatacgataataaaccccccccaaacaatagcattggctcatggaacatcaaggacagtgtcctgggaggagaactgtgtggaaaacattttgcctgccccctgaccttgtagggggatattttcttcaaaatcctgggagatttgggagaaatctcatagatccacatagatcccaaatcctgggattctatgtggataaaattaatgtaaatatagacctctttctctgctctttaatttcatctatcctactttaattatttatctgattggaaaactaaaatgagagaaattgaaaaaagggagagagtgaatgaaactaggtaagcttggctcagttttgtatttcttcctttcaggagaatactgcacacttgggttggcaagctgctttgctgtactgtcaatgggcatcctcctgagaacaagaagtctggcattcctaggactgtgtctaggaaaaggtaataacttgcccttcatcttctattctctgcatcattttaaagcttgtttagaacctgggaagggaagaggaccattagttttttgattcccctcagagtatccccaagcaacttcagcatccttctggttggttattatcattaaactgaaatctgaacctaaaatatgtatcttcagagaattttaagaatttagccaagagtgttttagtagtgatttgaggaaagaagaaagaggaaaagctaggttgaattagctgactcagcagactcagatatatatatatatatatatatatatatatatatatatatatatatatatatatataatatgtatatatatgatctatatatatctgagaatatatattatatgtaacataatcttataatatatttatgtgaacaatggagaaatttttacttacaaaaaagttactaacaagatattttgaaaaattactctaggaaacaggatatttttatggtacaaaattttgaggaattaaaagtttaaaacaaaacatgaacaacctgagataaaatcaaatttagaataagttaaagacatacttggtagaatttaaaaaaggaatcaaaaaaggaaaataccattgagtgatttattactatttacaggggaaaataaaaccctacaaaataaattatttagattaaaaaaaaaacagcagcaataatggggacatattggagaatatgacagagtagtcagtaaaggcaaatagataaaaatgagttccaagaatattattcctctggacacagacactatgatataaaatgtccataattgatgtatttgaaagtagacgaggaaaaatgaaacaaaatattcagaataaatacaggaacattttctgtaaaagaaacctgaataggtagattcaaaacactcaatgtatttcagtgactcaaaaagcattaataatgatcaaaaagactgagacagattctggtaaacttactgatcttcgggtttaaagaaggaaacctgcaagcatccagggaaaaagacaggaggtcatttaaaaagggaaatacagagatgattttatatttctcagtaactttaggtgacagatgacaacagggaaacctctacaatgcatgaaaaagaaatgaatagacccagcaatcttatgaccagctggcatgttatccattgtatagcacaaaatgaagatgagtttgacaaatccaaggttcaggaaataaagcattcactaactcactgttaaagaatatgctggtgaatgtgtccattcatcagaactatagctaaataaccataaaaagtacaaacagagaatgggatgtaaaagctacaagtaaaaaaaagatgtttaacatgaaaaataatatatttcttatacactgaatgagaatgtatccagatattttccccagtctcttttgagaaaaaaatgactaattatgaaagtatattcatttatttatgcctgaataaaacaaattatttatttaacacacaatgtgtcagccacctctctgcatgctaaggatactacaaagaaaaacaaaaattccttccttcctaacagatccttcctaacagagtatatgtgctagagcaggggtccccaacccctgggccatccagtagtggtctgtggcctgtcaggaacgaggccacacagcaggggttgagtggtggcaagtgagcattaccacctgagctctacctcctgtcagatcagcagcagcattagattctcataggagcacaaaccccacggtaaactgtgcatgcgaggactctgggttgcatgctccttacgcgaatctaacacctgatgatctgaggtggagcagttttatcccaaaaccatctccccccaactgtctgtgaaaaaactgtcttccacaaaaccggttcctgatgccaaaaaggttgggtaccactgctctacagagatagacataaattaaaaaggtaaatatataatatgttagataatcagtgttatatagaacaaaagcaaagaaggagcacagggaatgacttattaatcaccttccttatttagttgagtttgcaattttaaactgggtggtaagtgaagacaaataagaaagaaggttgtatttaagccttctaaaagaagatgtgtatgaccttcagattcccttggggagaggtcacctagatcccacatgtaatcattattctccttaaaatagctgagatgtaggtggagaggaagggtgagatcagggagcttggagggagagagcaagtccatgtcaggaagcaaggatttacctttttttttttcagttttgaatgacggcctcctgaggcaacattttgttgattctggacaaattcaagcatcgtaatgcaaaagtacgtcatctcatcctcctgtcttataccctttaacttctgcactagatctctgctgctgaccctgaggctggagaagccacaggactatgtacaagcttgtccaacccccaagacccactgggctgcatgggccacaagcagcccaggacagctttgaatgccgcctaacagattcgtaagctttcttaaaatattatgagattttttgtgatttttttttttttggctatcgttagtgttagtgtattttatgtgtaacccaagacaattctttttcaaatgtggcccagggaagcaaaaagatttgatgctgctgctgatgaattctgactaaatgtcctataaggcaaaacactgacaaataacagaaaagcaatggtgaatacaattttctttcttccactttccaacaggcttgtcttagttcatttgtgctgtaataacaaaacatacagactgagtaatttattaaaaaaaataagaaattcattttttacaattctgcaggctggaagtccaagatccaggcatggttaaggttggtgtccagtgagggctactctctgctttgaagatggtgccttgtggctacatcctctcatggtagaaagtgaaagggcaaagtgggagaaccctatgtgaaggctcttttataagagccttaattcatgcatgggggtggagtcctcatgactaaatcatttcccaaaaggcctcacctcttaatataactgcattagaaattaagttaaaaacgtggattttggaggggacacaaacattcaaaccctagcaaggctatattgaattatcatttgtgtggctttttagaagagggtcctgcaaaatggaacaatcagtagtgcttgatatctcgttcccctttccctgcccttttgtcctggggttgcactctcaaaaatataatagaatgtaaatatatgctacaggatctgcttctggagaagctcagggtaaaacaatatttataattttacaaattacaacatctataaattctagaatcactaactgtttcactttggtctcagatggtttattggacacggctttcattaatggcatcctaattgtcaaaggggtcaaaactgccccaacttctctcggggaataagcctatacagatattttggaaaacgaattgccccataaagatatgtcctggaaataagggtgtcagtgtcttggcagaccttctgggacagtaaccagcatctcacaaaaccagatgctccatgaatgacaggcggtctctgaagaaactggtggtcttgtccattatacagcagcagagggagttaaaatgtctccatttgcttcattttggttcatgtgaccctattttctctggagaaaacaacaacagcagcaacaaaaccaacaataagaacacccaatttgccatgaagtatttcttccaatatttattttttttgtgtgtatatctttgtttttgtttttacagatagactctcactctgttgcccatgctggagtacggggtgttctataactcactgtaaccttgaacttctaggctctagtgattctcccaccttggcctcccaaaacacttggattacaggtgcaagccaccatgcccaaccttatgatagcatttattttgtatccatagactttctttgctagattgagtaaatcttctatatctgatagaagggaaaggagaaagtcataagggaatgtagagttaagaaaatttgatgagctttggtgtacagaaaagggtaatacatgtgcatcaaatatttaattatttaagtatataaatatgttacaaatgagtgcgtaataatatcattgttatttggtagggaagtggtgacacagaggacattaatactttatgcctcatcttcttagaacacctctgatttccatgcacaattctgtgcaacatcagcctctgcccatgaatcccttcctatgcctggactgagagtcttaccatttcctatccagtgccatttctaggtcttttcgaagacatgtaagagttacccataatgtagaagggttaaggtacccagggtcatcccctaacaaatgaattaataaaagttttcttgtgtttcaggaggaaaattcagacaggcattttatacattggttgggaagtatcagcagaattaattctggtagccacaaccgtgatcttgacaaaacactctccatattggcttttccaacttctttcccttcatgtcatcctcccaaactgcccatctctgccatcatctccccagtaaaatatgtccacctattctattgacctcaagctctgccttggggagggagttattaaccatatgagagtttttatttcatagggagaacactatgtttgccagttgccacattcatatgcagaaaaagggaaagtccagtgggcagtaagaagcaactgaaagagaacgaaatgttttgcaagggaaggggatacaaggtaaactattaaagagaagactgagttttacatagttttatataagaatgactctacttataatcaaggaatctcatagatattccaatttttttctaagtaaacattcgttttcatgacagatgatttaaaatctctttccttatgctaaacaaaagtaactctttggggacaaatttataaatagatttatagggaatatgatttggagaatgtgataattagggacctcaagatattccacataatctggaggtaaagaaaataaaagtttaataagaagtgcctcaggatattggaaatcagaagtaacatttttttttttttttgcacaaagttattttaagatgtaatgacacccaaaggaacatgatattaacacagccagattgaaggaactgcacataaagtaattcactgacgtttactcaggaaagaaacatagaaagaatcctggaatcaaatcccaggagaaataaacccaagtcccaattataattttaatcacattgtgtgaatggacacattaggtcatttctaatcttttttattttgactttatgctcaaaacagctatagctttgggaatggagaaaagaaccaattttctccaagaattagcagaaaagaactattttcttactatattaaaagaagatggaaattttaaacattcataaaagcaatgatataaatttgtcacacacaggcaatcgtttcatatacttagaaacaacttttttatccattagatatcaatgtgagatagttaatatcaaagagcagcaactattgcttaaaaagaattgcttgtgtttaagtgaatcacagtttatcaagattatagacttaagaaacttatttttatcttttaatttcaagttaaaaaagtaagttttatgtaaaataaaatcaatccatttataagcatgattaatgtttgcatgtatacatttcttataaatagttccatttttagactcatttcatgattttcctttaaatgtttcaaactatttattaattttctaggtttgattttattttaagcagttaattgcttcctgattgaacaagtttatgagtttaccaagaaaatattcctaagtacttaaacaacatatgcaaatccagtaaattaaaactgtaaatatagtaaaaatagtctgcaaaaatattcattctttatgtatttactaaaatatatatcttttaaattaaaataataaatttgaaatcaattttatattgttagattgagatttttagggctgatctgtcaggttctctaatgaaccaaagtttttcaaacataacaatacttcaaacattattcagattttttctaataaaaaaattgctcttgtgacatatctgatctactgttgtaaatcacctctatatatttatcctttttttaacacaaacttgtaaaatcacttatcttttgataaagcagattttatgtttcaaagagttgtagtctgcagatcaattatgtaggaccaggtaatggtgaagatgtcaggtagattgaggtcacaatgaagtcttggaggctgcattcatttaactgaattatttcgtcctgtacataagcatactgaggacttttctcattctgatgacatgaggaatcttcactaagaaggcttctacaactacattaagattgatttcagggctggagtggcggctcacatctgtaatcctagcactttgggaggttgagggaggaggatctcttgagcccaaaattcgagatcaggctgggcaacatggcaaaactctgtctctacaaaaaatacaaaaattagctaggcatggtgttgcatgcctgtagtcccagttactcaggaggctgaggtgggaggatggcttgagcctgggaagtggaggttgcagtgagctaacatcaagccactgaactccagcctggatgacagggtgagactttgtctcaaaaaaaaattttaaaatggacttcaaaacattaattttttacctcaaatacttcacatgtactacattcatctaattagaactgatacctatttgcacacactcttacagataactaattttacaacttatttttactctgcattacaataaaacaatatgttttccaatattttaaaatatattataattcttaattctcacacataactttatctgactagtaacaatttgaatgtcactcggcattacaataaaataatatgttttccaatattttaaaatatattgtaattcttaattctcatacataactttatctgactggtaacaatttgaatgtcaggaaaatgaaaagacagacatagaaatagaattagaaaatcaaattctcttcctgaattaagtaaagccatctctcaatcactgtagatatgctgtatctatgttccctaagaaaaaataacagccgggcacggtggctcacgcttgtaatcccagcactttgggaggccaaggcaggtggatcacgaggtcaggacatcgagaccacggtgaaacgccgtctctactaaaaatacaaaaaattagccgggcgtggtggcgggcgcttgtagtcctagctaatcgggaggctgaggcaggaaaatggtgtgaacccgggaggcggagcttgcagtgagccgagattgcgccactgtactccagcttgggcgagagagtgagactccgtctcaaaaaaaaagaaaaaataacaataatcaatattctcatgtctttcatgccttcagaaggaaaaaaatagaggtttaccagttgtcgaaagaaaatgtaaacagccattccactttatataccttaaactattcggtcttggatataataagtgcctttataaataaacagacggaaacaggaattaggaaagttgtgactgtaaagtaacataatagaacaggatgtgtaaaatacattttaaaataataattattaaatgttaaatttcaaagtagaaaaacatagtaaaatatctttaaggacacatgatgaattaatggaaattggtattaattcaagttgaaacacaaaacaaggagaaaagatcaagtttttcagaccctagaaggtaaaaatatgtgattgcaatcttagaaaacaagataaaattacggaataatagtattttagggttatataagctaatacaacctcacctgcttacattacaaataaggatattaaaattctgtaatgtaacatgactattactattttagacacatgtatatttagcaccaaatatttaataatataaatcatttgagaaaaaccaaattagttctttttctgatgtagtgatcaccaaaccacactctgatgacaaattcagtatgtagagttaacatgcatatggcaagggaatgtctaagatgcttctatatgtgttaaattatttaataactgagggtcatgtaaaccttcagtctttgacaagtcattccagttacaagtattaattaaaaagttattgagtaagtagttgatgtgcaatagcatctatctaaaaaagtctacactgtcactttttagaatggaaatgaaaaatacacatagatgtaaatttcaaattttattgactttgttttattgtaatctagaagaaagactttttaaaatttaatgaagtttctcctcaaacctattttgacatgatctttgagagaccataattctataatattcttttaaacagtagataatgtatcaattattcatgtaactattatattgcagataaatgtaaagggcacaataacactcttaatgccagctagaaatacatcttataattgaagatttatattaaaatatttaaaaagtagctgatactttgcctaggatacataagtacataatttttatttagacttaggctaatttgaatgactatatttgactatatttgaatgactgtttaatttgaatgactttaattattaattacaatagattgtcaaaatgtatgtaaaaattcacacaaacactagtgtcttagttaatatgtaaaacaaaacttcaatatgaaagttttatctcaaattaatatttattattatgatactgtttgcttatctcaaagacaatggtgtcttgaataacacaatagaaaattatctcaataaagaatactacttctgggtcaggtgcaatggctcacacctgtaatcctagcactttgggaggccgaggcaggtggatcacaaggtcaggagttcaagaccagcctggccaagatggtgaacccccatctctactaaaaataaaaaattagctgggcatggtggtgggcgcctgtaatcccagctactcgggaggctgaggcagagaactgcttgaacctgggaggtagaggttgcagtgagcagagatcgcacaactgcactccagcctgggtgacagagagagactccatgccaaaaaaaaaaaacaaaaaacaaaaaaacaaaaaacaaaaacaaaaaactagtacttttgaatactgctaaaattttcaaaataattctagctattgaggtgtattttgatcctttaagaaagatacaggaagcagttatgtcttccctgatttaaagagtcttctaatgtaaagattaagtaggctatgcatgttctcatgtaataattatcattaaatttgttgtcacaaacacaaaaggcattggtgacaatatacattattttttattctccatgttaattttcagttatgtgtgtatgtgtgtgacaaataagaattttaaaaattttaaaaattttaatattcttttctttccaaatattagacaccttctttcatgaaaaatactttatatagctttaagtgttctcaaatgttgcacattgacttataacatctaaattacacagacacttttcctgcacatttactttaagctgtctgatgttgttattatgctccttttttttttttttttttttttgagacgaagtatctctctgtcgcccaggctggagtgcagtggcgtgatcttggctccccacaacctctgcctcccaggttcaagcaattctcctgcctcagcctcccaagtacctgggattacaggaacgtgccacggcacctggctaattttttgtatttttagtagagactgggtttcaccatgttggtcaggctgggcttgaactcccgacctcaggtaatcagcccacctcggtctcccaaagtcttatgattacaggcgtgaaccacagttcccagccatgttactttttatataacagaaatagttgtgctaatggtcttctgagaaggaaggtaggaaactacaaatcttaaaggaagtaaaccaaaagtcaaatgccaccttatatggatattgagtaattgattttgtgatttagtagtttgtttagcttatcattcaaaggcatacgttaattgttactcaatttcatttttggtacattaggaaactgaaaaacctgacgtgcatgtgtcgatttgtgtttataagccatggactttgtgtgtgatcattatattagctgctctaatgaaaattgttacactttcaatgctctttcaacctgcagtttctaatctgtcacaaatcattgtgggtacccctactgtagctagatcacctcgtcagtgttaagacaattgcaaggcacagccagtatctggaattttgttttcaccttctgcccataaacattattttcatattatctactctcttcacagtcagagccaaaactttgtcttaattctaaagtactacattacaaaaattttaaatatcttaatttctgactatattgacaaatatatccagcctgcttactcaccttgtttgttcagtcgatctctctatttgtcctgtcctagttctacttatatttctatccaacttagatctcttgggccattatttcaatatttttattgccatttccagaaggaattttgttgactttcttctaacaaaactataattctggaagaggccacgtcacccaatatcaacaaaatgcttataattgcacatgatttatatcaagcttttctaaccaatatttttggaaggtaggcctggctacataatttgctaggactagtgcaaaataaaaatgcaggtcaaaagctttatttttgtacaaacagctgtacttaaaggcattaaaatatgtagctttccccattaaaaatattttataacttataaaatgtaataatgatacatgaaaacaacataaaattccaaaattattaaaaaaaacccaatattataaaatacaatagaaaatagcaccttatgaatgtaaaatcttgattgataaaatattgtcctgaatatttatttattaggacattaaaagttatatatttatcaactttatttttaattggtacaaataaaaagtgatgttattcactctaaaaatgcatggttatgaataatttttgatactttttgattctgagaaggatctgttgatgcaattgctatagaagctgttagagtattttgtagactgttaatatatttagataaattcctttgaagtataaattttagtacttctacagctaataattttcgtggaatgaaatatttttctcaaaagatttaactgtatacaaatctgtttgatataagtatgaatttaattttaaatataaatgtattcaataacattttaacgttctctctgacatttgctgtgtggtggtgacaaagaaaccaaagtcacttcatgagttgtatctaacttaaaatttttacctaaccaccagaggtttggtctaggtcctggtgctcactgcactgaaagatgatgactgagacaacaggtattaccaaggaagaaggctttaaatcaggcactacagccaaggagatgggagctcagtctcaaatccccctctgaggagccaaaactaggagtttatatagcagggaagaaatttaacaatgtgtaagaaaacagcaactagggaggggcaaggaagcaatcacgataaatgagggatctggtatttcattgtctgaatgtggtgatctggtgagtttcagttctttgataagtttttttggggaccagaatatcattttctgaggaagcaactcagataaaacaaatgtaaattttaagttttaaggccagaagcatccatttcagtttatcaaaaacaacaacaacaacaacagcaaacaacaacaacaaacctatctatgggactgttgggtcagtttcaaaatggctgtttttttcttagtgctatattttcaatttaggtaaaaaataactttaaaaatatattcctcattaataatttttatgccatttaaaactgcaaatttaaggaaaatgttgtcaagaacgtcaacacagtgaccgcagagtgagcaagctgtgtctcatgcccttaagccaaccctgttagaagacatggatgcagcaacagtattttttaatctaaatacttttatttgctgtccaaaagtataaatccacaatagaacataaataaataaataaatatatccatcacattacatactttttttttttttgagacaagtctctctctttctcccagcctggagtccagtggcaggatcatatcccctcgcagcctcaaactcctgggctcaagcaatcctcttacatcagcctaccaagtagctgggactactggtatgttccaccattcctggctaatttcttttaaattttatttggaacagatggggtgttcctttgttgcccaggctggtcttggaagcctgggctcaaacaatccttctccctcaacctcttaaagtgatggcattataggcatagaccagtgcacctggcctacatacattttttatttattagtaggaatgcctgagagttccaggccagaaaatcagagacatgtaaattccggaatgccttttttattgacagtaagaataatggtgctatttataagtttgagaaggcataatgattttatgctttgtcatactcaaggaagattagtttttttctctttattttttaaggaccaaaaagtctatattgcaactcaatataaaaatttgcaaaaacttaattctaacaataaactgaatcattttggagaactaacagtgtattatgagcatgaagatatgatgatgacattagaaggaatgttggtctaaaagggataccttggtcctgcctaaaattaaggatcattggttccctaacctccaaacctttccaaatcacacagtaaaagagagtgacatcagtaccttgatctcatagataaactattaattctacattgattttgtctttaattttttctctatttttttaaaggtactaagcctcatatagctttggtgtgtttagcagaatgacacagatgaaacgtggataaatagtagtatgatgtattcttcctcctttcaccccaggatgcatcccctagtattcagatttcaaagttgactgaaatagatattgatatagagaatgcttttgtggattattacttgtttgctcagtgaattccataatctacttttctatatcttgctcagattcatttcctggaaagctgacttctataaactatatcatctaggccacttttctctttgggttgaatctggatttgaaaaatggcaggagttactcagagatagagaaattatttgtaaaatttaagccaccctaatttcctggtaagctgttttcacggttaccctgattatcctaaagtgtacagatcctgacagatcgcagttttccttatatgtttagatacatgctccttatcagatatatgattgcaaatattttctttcattggtggtttgtctttttcttttctcttgacttttattttaggtccaggaatacatgtgcaggtttgttagatgagtaaattgcatgtctctgaggtttggtgcatgaacgaccccatcacccaagtagtgagcgtactatccaataggtagtttttcaactcactccccttccattctccccaatagtcccaagtgtttattgtttccatgtttgtgtccatgtgttctcagtgtttagctcctgattgtaagtgagaacaggcggtatttggttttctgtgcttgcattagttctcttaggacaatgacctcaagctgcattcatatgtattttgaaacatagaagcatggaactgtgaggaagaccatattatcttttttgggtttcttttacttcttgtcattctaagaaaccattctaggaagtcattatcaaattagagggtattcagatttgcccataatagttttctagtttaaatttctacatttaggtctttcacccatttagttatttaatattgtgagaggtaagaatctctatatgtgctatccagatgtttcaacaacatttgttgaaaagactttttgttcattaaataatcatggcactctcatcaaaataagttgaccatagacacattacttatttctgaatgttagatttgattccattgttatacctgtatataaatactggtacctcgctatcttgattactgctgctttttagtaagttttaatattgaaaagtgtgagtcctccaagtttttcttctttatcaagattattttgtctattctagatcccgtgcaattccatataaattttaggattagcttgtcggtttccaaaattgagactccaaaattccaagattgtggtgaatctatatatcaatttagtgagtattgccatcttaacaatattaagtctttcgatccttgaacataggatttttttccacatatttagatttttctttaatatttttcaacagttttgtaatcttcatagagtaagttttgcattatttttgttaaatattttcctaagtattttattctttctaatgctcttaaacataaaattgtaacttcacttttaaattgtttgattaaagtgtctaaaactaaaattgatttttgtatattaaccttgaatcctataatcttgctgtacttattagtattaattttcttctaatggtttctatagaaatttatatatacatatataatatataattatgtgatcttgtgtatatacgtatgtatatatgtatatatgatcttgtgtgtgtatacaagatcgtataacacatatatattaatatatgttatatatgtgtgtacgtatatatagaatagtgtgtgtgtgtgtgtgtgtgcgcttgtgtgagagagagagagagagagagaatggggatagttttcctgctttctttccaatctgtatgtcttccatttcattttcttgcctaattgctctagctaaaacttctagtataatgttgaatagaattaaaaagggtgagtatcattaccttgttcctgatctcaggggggaaaacttcaggctttcaccactgtgatgttagctgtgagttttccatagatgctttttttctcttttttttcttttaagtgggaataattttattttcaaactttcatcttggatttaggaagtacatatgcagatctgttacctgggtatactgcatgctcctaaggtttggggtatgaataatcccatcacccaggcactgaacacaatggtataatttgaattgcaaataattttgccacacaataaaataaattatgtatcaagtagcaaaaagatttcaattttaataataggcaattttcattgttttcaaaattgtatgagggttttaccatttatgaaaacgtttcgcttctgtggttacatcaaaaagaattttgtgatcactttttcttttcaaaaaatatgacacacctgtgaaagatcaaatatatcagacatattcaatgttactattgataagaaatattttttattctgtcactttctacaaagtcaaaaagaatcataaacttaagaggaggtgaaagtcctcttagaaatgttacctcaaataattgaaagaagacatgacatctgaataaatattttactttatttttcattatggcacacttgtatgtactggattattacaattaggtttttgttttcatttaggtagacacaatgctgttatcattaacgttcatattctccagggacagaagaagaataacatacaatgatttttttattgtcaggtgaaatattgcaatgtggcaaccagattacttgggtgaaagtgacatatccttaggagaaaaaatatattcctcacagcaaaaaacttttctttttctttctttcatacccgttgtattatttcctgcacaaatgcaattttaatgtcatatttttaaactggtaaaaaaaatttcaaaagacattcttatttctacccattatatgcttaggaaataacataattcattttctgttattcatacctccaacaacaatgaagaataattttgagcattaaaatataatttttttcattcatttgtcttttatttaagttcaattgttacagtttagttcttacaattgagttgctgcatcaccaggcttaaccaactggtcttcaccatgttacttagagactatatacacaccatcatcctaagatttattaaattatcagtcttattcactaacattaaaactggaaggtaatatgagattgattattcttattaagtgcactgttttgaaataagacaggcattcataaaatttcattgaacagtactataccaaaagcttatttcatattttctcattaatcttattattttcccaaatggacatctgacacagtaaaaggaataaaatatttacatacatatatgatacatatataaatgataaatgtatgacacacatatgatgtatatatatgcctcatatatgtaccatacatgtgcatatgcattatatatatgcatcatagatgcgttattatatatgtgtgtgtgtatatatatatgtgtgtgtgcgtgtttgtatatatatataattttatctaccttccccagtttctccaaaagtcaaactgatgatataaactgggcactggtttctaagagtctgtgcattgcaggccctttataagacaagtgtctgggaagcaactcaaaatagtttcagccaaagaagaaacataatgggtcacaaaactgaggacatgggtggttttgttttaataagatggagtacaagactgtatggaatattgcagacactcttactatctttaatctgtgctattcctgtattctcattgccccatttaagagaccaataagagggtgcagcttggatgagggtaaagtgactgcaggcctctccagacatttttttaaagggagatgtggctaccacatgccctgctttccttactgtgtggcatcatagacatgttatggttgtttttaaattttatatgaatggcatcatagacagtattttgtctttttcctaagtaatatgtttgttaaatggacctacgctcttgtatagagtatctatgttaattgttacttctataggcttgtattagtttgttctcatgctgctgataaaaacatacctgagactggccaatttacaaaagaaagacacttaatgaacttgttccacatggctctggaggcctcacaagtatggtggaaggcaaagaggagaaaatcacttcttacatggatggtagagagagagcttatgcaggaaaactcccccttatagaaccatcaaatcttgtgagacttattcactattcatgagaacagcacagaaaagatctgaccccataattcaattacctcccaccaggtccctcccacaagagagggaactcaagatgagatttgggtgggtacacagacaaaccgtatcattccaccccaccccctcccaaatctcatgccattacatttcaaaaccaattatgccttcccaatagtaccccaaagacctatctcatttcagcattaactcaaaagtccacagtccaacgtctcatttgagacaaggcaagtcccttcagcctatgagcctgtaaaatcaaaagcaagttagttgcttcctagatacaatggggttacaggcattgtgtaaatacatccatttcaaatgggagaaattggtcaaaagagtggggctacaggccccatgcaagtttgaaatccagcagggcagtcaaatattaaagctctaaaatggtctcctttgactccatgtctcacatccaggtcatgctgaggcaagagatgagttcccatggtcttgggcagctccacccctgtagctttgtaaggtacagtctccttctcggctgctttcatgggctggtgttgagtgctggcgcttttccaggcgcacggtgcaagctctcagtggatctactattctggggtctggaggatggtggccctcttctcacagttccactaggaaatgccccagtagagattctgtgtgaagggctccaaccccacatttcccttccacactgccttagcaggggttctccattagggccacacccctgcagcaaaatttctgccagggcatccaggcatttccatacatcttctgaaatctaggtggaggttctcaaaccccaattcttgacttcgttgcactcgcaggctcaacatcatgtggaagctgccaaggcttggggcttgcactctctgaagcgacggcccatgctctatattggcctctttcagccatgcctgtagcagctgggatgcagggcaccaggtccctaggctgcacacagcatacagaccctgggcctggcccaagaaaccattttttcctcctaggcctttgagtctgtgatgggagaggctgccatgaagtcctctgacatgtccttgaaacattttccccattgtcttggggattaacatttggctctttgttacttaagcaaatttttgcaggcagcttgaaatttctcctcagaaaatgggattttcttttctagcacatcttcaggctgtagattttccaaaattttatgctctgcctcccttgtaaaactgaatgcctttaacagcacccaagttacctcttgaatgttttgctgcttagaaatttcttctggaagataccctaaatcatctctctcaagtttaaagtttcagaaatatctagtgtaggggcaaaatgccgccagtctcattgctataacataacaagagtcacctttgctccagttcccaacaagttcgtcatctccatctgagataagctcagcctagatttcattgccaatatcattatcgacattttggtgaaagccatttcacaagtctctagagagttccacagtttctcacattttcctgtcttcttctgagccctccaaactgttccaatctctgcctgttatgcagttccgaagtcccttccacatttttgggtatcttttcagcagcgacccactctattggtaccaatttactgtattagtctgttctcacgctgctgataaagacataccaaagactgggtaatttactaaagaaagaggtttaatagacttacagttccacatggattgggaggcctcacaattatggtggaaggcaaggaggagcaagtcttattctacatggatagcagcaggtaaagagaaagcttgttcagggaaactccttcttatataaccatcagatcttgtgagacttattcattatcacgagaacagcatgggaaagacctgccttcatgattcaattacctcctacaagttctgtcccacaacatgtgggcattcaagatgagatttgggtggggacacagccaaaccctatcaaatatcaatgctataacattatatcaatattctgcattatatttatgcatttcaatttgatacattaggtagttcccagatttaggacattatgaaaaacattgttactaatatagcattactttttttggtggtgtgtggtagacatgaagacatcacacctaggtcacacttcaaggaagacatctatgtagagcttcagagaatgcagtcactgaacagactccaggtgtcaattccttcaggaccagcctcctatgcagaaagtcaccttgcccaaagctctaaaagtttgaaaatttggtttgatgtggtacaaagatgatgagcaatttcattgcagagatcccctctgggtgacagaggctttcttggtcctgcagtttgtctaatccagcttgctttgttcccttttcccttactgatgttgactcttaaaaagtatcttgtactccaagctctgactcacttcctggagtggtcccaggaaggaaggaataagatggggtttgggaattgcatcactcactgcgcaggttgcaatgaagaacccatcactgctgacagagcacactgcccctggcacaagtgccaagccagcttttaaacctttcagccatggtgaactgggagggtttcccagtggggaagaatgcaatagctgatgtgatatttgaagcacttgaagcatgaaaaagcaaaatatctataagaataagaggattgatgactattgctaaatctcattaatgctaacaatagctgaggtcaacatcccccaaaaaactcaaactttatttttctagttcctcaatatgaaccaggctttagaaattgatctcataactaaaaattactgaatcccaggcagaaggactccaaaatattatggcaaatatgtgatatactgattcagtgcttctccaaagggacatatggccatttacttagagagctataattagaatccattgttcttttcccatatggctgcttggatagagttaaaagaccctgctaaaggcatgaagaagttccatctgagaaggaatactcttaaaatttggtgtgccatactccagggtgaactggatcaaaagaaacaaatcaagggatggaagtgagagtttgttgaatcatgtaactttttataatgctatataatcaataaaaagaatacctggtcagaaaactaagagatgaaagcagaaggagtccctctaagcaccattctcaatgacctgttggggaatttatgcttcccatccctgcagccctgggatatgcagggttagagtttcttatcctcaaatgtggcacctttctactggggacataagaaagtcagttgaactataaattatggttgctccctaggcattttgagatcttttgttttgttttatcaacaatcagaaaatagaaaattgagttgtaattttcagtggacttctgttacaccaaagggcaaggagaaatccaagtgtaacccacatgatccatttgagcccactactatttctttgtccacccatggtttaaacaaacagatacagagactttggtataagaagggcatggaaatcaggaactcaaacccctcaaggatgcaggtctcacctccaggtaagctactaaggtcaagcagagctatttgctgattgagagagatatagaatggttaatggaaggaggagaaaatgggtgtcaattgtggccctgacaataactgcttcagttagtttcttttctcttagttttccctcagaagagaaagaaatgcaagaaggagtcctgggaaagcttttccctgaaaatgtatatgagaatgtatttgagtgctgcaagagatcaactgctgtacacaagaagacatgccacacagcaatcctttcagagacattcttgctgggttctggaatctcttttcctctcatgcctttatctgtttatctattcccacattgattacgcagtatggtatttgtgtattaaaataagatgtgatttttagtaatggaatttctccaggtttgttatatctctttaagattatctgggctattttgagccctttatatttgcatataaattttagagaaagtttatcaatgtatgcacattaaaacaaactctgaggaaatattttctgaagtggttgtgggattgcatgcatttataagcatatttggaagaaatgctgtcttcaaatctatatttatgtacaggcctcacagacctatttatgtattaatatctttcaggagtatgttgtgtttttcatcatataaattgttcctatcttttgttagatatattcataggtaattaatttttatatgattgtaaatggtaaaatttatcattttattttctataactttctgagttttgcaaatgcaattcatttattttgcattgctcttatcttttccaatattattgtattaattgattaattctaatatttgtttagtgtactagtccattctcttgctgctataaagaaatacctgagactgggtaatttataaagaaaagagttttaactgactcgcagttccacatggctagggaggcctaaggaagcttacaatcatgagggaaagcacctcttcacagggcagtaggcgagagaatgagtgcaaaaaggagaattgccagatgcttataaaaccatcagatcttatgaaactcactcattatcacaagaacagcataggggaacctgacctcttgattcagttacctcacctggtcctgcctttgaaatgtggggattacaattcaaggtgagttttgggtggaaacacagagctgaaccacagcacagagaatcttttggattatttttattcatattattttgaatgaggaaacaccttcacgatgtttctgaatatattatacattgaattttttgggtttttttgtgttgtgctatcttagatcactggcacaaaattgaacagaagtagtgaatgtgggtatcagtgtatttgtaatgataattcatgatagttttctgtatggatgcattaaaaaggacattttatttttttaaaatttgctttgcttttaaaagttaatatttgttaaatttcatcaaatatttgaatacatctataaagacagtcatacatatttaatttcttatgtgatcatgcagaaagattaacattaattctacattgtctttgcattcgtgatttataaaacagacatctgtaatttaatactaatcttatttgtttctggatttttatttacaaatgtttcatgtaatttgttttgatgtgtatacatatactctatgttcttgttggattttgttatcatggttctgctggcttcacaaaaatactttttaaatactttccctgtttcttcactttagaagaatatgtgtgaagttgctgttattttggcaatagctattaggaaaaaatcactgataaggtaatctgtttgtgggaatgttttggagaaagatattaataataggttcaacttctttaactggcataatataaggtacaagtaattttaagttgccacacaataaaaagaacacagaacatacgcaagatgcagactgtgacagcatcattggatcagcctcctaaactctggcttcactgagcatgtcattcctctagactcagtggctcatgcctgtaatcccagcattttgggaagcttaggcgggcagatcgctcgagccccgcagtttgagatgagcctgggcaacatggttaaatcttgtttctactagaataaaagaataaataaataaatacacaaaagttagccaggcatgctggcatgcacatgtagtctcagctactcggaaggctgaggatggcttgagttcaggaggtggaagttgtagtgagccaatattgcaccacttcactctactcttggcgaaagagatagaccttgtctcaaaaaaaaaaacaactaatttttcagttctcttgcttatcagataccaagagttagaattgagaatatttataggattttaaaatgaaaatgtgatatagttagtgagttgaatgatatcttctcaacatatatggtcacctgaaaccttttatttagaataagagtgtttgcagatgaaatgaaggatctgaagaagagttcatccaagatttagccagaccctaaatctaatgagtttcctcataaggacagaaaagaagacacaaagatagacagagaacaagtgaatgtgaagatggaggcaggaattgtagcaacgtgtctcagccagggaatgctacagattccaggaaactaccagaaactaggaaagaggcatgcacagactctccctcaaagccaccaggagaaagtcattcttatttcaggaggcatctgacctcctgaactgggagataatgaatttctattgtcttaaaccacaaagcttttggtaatttgctatagtggccctaggaaactaaaatatgacccttcatgtatagatgataaaagacaaagtaactttaaggttctactatattgaaaaatgtgattagttcttttccacccagtagtctcttgacaaatccctgaaggcattatatctgttctttccttccacagagaaactatttgctttggaggagagtttgttttctcaaaaaggaaaataatccattgaacatgtaagcctctgatccttttttttaatccacaggagaatcagaagatgattttgccatgactaacaccctgccgatgacagaaacaaataactcttaaattcttatatcctgtctttaaacaattgaaatgcctttgacaattgacctacactgcaaagtatgttttccactcttgattgtattgatcagtaaataaagccagagccaaactctgtgcctttttcttgcttagaaaacctcaatataatccttgaccatttggaaaataaaataatggtgaggattgaaatgatttttaataggtaattcaccagttttaaaattttcattttacagaatagtcttggcttcaggcacatagataacttgtttgattattcaagttgcatattgtaattagttatttttgtttaaatgaacctggtaaattctgtttaattatttttttaaaagatggcctggaattaaatcttctctgtttcagaataccttctctttattatctcagagtagcattagagcatttgatcattgtgactgtttgtaatgcataaatgatgagtccggtgacggcttgtacacttttattaaccgaaattacatgcaccccatagaaaaaccaatacttgaaactaatgaagtctctgatgttttgaatattttttgtacaatcaagtgcatgtgtatgttcattttgctagtccaacgggtatctgaacctcaaaaggcaaagaatcccattaatactagatgcaatttgagaacagaagcataatctttgttactgagatttcaggtggagcatcccacagcatcagactttgttaagatcaaataagagactacattccaagacaattgagagcatatatcctagaggcagaaaattgttaacctacatagatacaccctatcatcatctctaccactactatgatagtaatattctggaattctggaattctgctgatgggaagtacttaaatcttaagtttacctggtgtatcatggtacatgcactttgcgtcaatctttaaatcttctatttttcaaatggtcgtagttctgaaatgggaatcctgtaacctgttaggtaaatgtgatagttactaacttgaacaactagtaaatgtggagcgcgcaaatatcaaaataaaaattggtaacacaaattctataatgtcaaagagaatcagagaagaaataggacacaaatatttcttatgtccctgagagcaaaatgctctcatgcatcacaaatatttgaagtacgctatccaccactaatattgaagtaccaatgtgaggtaaaatttgtggtttgagaaaaagcaaacaaaaacaaatggaacaatcttttgatgtatatgcacgtgtcttggtctatttcatgctatcataatcgaacactgaagactgagtaatttagaataaacagacatttattggtttacagttctggaggctggagtctattatcctgatgctggcacctgtgagggcctttttgctgcatcatcaaatggcagaaggtgaaaaggctagaagcgcaagagggggctgaatttctccatttataatggcacaaatccacccatgacggtggagccttcatggcctatcacgttttaaaggtctcacctcttaatactgttaaatggtgattaaatttcaaaatgaattttgaaggagacaaactttcaaaccatagcagcgtgcccttacaaataaaaattgcacgtgttttcatttagtatttataaggccctcactctatatcctacagccgccttttctatacatggcaatgtgaaggtaggggtgtggaaggaaataattggttgtctatgaagcttgaaaggtttagaaaaatacttatcaagccaagaaataatacagtggcatacaaaataataattaaaaattcaaagattacacaaggacaaccaccaccacaaacatgtaatacctgtaagctatgccttttttttttttactttgctaattggaaatcagatatagtttatgcaacgaaccaagtattcaaacacaatatgagagaaaatctaaaatgttcttaattgttgaagttgtccatattttacaaattcaacatggttatagtttctgaaaagtacctagggctctaagtaataagcattgcctagtattcagagtaatatacatgcactagactcaagagtctagcatagctcctgtacatagcatttcttcccttaaaagaaagagttaccaagctgtatgaaaatcatgtgatcctttaacttctctctgcatttaagtaattaagatcgatttgagagtgagcatggtgacactctcattgtggctattcattggatattgctagagcaaagcctgtaaggcatctttaaggacaaggagctccacataggcagatgacctatttttataggacattcttttacgttctaaagtcaagagaaatattttaagaaattgacattttgtttctctcttgagcacttatgttcaatgaaataaactactgtttgtttctattgcttaccatcttcctatgagttcttgcgtgaaaaacagctgatatttgcctagtttgaaattttaatcgtgaatataattgttttcctactctgctaattctaactaaattgtgatgagtcaaaatcattttaaagagagaatatgggggttgcattatttttcgtagaaaataaatccacagaggacatgtaaatcccatgaattccagcttgttatgaattgcttacaaagtggaaagactgtagagtaactaatagttagcaatgattacaaatttcagatggtttatgctaatttccattatttatataaatacctctatctgggcacatgtacaattggaatccttgttagccataattatttgctgcaattcataggtgggtgttcacatcaagtgttttttttcctgcttcagtgaacttcctcagagcttatttatgtgattaaaaataatctggttctgagttctcttgaaatggtttattgtttttctctccaatgtaagtgcaatgtacaaccatcagccgtccctaagaaactaaaattgtttgatttttttatgtgctaagagaggacactcctcagcccttgggtggtcgacgggactgggcgccgtggagcagggggtggcgctcgccggggcggctccggcagcacagaagcccatggagggggtgggacgctcaggcatggcgggctgcaggtcccgaaccctgccccgcgggaaggcagctaaggcctggcgagaaatcgagtgcagcgccggtgggctggcactgctgggggacccagtacaccctccgcagccactggcccgggtgctaagcccctcattgcccggggccagcagggccagccggccgctccgagtgcggggcccaccaagcccacgcccacccggaactccagctggcccgcaagcgccgggcgcagccccggttcccgctcgcgcctctccctccacacctccctgcaagctgagggagccggctctggccttggccagcccagaaaggggctcccatagtgcagcggtgggctgaagggctcctcaagtgccgccaaagtgggagcccaggcagaggaggcgccgagcgagggctgtgaggactgccagcacgctgtcaccactcaccgtgagcccgcactcctcagcccttgggtggtcgatgggactgggcatcgtggagcagggggcggcgctcgtcggggaggctcgggccgcacaggagcccacggcgggggcggggggaagctcaggcatggcgggctgcaggtcccaagccctgccccgcggggaggcagctaaggccccgcgagaactcgagcacagcagctgctggaccaggtgctaagcccttcactgcccagggcaggcggggccagcaggccgctctgagtgccgggcccgccgagtccacgcccacccggaactcacgctggcccggaagcgccgcgcgcagccctggttcccgcctgcgcctctccctccacaccgccttgcaagctgagggagccggctccggcctctgccagcccaggaaggggctcccacagtgcagcggcgggctgaaggactcctcaagtgccaccaaagtgggagcccaggcagaggaggcgccgagagcgagcgagggctgcctgccagcacgctgtcacgtctcagcaatagactgctcttgaggtaagcagtaagaataaaaaatgaaatcaagtcattttgcttagtgtactacaacaatagagaatattttctttttaatacaaaggttatttaattttccagagtaactctattgcatccagtggtgtaattctcaattcataaggatgaagagaagttacctgtgacctattacgtaatttataaacctcttcttacagagaatgatgtgtcttagaggaataaaagtgaggcattttattttcttcaaaattaaatattaacaattgtcttatactgatcatgggaaaagtaagctgctaccaccaattccaatctgtatgaggtacttttatttaagaattataactaatgattcaagaactaacttaagtcctattttatttacaatgattcctgaatgtaagaacacctactgcatttgctctgtatccatgtaggacctaattagaaagctgggctccatatagaaaaaccaatgaatattttttgattgataactagccaaaatgacagagttttccgtctgtaagcatacaaacatgcattttattttgaactttcattttgttataattctttatgattttatcggcaaaaccaacaaaataatacattgttcttaaaggaacacatgctaaaacagaggtacattatacatgtttaccaaaagtactgtagggttgtttttacattgaaaaatgcatttgtctgtatcctttggaaaatcaaactgatctaatataatttcattaagtctttaaacaaaaaatactttagaaatgtatgcaactaacaaagggaagaacattttatgctcatggataggaagaatcaatatcatgaaaatggccatattgcccaaggtaatttatagattcaatgccatccccatcaagctactgatgacttttttcacagaatgggaaaaaactactttaaagttcaaaaaagagcccacattgccaagacaatcctaagccaaaagagcaaagctggaggcatcacgctacctgacttcaaactatactgcaaggctacagtaagcaaaacacagatatagaccaatggaacagaacagagccctcagaaataataccacacatctacaaccatctgatctttgacaaacctgacaaaaacaagaaatggggaaacgattccctatttaataaatggtgcttggaaaactgcctagccatatgtagaaagctgaaactggatcccttccttacatcttatacaaaaattaattcaagatggattaaagacttaaatgttagaactaaaaccataaaaaccctagaagaaaacctaggcaataccattcaggacataggcttgggcaaggacttcatgtctaaaacaccaaaagcaatggcaacagaagccaaaattgacaaatgggatctaattaaactaaagagcttctgcatagcaaaagaaactaccatcagaatgaacaggcaacctacagaatgggagaaaattttggcaatctgtccatctgacaaaaggctaatatccagaatctacgaagaacttaaacaaatttacaagaaaaagtcaaccccattaaaaagtgggcaaagtatatgaacagacacttctcaaaagaatacatttatgcagccaacagacacatgaaaaaaatgctcatcatcactggccatcagagaaatgcaaatcaaaaccacaatgaggtaccatctcatgccagttagaatggtgatcattaaaaagtcaggaaacaacaggtgctggagaggatgtggagaaataggaacacttttacactgttggtgggactgtaaactagttcaacccttgtggaaggcagtgtggcgattcctcaaggatctagaactagaaataccatttgacccagccgtcccattactgagtatatacccaaactattacaaatcatgctgctataaagaaacatgcacaggtatgtttattgcggcactattcacaatagcaaagacttggaaccaatccaaatgtccatcaatgatagactggattaggaaaatgtggcacatatacaccatggaatactatgcagccataaaaaaggatgagttcatgtcctttgtaggggacatggatgaagctggaaaccatcattctgagcaaactatagcaaggacagaaaaccaaacaccacatgttctcactcataggtgggagttgaacaatgagaacacttggacacagggtggggaacatcacacactggggcctgtcatggggtgggaggaggggggagggatagcattaggaaaaatacctaatgtaaatgatgagttgatgggtgtagcacaccaacatggcacatgtatacatatgtaacaaacctgcacattgggcatatgtaccctagaacttaaactataatttaaaaaaaaagaaatgtatgcaacttcaaataaaacaagaacatttaattctgagttcatgtaacgatgttaatgctcaatgttttcacattttagtgaataaaaattttccttcaaaactgtaaaacaatttaaatttacatacacctctaacatttgtgaggctcagggaatgagtgtaagtgaagacatctacactatatgccaaaaatttaaggttataaatcaagctaagaaacaattaaataaaatatgcttgtcctcctaccttaacaaatgagacttcagtgttgaaattgaaaaatgtatgtaaagttatctgtgtatattacttctagacaactatcaaaaataattgaatgtaaatattaatgtccatagttgtactgatagccaagaatgtggtgaaggatgtaatttataagtcattttatatttatagtaagcataatttttctttgcctttccacataagcaataattaggttattaaatctaggctgttttcacatgttttcttctatctatatagcacatatataagtgcttagattacaatcgtattagaggtgtacaatattttcccaaaaaatataaatggaatgaaatatttttaaaaatataagaaacaatgtacgttattataaaagtcaatattcttataaaatacctaaattaatattaaaatgtaataaaataaaactaattttaaccattttaactaaatatcattgaatacttttgtaaaataaaactacaatttcacccccaaatgtctctctaattttcaacataagttattagcatcaagctttatgcattttacatataaaattatatatacatagatttcagagagtaataaattgttgaaaagtatgtatgttccttactccaattcttacacatgatgcattaatttttgaatagtgctacaactaaaattatagtaataaagagattcaagatacccatgttagcatttttagatgatactacttaaggaaatatatatttcattggtgcaatttcagtggaaggaaatgacaattattattatttttttcttccttcctaattgcttctgccactaatagcctcctcacactttgaatcaatatccatctctaaagtctatcggggcacaaaccacacaaattcacagaatctagacgagatcacaattttttttttgttttgaagacacaggacttcaaggacatgtaggaggagaaaaaaaaatactgtggggctgggacagtgtgaaacatgactgtttttcctttctttctttctttttttttttgagacagagtcttgctctgttgcccaggctggagtgcagtggtgtgatcttggctcactgcaacctccgcctctcggattcaagcgatactcctgcctaagcctcccaagtagctgggactacaggtgcgtgccaccacacctggctaattttttgttttttatatatttagtggagacgggagtttcaccatgttagccaggatgatctcgatcttctgacctcgtgatccgcccacctcagcctcccgtagtgctgggattacaggcgtgagccacggcgcctggccatgacatgtgtttttagggctaaagtcactctgcgtcagtgttgtatgttagacacctagtgagagactatgcttgataaatgcatttttttgagtttgtgatatattgaacccttgaaatcatgaaacccaaggcagaggtacctcttgcataggtttaagtaagtattaattacacgcatgttattgagcaaacgttgaacggagggacactggatttttactcaggtttctataggtgattaagattcactaacaaggtaaacaaagtataaagatatattagaaattttcttagtgtcttcaaaactagctttaatgggataagaactcactccagaaaacatagcattggcaagtcaagtttcaaaaatatgacactaaaaacattcaagctgagatccaaataagaaatgcaatctcatttacaataaccacaactagaataaaatacctaagaatacaactaaccaacggggtgaaatgtctctatgaggagaattacacacagcacaactgaaggaaataacaggtgacacaaataaattgaaaaacataccatgcttatggattggaagaatcaacgtcattaaaatggccatattgcccaaagcattttaaagattcagtgctattcctatgaaactaccaatgccattttttacagaattagagaaacaattctaaaattcacaaagaattgaataccccaaaatgaaaacatgagtacaaggaaattttctgtgtggaacagtggcatcaccagcagtaggaatttgagacccatctcaatcttggtcatgaaatcaaccagaacatgccaatatcaagggaaatgttctattcttagaaatgtttccactgacctgtttgcaaatatcttcttttttttcacaaatatgtttattgcagcattatatatatgtaatagtataaaaatgaaaaagtataaatatgtatcctatatgggtgacataatattttcctctacagatttccatacagaggttgcaaaccaaaaaatgtaacttgtataataaaatttttaatctttggaagtacctagatgttcccttggaagattccatgcccatctgacaaataattaaacagtttaatttttatcaattgtttaaatttttattttatttatacttgcaacactatttgaggatggtggcaatagcagtagaagtaacagctctgttttcaattctaagtggctttattctacattgttttctaaaacattctttcatctactaaatcatgaacatattctcatgtaaatacacacatacaaacaccgtttcctcctacatattaatatcccttttcactctctattctatcatgtatttgtgtgtgtgtgtctgtgtgtgttggtatgggtgtaattttcagtatccaaatgttttacatatgtataccttctgatgtgtgcttttgatggattgggggtgttaagttgtgtttttattctctttttggagtctttctgtttttagaatgccggctttttactccatattcttttatttgttttattagtaaattagtacatttgtgctggtacctagtgagaagaatctcttgaatgcatttagtttaattttatctttggaataacatggatttcccttttgcagcttaataaataacttgaattatgaagaatgttcttttacacatactagatgcaactactgctccatgagtggttttacagaagcatttcattatgtctgcaaacatctttacaattattgagacaccatctcccaaaaagcgctcttctgcctttgagtgtaagaagattggtagttttgcacactttgcaccatattttttatgtatatgccttttgtttgggggggatgataccatttttatgtgactcttaattagatacattatatgtagaaaattgtgtgtatattgctggccactttgtgtttctgacaaaccatagtaacttggaattgaatcatgaaagttttcagaagtctctaagtttttaacctgaaaaatctgtatgtaattctctcaaccataagcttccaaaaaatttaggttgtgttatcttctaaatttatgaaagcttgttcttcagtaacatttttgtctatgttattatccattactctttatttttctcgttttagtttgtgagtagaacagccgtgacatttattttcaatcctagtgtgaaattcctcgggcctctcaattagtactaactaaaaatgtgttttacttatcctctcaaaagttacagtaatggctaagaagctaaaccaacccatgttctccttggagtttgatgctaaaccagcaaagctgatattttcttgaacccccctttttttgacactattgactattcaagaccattccagtgaccaagatttcttgtttgtttttagatgacatttttataggtatgtttaaaatgagaatgtaaaatgtgtagatggaagattctctcttcctctcgttgattagccttcactttcttgtaaatattctttttctcaaaagcctgtgggaaatcacaggagatattttttattgcacatgtcacatgtgcatggtttaactcacaaatgtttgaggcatattatgacagcaaagttatatggcagaggacaagcaagtatatacaaaaattgagaaagtaaggatttttaacatgccacattgtgaaaatttacgtataggaggctagcgatgaccagtgatacactccaataggtagatttcaaatttatgagactattttgaacacattgttccaaggttgttcataagtacagcacatttgttcttctggaaggtaaatcttttgttatttaattcatggattagaaaaattgtttgaaaattctattactttttaaaattaaaaaatcaatcataattttatattccaatcctatctgaaattgagttagatcatttctgtattggttgctttttatgcatctattttttaaagtattttggaggcaatgaccttaacaacagattctagattactttgccattgttttccaattctcaaatcctaatcagtcaattgagagcaggagtcatacttcatctgcatttgtaacttgaacatataacaaaatggcctataaatatagaataggtaaaaagcaagtaagacaagcaatacttttgcttaattagaaatgttttttaaaaactttaagatatcctggaatggttcaaatactgattcactaatatattgcaatctagaaagataaaactcctagtgtgtttattctgtttcagttactaagacacatggtaaagaaattagttttagtaaattatcttttacaggggatattaagattgtgtgattatagagtgttttttttaagaagtaccaaatataactaaactttaaatatttaatcatattttgttcaatatcaatgtaaaatttatttaaatcttacattaaagttaaaagccatgttaaataaaatattatttatgaaaaacaattataatatactatgaaacatttgcttttaattcagctatgctaattattttttccattttaaaataaatataaatcattgtcatcataaaatagttttcagccaggtgtggtggctcacacctgttatcccagcactttgggaggcagaggtgaacagatgacttgagatcaggagttggagatcagtctggttaacatgatgaaaccccatctctactagcaatacaaatattagccaggtgcagtagcacacctctgtagtcccagttactcgggaggctggggtgggaggatcacttgggcctgggaggcagaggttgcagtgagctaagtaagattgcaccactatactccagcctggctgacataggagacattgtctaaaaaaaaaaaaatttttctcttaaaagttttatattatatataattaacataactattttttatatttatgggatacagtgtgatgtttctcttttttttcatttttactttttgtggggacatagttgatgtatatatgtatggggcacatgagatgtttttatataggcatgcaatgcacaataattacattatggaaaatgaggtaaccatcccatcaagtatgtatcttttgtcttacaagtaacccaattatactcttccagttattttttaaatgtacaattaaatgattgttgactatagtcaccctgttgtgctattaaatatacattctttctaacaatatttttttgtagccattaaccatcaccaccttcccaccaccccacacactacctttcccagattctggtaaccatcgttctactctctatatccatgagttcaattgtttggaattttaaatttcacaaataagtaagaacgtactatttctgtccttctgtgcctggcttattttacttaacataatgactttttgtcatatccacactgttgcaaatgacaggatctcattaattttatggctgaatagtactccaccgtgtgtaagtaccacattttctttatccattcatctgctgatggacactcaggttgcttccaaatcttagctattgtaaacaatgctgcaacaaacataggagtgaagatatcccttcaacatatggattttctttcttttggcttatatgctgagcagtgggattgctggatcatatgatagctctatttttattgttttgaagaacctccagactattctccatagtgattatactaatttacattcccaccagcagtgtacaagggttccttttctccacatactcaccaacatttgtgttattacctgtcttttggatataggccattttaactggggtgagataatatctcattgtagttttgatttgcatttttctgatgatcagtgatgttgatcaccttttcatatgcctgtttgccatttgtatgtcttttaataaatgtctattcaaatattttgcttatttttaaatcagatttttagattttttttctactcagttgtttgagctcctaatatgttctagttaagaatcctttgtcagatgagtaggttgcaaatattttataccattctgtgagttgtctttttactttgttaactgctttgtttgctatgcagaagcttttgtacttgatgtaatctcacttgtccatttttgctttggttcctgtacttgtggggtattactcagggcatttttgtccagattaatgtcctagagattttccccaatgttttcttcttgcagttgtatagtttgaggtcttagattcattttgatttgagggtttttttatattgcaaaagattctgtaggtatgctgcattatggtttatgcttttttcttttgtctactctgtgtattttcaaaaatagcctgtcttcaatctcactaattatttcttctgcttggtcaattctgttgttaaaagactctaattcattctttagtatgtctattgtactttttagcttgagaatttctgcttaattcttttaaattatttcaatctctttgttaaatttatctaatagaattctgaattttttctctgttttaccttgaattcctgtgagtttcctcaaaacagctattttgaattctctgcctgaaaggtcacatatctctgtctccaggattgatccctagtgccttttgttttttttttttttgacagagtctcgctctgttgcccaggctggagtgcagtggcgcaatcttggctcactgcaagcttcgcctcccaggttcacgccattctcctgccttagtctcccgagtagctgggactacaggtgcctgccaccatgcccggctaattttttgtatttttagtagagacagggtttcgccatgtaagccaggaaggtatcgatctcctgacctcgtgatctgccccctcggcctcccaaagtgctgggattataggcgtgagtgactgcgcccggcccctagtgccttttttagttcattttgtgatattatgctttcctggattgtcttgagacttgtagatattcctatgtgtctggacattgaagagttagatatttattgtagacttcgcagtctggttttttacctgtccttcttgggaagaatttccagatattcttaagaacttgagtgttgtagtctaagctgtatctttttttatggggaccccaagtccagtaattctgtggttcttgcagactcctggaatctaccatcatgatagtctttgataagatcaagaagaattctctgtattaccaggcagagactcttgttctcttcccttcctttctcccaaacaaacacagtaccactctctgttctgagctacctgaagctaagggtcaagtgacacaagtgcccctgtggccaccactattagggctgtgctgtgtcagactcgatgccaacacagcactgggtgtcactgaaggcctgctgtaaccactccttggctaccacctatactcactcaaggccctgggcttctacaatcagcaggtgacaaagacagctgggcccgtgtccttgcattcagggtggtgagtttccccagaacctgggtagatccagaggtgctttttgggagccaggagatagactcaaaaccatagaagtctgctttttcaaaggtacatggttgagctggcactcaaaccacaggatgcaatccttcatactctttattcccctttccaaaggcagaggagcctcacttcatggccactgccaccacagacccacagggagtactgccagactactggcaatgctcctgtaaggcccgtgggctcttcagtcatcctgtggtgaatgctgcctgcatggtctaggactcactctttagggaagtggtctcctctgtggcccagggctggatcagaaatgctgtcaaagagtgaaatcctggaactggggacccaatgagcttgcttggtgttctacacctctgtggctgagctggtacctgaggtgcaaatcaaagtccccttcacttttcctccacttttcgcaagcacaaagagtctcaccccatagtcactacagctgggaatgtgctgagtctcacctgaagtcagaaagtctcagagtctcactcaaggccttcaacatagtatctggttatcaccattcttcacacaattagaaaaaagctatttaaaaattcatgtggaaccgaaaaagggcccaaatagcccaggcagtcttaagcaaaaagaataaacctgggggcattatgctaccaaagttcaaaccataccacatggctacagtaaccaaaacagcatggcaatgttatgaaaacatgcacatagactaatgaaacggaataaagaacccagaaataagaccacccacctacatctgaacttcaacaaatctgacaaaaacaatcaatggggaaagaattccctattcaataaatggtgctgtgataactggttagccacatgcagaatattaatactggacccattatcttcttatactactccaagaaattatatgaattaatttaaaaaatctctatgtcatcatttttcataaatattatttattaggattattttcccctgttggaggattgtgatagcattaatacaattcaattgtttgtgatggatatctgcattttatcttaatggcataccttatcataattttaatgacatactttgttttttaaatttaatttgtgtcaatttttcatcattacacattatgaatgtgcttatgtttttaatctcttttttcctcaacttaatttctaaacaaaatcaatttagtaaacataaaacaaatttataaaacatttgaatataagcaaaaatgaaaataacatcacaattgctcattgaaaaagatttgtttaatctagaaataaaaatgatgtgctaacatttttgggaatatctatgtcattattatcaatgtctgtatcttacagcatcttgtttgtacatctatgtattaaagagcccaataatgcctatatatgtattaagtaatcatatttatgcatatgacaataatttgttttatgcaaacacacacaaacatatacacactcaaataaaatacaacataaaccacccttcaaaatgacaacaacctggttttcagtttgttttcaataatctttgaagagaaaatatattgcgatatatccatgcttagtaacttttattttgaaaccttttattgatagctttttaggacattttagagaacctggggaagatttcttttcagtacttcggaatcactcaataaaaattaatcaactgtgattaaatgataatgccattctgagcttagtgactgcaaaatagatgtgtaattaatgaggacaaacttctaatagacatcacaaaggtaagcagctatagaaaaagtctagacaccaggatattttagatttccttctaccctcagtcctgacactcaactttttatcccaatttctctactcccccttattttttactctcttcttcccttccctgttagttttttgtcagtctcatccagctcaacacccttgctaaatttttgaaaagtctatttcagctctttattgcctacatccccaacttaggatttcttctaatcatgatttagatctccattaatccccatttatcttgatttccaatgggcagagaattttacctttaaattattgagtgtaaacaaataaattatattactgagagatgtttggttggagatacatctggaatttttttttctgaatgtataaaagagaagaatagtttagaattataaacagagttaagagtaatttattcaattgaaacaatactgatacatcaacttttatttactttctgctgttatatttccagctatacatgttacaaatataacatacaattcctccccagagtgctaatagggaaataatatatacatatacaaaggcagctaataatattattggattatccaaatatgtatcaaattgacttgtgactttaaatgctataaaagtttagaatagggtaagagactactatacatttttttccttttcaatcacagttaaattggaacatattttagattatcataataccacctagagaggcataataaaaattatttcaagctctcaggtttgataaataatttgtatttcatcttccacagtttctcagaaactctgtcaaatagtgtttgaaaatcttgaaatgtcctataatcctagtactttgggaggccaaggcaggaggatcgctgggctcaggagttcaagactaacctgggcaacatagcaagatcctgtgtctactaaaaattaaaaaatttagtcacacatgatggtgcacacctgttgcctcacttacttgggaggctgaagttggaagatcgcttgagcccatgaggtcaaggctgcagtgagttcatgttgttgagcttattattagcctgcatatacactcccatggcagcatttttcatgaaattcttgtgcaagcgccatggtagctcaaaacagaatggttcactatctttggtataagtcatcctgtccactgtgagtcaatgcttctcctgcagtagatgctctttggtgaaaattaacatgtgttataaagattcttatatattttgccaactctcatgtgcccactcattcaccatagccaaaatttcctttagattaagatcccttggcatttttttctggcctctcttcccattgttccaaatcctgggattaagttactccatttaccagctgctattctggatttctacgatctccattgtcactaggatctataataacatcccctacatgagctgcagatagctgtcacctgaagaggatagttaggcactagtgagcatgtctatgctaccattgcctttttggtaacatatttcttactatattaattctatgaatgtcttctggatcctttcaagaaacagaagcatctgttgccttctccattattgtacacttaatttgtttgagcatgctgaattttttattctttcttcagaatcctgcaaagacattttggtatttccaacttgtttaatatgggacataatttttcccaaggttccaacagccagcccagtggcatgttagtattgctcccactggtaacacattttatcatggctaaaggaaatttcccaacgtcaaagagctctccattacttaacattaaattttacctcttggtctattgccctcaaggtctcctctcaagtatgctctctcagttcccgtaggtatgcatctatgaggtcctgaagctcccttggagaataattcccttcttagtgtggtcagaacattcctgattactacttgttctaattaactaaccctagatattggtattagctgagagctaaggtagggaaagtcttgaggagggcaaatacagtcttgtaagtcatctgccccggttgatgcctccaagaaaagcttcttggtagtccagctataattctctaacaaaggaaggagctcactcctatttgcccaaatttttcaggaaaatgtgatgtgttcattgctataggtttgacaaaatacagagatccacatcccaatttcagtgtcatactcttgtaaagaagactggctaaagataaaagtccacatttacctgaagctcttctactcatagaattagctatgataggtatgaggtctggttttcaacatgattgcaaacctggctagtggagatgattgtctctttaaatgttaatgtggaagcctactgacttttccaacatgccttataatggattatgctggcaatatcttttttatgttttaatggagctcagtaactattagcccatttcatagaccttatagtgtcaatttgcctgttttctccaggccatatccactgcagaagccagtgcatctccttcccctctactgcaccctgattccctcaggcaatctgttggtaatcagtatgctacggtatgccaggggcttccaactatctatttatcaacagcccccgtttatttgttgccatgttactggcaagcaatatacctcagaatctcatcctttttttgttttcgtttttttttgagacggagtttcgctctcgttgcccaggctggagtgcaatggcgcgatctcggctcaccgcaacctccgccccgtgggttcgagcaattctcctgcctcagcctctcaagtagctgggattacagtcatgcaccaccacgcccagctcattttgtattttttttagtagagtcgggctttctccatgtcgatcaggctagtcccgaactcccgacctcaggtgatccgcccaccttggcctcacaaagtgctgggattacaggcgtgagccaccacgcccggcagaatctcaatcttaattcttacaagatatgagttgtctaatgagacacctgcaaaagagttataaattaaaaattcatgttcaggagattaattaactgctcccaggagatactggtaaagtcctgaggaagggaggccaggggaggagtggaagccgagcaaggatgaaagttcaggcaaacacccacagaagcttcagctcgactacatgaaggaagtctggcatcaaaattacattcagaattataatgacacaaggcattctctaatgtgcaatgttcataaaattatatgcctccttaaatataaatattactatttattttatattacatgcaatttgatattttaaattgcatgacaatatgagtcttttcataaatgacacaatctaatagtattcaataattatattttaaaatatattaagcatttttcacattgtgcttattttttcttttaaaataaaatcattttttacaacacctctttgctttgaggatttctttattgttctttttaaggtgcaacaatttattattagaagagtgatacatttatagaaaatgggtctatttaatccaaggatcactagttcccctttaaatatcacattatatgcacatggacagagctaaagaaagatggaataaacaatgttagagttaacttgtagttacatttcattcaaaatgcattatttctgaatgtatggatttcccttcttttcacgtctctaacacttccttacttttataagatgttttcaaaacagcctcagaaaaataagagacagttgtacaaagatttttttaaaaaaaaaaaaaccctcaatttatgttattgtgcattgagactaaatgaagtgatatttcaaggaccaattactcgccttaataacaaccaagttttatttactgttaaagcaaaacaaaacacaaaaacacttagctcatatacttcatggctactatgataaaagacaataaggcatatggttccatctaaatctggaagttgtatactttccatagaaacttatataaaataatgcaataaattaataaggaaagtaacctattagtaatttggaaaataagtaaaatttgggatttattattattattattttgagatggagtcttgctcagttgcccagactggaatgcagtggcacagtctcagttcattgcaaccttaacctcccagtttcaagtgattcgcctgcctcagcctcctgagtagctgggattacaggtgcccaccaccacacctgtctcatttttgtatttttagtagagacagggtttcactatattggccaggctggtctctaattcctgacctcgtgatccgccctcctcagcctctcctcaaaatttgggaatttgtctgagcaagtagtactttagaattgttttttttctcatctaatgggtttctagtttatgaaattcaattcaaccttaaatgtcaaatatttaaattcttacttgttatattacataatgtatgcatcttgatattgtttgtacactagagactatgcaggcaaacttcattaatttgtagatgaggaaatttaagcacaaataatttaagtgacaatcatttgtgataattataaacaatgcctaagacaaaagccaattgaatgttagccccgtgatatcttcttgctgcttcacagtcacactagagcagcaggaagctctgtagcttgtacctctgatttgttaaagttataaaatgttagaaaatgtgttgttgcacaataagtaagacagatctcctaagaaaatttactctggctactaaaatatgaactatgatcttgcttcacgagaacgcttctgacagaattcttgaaagtattgctctcctgaagacaagtgctttagaaacacataattgtccccttcatgaaagtcaaaaccttcccttctatgaaccaacatacgtctctctctatctctttttcaagagagtgagtcactgtatgaaaacttaatctatacaagattcttacaaactggagtatttttaacctaactaaaattcagttttactttcatggtcagcctttccagagagcaacatgtatataaaaactgaactcacaattagaatgggcaactattatatggttaatagtctaaaaaggaaaagtattagaaaagtttttttttctttttatttagaggagacagcaaaatatttcttacataatccttcagagacaatgaaaagtaaaccaagaactcttaaatactaaagagatacaaaaaaaattaattcctctgggcaatatatcacatgtagtagattgtaacacaaaaatcaatgagacataaatgaatgtaaattccccatgagatttagaatattacgtcaaaatgcatgtatagatcatcatccacatgttacagaagcaccagcaccctaatttgtctttcaaaatatcataacaaaattataagtcaacatgtactacattttagatgcttaaatatttcaagacaaaattaacatttaatacatataacaaatgttagcaatttttaaccaggtagacaatgataaggtcatatatcaaatttaatgtaatggaaagtccattttataaagaatgaaatttgcaagtgtacagaaaaattattctctttttgaccattttagttgataaaaaggcactagaatataattttctaggaatacagtagaaagtaagatgaggtttcattatctaaaaaccatagaggctatgacaagcagtttaacaaaatcaataattgagatttttgttgaaatacattagagacttagaaaaaggaaaatgtaagatatatatgtataatcataatgtattcactttcttcacttagaaattcaatattttgcaaagaataatatatgctctcaacttcaattacatttattttgtaatgtctcagtacaatattatatatcttaaatgtactatggctttcaaaatatagcaaaagggatataagtttaatgagttaggaaaatgagctataaaaaagtgatgactaaatagaagaatttacaaggattgtaactatgagtgagaaggcttacacaataagatccatcaattacttcttccaggaaaactaagctttaattatggaatggcagaatacatcttcatttaaacttatttctcacatcagtgtttggttgggagaatgtttctgcatggatttttgtggcttctttattcctaaactagaaactagtgtaagcgcgtgtgtttttgtgtgtgtgtgttttaatcaagattatttgaagaaaagaatagtattacatctaaggagaaaactatgtcaaggagaggaaaattattaacaaaaacattggacacagaagaaaaaacaaaagaggaaagccatgtgtcaaaatttcacaagagcctattacaaaatataaagagactcagagtttcaagattatatgataattttcaaaactccattaaagacataggaaaatctattttctacagatggagtcaacttactctttaaatgaagtaaacatggaatagcaatttctgaaggcaggtcatagcaacttgagaatgaaattatgtgaactattacaaataattaattacatacattttatttctttttgttaaattgtatgagatttacaggttatatgaaacaactagctctatcaaattgatataaacaaaagttattcatgtaaaaacagttcaatgattttagcttttaatgtttaataatttttaactttgtaaaggaaacatttacattagaattttaaataggattcaaattatgtgaccactagtaattgctttatttctcagatgatctaaaattaattgaggggggtaagcccatacaatgtatatggatatgaggtaaaacattttgtattagttaccaatctaaaaaacattgccaaatgctaacaaacttttgcagtttagaatccacaaatataaaatctgaataataattctaaatacttgggtaacattgggagctctttattattcaaataaaataaaaactctttagagtgaatattgaatgagttcatttttgtaaaattggagtattcccaatgtattagttttcacattgctataaagaactacctgagactggataatttatgaagaaaagaggtttaattgactcacagttctgcaggattagcaggaagcatgactggaagacttcaggaaactgacaaggcagaaggtgaaggggaagcaaggccccttcttcacatggtggcaggagagagacagagagcaagtggggaagtgccacaaacttttaaaccatcagatctcctgagaactctatcacaagaacagcaagggggaagtttaccctcatgattcagtcacctcccatcacgaccctcctctaattttacatgagatttgggtgggtactgaaatctaaaccatatcacccaacatgcagtaagtgttttgataattcttttgctactgttataatactgggatatgagaaaagacatgtacatcatgaattccttgacttgtgtacagtgtccctagtttaataatcctgggaactggtaagtaaagcaaattcaactggtctctttgctcaagcttccttcagatatccatatttaattgttaatatccactgtaaatctttgaatggtatatgttatacatgtgcaatgcttatttcaatctagctatactttctttaaacatccaaaagccttttgatataggcacaacttaccttccacattgcacacagagtaaattcttaactatccaaatgctggttattagtctcagcaatggctttaaaagctttgaaacaaatgattagttaagaactctatgttcattattttagcaaaggtaaaaataatctaagtcatagccctgatgtaatctctgttattcttaaccagtgtaaagtagtagttatatatactttgttattttaatttgaaagacaatgatttatgatagcctcttcagtttgtgggatctcagtttacttcaaatctaaaccaagattgaaccaaatagcaaatggattttcataaataatgagagatttaaaaggtgtgatctagcaatggatacagaaaatagagtaatctagatgttgttcctgttctttttttattttttattttgttaaagacagcgtcttgctctgtcccccaggctggagtgcaatgttgttatcatagctcactgcaacctggaacccctagtctcaagagatcctccagcctcagcctccctggtaagtagaactacaagcaagtgccaccatacctaatttttctatttttttgtaaagatggagtcttgctatgttgtctaggctagcctgtaaatcctggccttaagggatcctcctgcctaggcctcccaaagtgctgagattacaggcatgccaccatgccaggcctgttcttgtccttaagtaggtccactgtaagtgattctgggcagacatttatctcactatagctgtcagctttagaaaaagtcacttaggtaactttgggctgtgaaaaattatataatcagttcaggaacccctttggttttctatcttgatttatttgtccatagcacttggattagaattgggtacttaaatcaattcaagaaaaatattaagaaagccattatctcattatacaacaaattaagccaggattgttggcatgtgcctacagtcccagctactcaggatgctgaagtgggaagactgtttgagcccaggagttcaaggctgtcgtgctcatgatcatgcctgtgaatagtcattgcactctagcctgggcagcatagtgagactctgcctctaaaaatataataataataataacataaattacttctataaaaatatatgataaaatgtgaatattgaattatgttttatatcagggatgtgtagggttcatttgctgtatcttcttcactttcaaaaccaatctcctatctttataatacaataatatatctttatgttaaatacaattggatatttttctaataaaggattaagcaaattaacagtaggaactttaaaaaaaagttaattctatgtgtgactcattttcatcaatacctgtctgtaattcaaaattattttaaaaacaacacaatattgtgttgattatattaataattgagcattcaattgagatgttccatattacttgttcctaaattgccaaaatctaatcaggaaaatgcaaacaatttgctttgtgttctgtttgtagatgttcgttgtttactggaaatatttggaatgtgggacaattcttattctaccttccttgatatttcttccccactcatttcttgtgattctattttcaataatcatctttctaacatatataagtctataacagtaagttttagagaaatgtagtaactatattgcatcatatgaagagagtctgtattctttttattatttatttaggaacctctagcccagagtgtaatcgatattaaattttttggtgagtgtataagtgagagcattaatcaatgaaacatataattttttatctaatggaatcacctagtgcttttttgttattcatttacatttctagttaaagccagtttatgtgtacatctttatactaaataccatcaattttttttctgtcattacacaatcagcatataaattgtatgaggattaaaaagtatttgattgactaaaaatgcaatcatatttaattgtgacttccctcaaaaggagtatgggtacctcacaaaactatgtatcaacccataatattctgttagtaaaaccacttattttaaaaaagaagtgctttgtcgtcaaaaacactgaaggctttcaacgacaatgaaaaaccatagattgtttacactttttgtcttaaagaacaaagtatgagaagccttttacattttgtttcttttaatacttgttttgaatgagcagatgaagtaatcaaaattatagagcagctctaccctgctacgctgctaagctgctatgctagctctacgctagcccctattactacaagtaacagctagacagacaatgtaataaattctgttgtcttactgtccttatacagacctgacctgagaaaatatcactctagtttcacacacatgtttcatctttttctatgtttgagaattgctctcactttgataagattcatggccatgaattgggactatagttggaacccccacagtgtcaagtgatctttttatttctcccttgcaagagttctatatgcccaaagttttcactttaaaacttcactaacttatctccaaagaataaaatcttgcttttcacttgatataaatggctctaccactcagatcacatataaaaggaataaaaagttttgtgctatctgtttgtctctattgtgataccatattggtttgcatggaggtcatgaaactctctgtgaccagaagaattctcaggttgagtgtggaagtgtgggcaaagagaggttttgccctcaaatccacaactttggcgtctagtccacctgtgttctccaggtcagcttcaccactgagatctgtactttgcaaggcacaggacttctcttaatataactgaatccttgattcccatttcatatgctacttctgttatccgtggttggaacttttaggaagagaaaggtatgattattagacaccctatctataagtgaccatgtcccttttattaaatgcaataagggcccaaagttaacatcatcttgttaaattaacaaaaacattccaataaataaagattgtgaatcccttttattgctgtcaaatgtataaatatttattactttaaatggaatataaatgacactagacattgactatcattcagaaaggtttccttgtgtttttgtttgttatttttacctttcctttaaggttttctagctcacagttgggagggggaaacatattacttgtgagactgcttgaggcacattaaagcattaagcagccattgggcaatcgagtcttagaaagctcccttgtgaacaaatgtgtataaaaaggggacaaagaattctgaatgatttcatgctgaaaaacatacagagtataagaaaataacttataaatctggggttttctacgacttatgactttttctcagaaaagagataactcatctggaattatttctgatttaattacttggacaaaaacaaggtacattttgtttcccattttaagggttcattagggtcctaccttgcaaaccccatgcagacagagagcaccctcttctgtcacttaattttagagccagtatacatttttctctgataccaatttaacaggattttgaaaagttcttggttatgaggcatcatgactaaaagtacttaactgacaaaatggccctgaatgaaaaccatggagtcctcaggagagtagggctgttttgggaaggtgtttttatcatcttagagattccgtttgatgttcaaaatggcttgtaaataccaccatggggtaagtgactgtaagtttctgcgtataaaaaagcccattcgtgacaactactgcttctacattaaatatatcactggctgtcgtatgaactgtgtcctcactgcagcaaatacagtagattctgcttctagtgtcaggaaattagaactctgagcattgatggtcatgcatttttatcttggatctatccataatacactggaaactgattttctcataacattgaatctacttatgtaggatccatcagtgactttttttctcatttgagaatttgcacttttgaaataatatctggttataagtactatgatgtgaatttatccagggaaattctaaaactagatttagagtatttgcacattggatcccctgttttttttctgatttaataagaattctactttagaatacatgaaaatatgtgtgtgtgtatatatgtatatatgtaaatatgtatatatctccgtgtgtatatatatgcatgtgtaaacatgtgtatgagtatacacatgtatatacttataagcatacgcatatatacttatacatatttacacatgcatatatatttacatgtttctatatgtgtaaatatgtatataagtatacatatatacttacatatacatacacacatatacttatatacatatttacatatatatgtttacatatttgtgtatatatgtaaatacgtatataattatacatacatattatatatacatacacatatacacacacatatatatttacacacatatatatacacacgcagattctcccaataaactactaaggatattttgtatttatctgtgtattcatttatctggcatttccctaaaatgggcttactggatgataataaaatgacacagaatttcaagtatacattttaaaatatatgcacaatacagcataatagagttaattcttcttgaattgaaagtttcaatgattgcttctcagactacaaatatttcttatatttcttacttttcatacttctgcattctcttgcttctcttctcattcatttacttttttatttgaatcattcttttttttacaatactcttttcctgacccaaaatatattatagaaaatatgtaggactgaactcaggtctactatttgtaccctgttattcaaaaatctcatttactcccatggctttgtcctatcactttacatttttctatctacatgtggcctttctcctgagttccattagttcagactgcttgcatgtaggatgtcttcatgttggatacccttcaatcaacttgaatccatctttgctccaaaagccatgatttctctggacttttcaattttaattttttttttttttgagacagggtctcactctatcacccaggctggagtgcagtggcatgatcatggcttactgcagccttgacctcccacactctagcgatcttcccaccttagcctcctaagtagctgggactacaggcatgcaccaccactcaattttcatttttgaaagggtaattttcccatatcccaagtttaaatttttatggctacctttgtctccctcctagctctcatttttctacctactcacatttctacttactaagttctttttattccctctgaaactagttcaatgcaggcccttaggacttggcaccaggaatttctattattcttctaaagccctctctgcctctttctttatttctgcaaagaaatttcaaaaacacattactggaactttactctacacgtttcgtttcctaagttctcactaccaaagctttcaagaacaacttccttcttgaaggtcccgcatcctgctgtgcttagaacagattagttcaatacttacactgttatacttctgccaggcttccaggtccctcaggcacctgtgtgactgaatccctggctcatctgaaagttgaccagagtactttataataggttaaatgcccatgttagcatgttttttcctcttatggagtcatgcttaattttggaaattcgttggtcactaaaaaaaaaaatagtaatatttattgtattttagtctatcattaaatgttgtttgttttattaggacttttctgatacctaacacatattcccatagtacatttcctaatacttctcattctcattcaaattatctgtttagccctggtctggactttctgtagaggtcagcgggatccatgtgacctttgcaatatatgtgattaggtaattgattttttttaaacaaatactcgtgcttagtacaatgctctgtattaggaatagaaaaattcataaatacagaattggtgctttctccatattttcaaactcttttttggcattatatatttcttatcttaccataagatattcttattctcttctctatttattttacaataaaatttcttctcattttattctttctttaactactgatttataaattagattttctctaatttaatgcatttgtttactcatacatcagtgaccgctgagtacagtatcacagtatcatattctaacattaagcttgattgatatcactatctcagattgtttttacaagcattactcattttaccttgaatacaatcttggaggtaaatgacataatactattataaccattttacatatggataaaatgaatagcacagtttcaaagcaaactgatgatttgacacacatggctggtattcttatcactcacattctgatttcttctgtgtgtatatgtgtgtaatgacttgctcattggtataaaatgttaactcttattatgatgatttttcctgtagtttgatcaaacaaactctttttgtcccccagagaataaaaacaagtcaataaccacacaaagattttcgttctcaagggcagcatatttcatttgcatgattcagaaaatgtttagtcttggcaggattttcttaacatcttgaacatgagatatgtgaataaaattttctgatattgttttaaaagtacacattttaaaattggtgctgagttgagatgaaaattgaatgcattgtgaattacccaaaaataataataactttggttaaagatacaatgtctaacactttgcctaattgaaatttaattcatctttaaatcaatcactaattagcctttatgttgcctagaaaataaaaagtgtttaaaaaaatattttcttcctgctaaggtgtagtatttcttaaagaatgtgtggtatttctcaaaacactcaactcactgaattttatttgtactctacatagaaaaacaaaattgaacactagtctgtatagaaaggtgttgcagacacccattcctgatgtggatatacaacatcaactgtttttcttccacctctgagtgatcattttatccagttctagacaataagatagatgtggaaatctgctgtgttttctccaatttttcatctttttctgcctcgtatatagacatgtttaaagccattggagctatgaattaacaagcatgtgggaaaaaacaaataaattgctctgcatccatcctgctaccacctctcaccatgtatttacataaaataagttcttatttaagttgctattaactgctttttaaaaaatgtatgcaacaataagcatttatagcagatattgaagggtaccactatatacagaaaaaatgttgttgtacatcaaaaatatggattcaacaaggaatattattataatgaataatctaaaaataagattgatgcctaattttagatatatacttacattttgtatcaaatgaaattgcaatgtaaagtaagatgtacgttttcagtggcatgagtttgaagtatttttgtttaacttttgaatattttttcttttttttaattatacttcaagttttagggtacatgtgcacaacgtgcaggtttgttacatatatatacatgtgccatgttggtgtgctgcacccattagctcgtcatttaacattaggtatatctcctaatgctaggaaagctcagaaaataactcagtatctctataagttttaacttaaaatattatagaagtgggacaaaatcctggtaaactatctctaggtaatgtagtaacatatggctagctatttaattgggtctaaactttatataaaattacagtctttgcagaaagttttggtataaattacataaaggcatcacctctgatttgctccaattggttttatatggtgtcttgacagcaaagagaaattatccatgattgatagaaactgggagataaagcatctacttgaaacattagaaagaacgaatataatcagtgtggcagaggaaaagctgaaagggagaaatgtttctcagtgactttattttcaatgttaaaaaatgcatgccactgtaatcccagcactttggaaggtcgaggcgggcggatcacgaggtcaacagattgagatcatcctggctaacctggtgaaatgcggtctctactaaaaatacaaaaaattagctgggcgtggtggcggatgcctgtagtcccagctacttgggaggctgaggcaggagaatggcgtgaacctgggaggcagagcttgcagtgagcagagatggcaccactgcactccagcctgggcaacagagcgagactccatctcaaaaaaaaaaaaaaagtatgccaaactttaagaagtaataatagtaaggtgtggaaggaaacataaatttaaaagtcagtagaaagttttggtgggaaaaagtttgcaagacatggaagtttgttataaacaaaaagagaaaattgacccacatatactttttttacttttttggttttacttaagcttttattttaggttcagggttacatgtgcatgtttgctatataggtaaatttcatatcgcaggggtttgttgtacatattatttcatcacccaggtaataagcatagtacctgacagatactatgatcctcactctccttcctcccttcactctcaaatagtctctagtgtctattgttcctttctttgtgtacagatgtactcagtgtttagctccctcctataagtaagaacatgagggatttggttttctgttcttgcataagtttgcttaggataatggcttccaacttcagccatgttgctgcaaatgtcatgatgttgttctttttatgactgtgtagcattccatggtgtaaatgtaccacatttttttctttaatccagtctaccactgatgggcatttaggttgattccatgtctttgcttttgtgaacagtgctgcaatgaacctacatgtgcatgtgtctttttggcagaatgatttatattcctttgagtatatacccaatattgggattgttgggtctagtgaaaactctgctttgagttctttgacaaatcaccacactgttatcacaatggctgagctaatttacatcccttcagccatgtataagctttctcttttctctgcaacctcaccagcatctgttactttttgatttttaatcatagccattctgactgttatgagatggtatctcactgtggttttgatttgcatttctctaatgatttagaatatgtgataatatttgaatatgtaacattagtttacatattataaatattacatgttatgtaaaattagaatatgcaatgtcagtaatgtttagaatatgtgataaccttttctagttacatatttctctgtcaacataaaaattaagaaaaatcatatttatattttgtggaagcatctttcccatttgaataagattttacaaaataaagtagatatataggcacacattttctgaattatatttactaagacttaactgaacaaactaatttcaatattacagcataaacctggaaaatatataaagtatgtgaatgctttaatttgtacattattggaagtatgtgaatatcatcaatattataggatttcaaaaaagagctgtggaatgtatacttttttcccagtacaattatagaagtttgataaaataccaaaaaacaaagccatttgaaggcattgaaaataaaagatcaacagatgttcaaaattccggaaagaagacaagcaaatgatgattatacccacatcagtcttctgttttcccccttgaggtatttgtcaattcacagaaggaataatttaggattagtagaaagtggatactttggtttgctggcaattgtgtaggtctgaggaggcaaaggttagggtttgaggctgccaaggagctgggttaaatgtgctgagagaaagaaaatcacagggagtgagcctcaaattccaagcgtaatttatcctgagtcactctgtggattccaaatctgaaacttttggaaaccagacataaacaacagagtctaaggtgctgagcagagatttcagcagttacatagtgctaagagacaggtctgaatttaaatgcatgccaatgatgtgagactgttacacatgttctgtttaacagtgtgtttctgatgagaacacagaaggtttaaactgttggagcaagagcatacctaaaatagacgagccttaacgatgtttgtataatttttcatacacaatgtctggtatacaagtaaaatttttataaaaagcaggaaaagaaacagtatcagaagacactgaatcacagagatgtgatgaaataatgaacaaattctggagatggttggtggtgatggttgcataacaatgagagaatgtatacttaatacttctgaactgtacacttaagggacattggatttctaacattgagtctgaaagaagagagaaaggagatagaagcaattttttctaattactacctgataattttctaaaactgataaaggatattaagctctgagcaaaaatcaaggttaaaaacatccccaccacaaaacaatcacaaaaacaacataaaccttagaaaatcagagttaagcttttgaaaaaagaagtaagaaacagaaatatagttacaaagacagagacacaattcagattaccttttagggatcaatgtaaggacagactgaaattctgaagagagttccaagaagcttgttgatagaatatagtggaatgatgtctttaaagtgctaaaagatagcaaatatcagtgtataatttaatatccagctaatatctttcaaaaatgggataaaaattaataggtgttcataaaaaacgttgtgatatttaatttttaatagtcctatactaaggggaaatactaaagagagttctttaaagtgaaaatatgtcatcgcagatggaattgtggaagaaaaaatcaaaccttctgagggcacataaatgtaaacaaatattaactagtgatgtacttgggagactgtatgtagaattaacgtacattataatgatatgtaatcaaatcaaaatcacaagataaaacttcgtatcaattaggctattaagaaaaaattaaaaataacaagtattggtgaggaaataacaaaattggaatccttgtgcattgttagtggggatgtaagatagtgcaactactgtaaaaaatagtacagcaattcctccaaaattaaacatgaaattaaaacatgatacaccaactccacttctgggcatatacccagaataaccaaaagcagggaatagaataaagatttgtacaccaatattcataggaacattatttataataggcaaaagatggaaacaactcccaagtgtccattcacagctaaataggtgaacaaagtgtggtatgtgcgtgcaatggactataatcaaatttgataggaattacattttgacacatgctaccacatgaatgaaccttgaagacatcatgctaagtgaaataagccagacagtcagaaaaggacaaatgttgtatgattccacttatatgaagtacatagactagtcaaattcatagggacaaaaagtagaagggagcttaccaggggtaaggggaactgggaatgggggattattttttaatgggtaaagagtttctgcttggtatgataaacggattctggaggtgatggtgatgatggttacaccacagttagactacttaatttttctgaactgtttacttaaaatagttaaaatgataaattttatgttatatgtatagtttatcttaattaaaaatagtatacaagaatggatttgggctattaaaatgttataagtttttttcagccaataagtggtgaaaatatgactttaaagaggatatcagcaagtcaaggttgtgtgtttaagttcagggtaaacactaaaataataataataatctataccataatcaagaaagtagaaggtacatttggctactgaaaataagtttgaactttgggaggccaaggcaggtggatcacttgagctcaggcatttgagatcagcctagacaacatggcaagacctgtctctactaaaaatacaaaaaatagccagatatggtgctttcttgttgtcccagctactcaggaggctgagggggaaggattgcttgagccccaggggcagaggttgcagtaagttgaggttgtgccactgcattacagcctgggtgacaaagtgagaacctgtctaaaaaaaaattagaaatccaaaattggttatgaatattaaagaaagaaagaagaaacaactagaaaacagaaaaagttgctgcacatatcatcccgtcatgcaggtattaagcccagcacccattaactgttctttctggtgctctccctctccctataccctggacaggccccagcgtgtgctgttttcccccatgtgtctgtgtgttcttattgttcagttcccacttataagtgagaacatgtggtgtttggttttctgttcctgcattagtttgctgcagattacctcttccagctccatccatgtccctgcaaaggacatgatctccttcctttttatggctgcatagtattccatggtgtataggtaacacatttttttatctagtctactgttgatggacatttgagtttattccatgtctttgctattgtgtgtagtgctgcagtaaacatatctgtgcatgtatctttataatagaatcatttacattactttgggtacagaccaagtgatgggatcgctgggtcaaatgatatttctgcctctatgtctttgtgcaatcatcacactgtcttccacaatgattgaattaatttacattcccatcaacagtgtaaaagtgttcttatttctccacaatcctgccagcatctgttgtttcttgactttttaataattgtcattctgactggcgtgagatagtatctcattgtggttttgatttgcatttctctaattatcagtgatgttgagctttttaaaaatatgtttgttgggtgcatgtatgtcttcttttgagaaatgtctgtttgtgacctttgcccacattttattgattttttttttctgcaagttccttgtaggctctggatattagacgtttgtctgatggatagcttgcaaaaccgttctccaattctgtaggttgcctattcactctgatgctagtttcttttgctatgcagaagttctttagtttaattagatcccatttctctagttttgcttttgttgcaattgcttttggcattttttgtcataaaatctttgcccctgcttatgtcttgaatggtattgcatagattttcttctagagtttttatagttttgggttatacatttaggtctttaatccatcttgagttaatttttgtataatgtgtaaggaagaggtccaagttcagttttctgcttatggctagccagttctcccggcaccatttattaaataggaaatcctttccccattgcttgtttttgtcagatttgtcaaagatcaggtggctgtatttgtgtggttttatttcgaagttctctgttctgttctactggtctatgtgcctgtcttcataccagtaccgtgctgttttagttactgtagcctcgtaatatagtttgaagttggttagcatgacaccttcagctgtgttctttttgcttaggattgtcttggcaattggggtcttttttggttttatataaattttaaaatagtttttttctaattttgtgaagaatgtcagtggcagtttaataggaatagcatttaatctataaattactttgagcagtatggctattttcacaacattgattctccctatccatgagaatggaatgtttttccatttgtttgtgtcctctctgatttccttgagcagtgatttgtagttcttgaagaggtccttctcttcccttgttagcggtattcttaggtattttattttctttttagcaattgtgaatgggagttcattcatgatttagctctctgtatacctgttgttggtgtatagaaatcttagcaatttttgcacattgattttgcatcttgagactttgctgaagttgtttatcaccttaagaagcttttgggctgaggtgtttgggctgtctagatatgggatcctgtcttctgcaaacaaaaataatttgacttctcctcttcctatttgaataccctttctttctttcttttacctgattgctctggccagaactttcaatattatgttaaatgagagtggtgagagagggcatccttgtcttgtgggggttttcaaggggaatgtttctagcttttgcccattcaatatgatgttggctgtgggtttgtcacatatggctcttattattttgaggtatgttccttcagtatctaatttattgagagattttaacataaatgggtgttgaattttattgaaggtcttctttgcatttattgtgataatcatgtagatttttgtttttatttctgtttacctgataaattacatttattgatttgcatatgttgaaccagccttgcatcctggggatgaagccaacttgatcatggtgaataagctttatgatgtgcctcttgatttggtttgacagtatttattgaggatttttgcataaatgttcatcagggatattggcctgaagtattctttttttgttgtatctctgccagatttcaatatcaggaagatgctggcctcataaggagagttagggaggagtcccttcttttcaattgtttggaatagtttcagaagaaatggtaatagcttctctttgtacctctcatagaatttagctgtaaatgtgtctggtcttgggcttttttggttagtaggctatttattaccacctcaatttcagaactcattattggtctatttagggattcattttctgattcagacttgggtgggcatatgtgtccagaaatttattcatttttttttagattttctagtttatgtgcataccggtgtttatagtattgtctgatggttgtttttatttctgtgaggtttgtggtgatattcctgtcatcatatctgattgtgtctatttcattctttccttttttttctttaaagtctagccagtggtatatttattttattaattttttttcaaaagaccacctcctggacttgtttttttaaagggtttttcgtgtctctatcttctttaattccactatcatcttagttatttcttgtcttctgctagttttgggatttgtttactcatgattctccagtttatttagttgtgatgttaggttgtcaatttgagatcattctacctttctgatgtgggcatttagtgctataaatttccctcctaacactgcttaggtgcatctgagaaattctggtatgatgtatgtttgttcttctatttttttttttttttttttgagacagagtctcgttctttcgcccaggctggactgcaatggcctatctcggctcactgcaagctccgcctcccgggttcacaccgttctcctgcctcagcctcccgagtagctgggactacaggcacccgccactgcgctcggctaattttttgtatttttagtagagacgggttttcaccgtgttagccaggatggtctcaatctcctgacctcatgatctgcccacctcagcctcccaaagcggtatctttgttctttttactttcaaaaaactttttatttctgtcttaatttcattatttccccaggagtcattcaggagcaggttgttcaatctccatatagttgtgtggttttgagtgtgtttctcaatcttgagttctaatttgattgtgctgtgatctgaaagactgcttgttatgattgttattttgcatttgctgaggagtgttttacttcctatgatgtaatcaattttacagtaagtgtcatatgacaatgagaagaatgtatattctgttgttttggagtggagagttttgtagatatctatcaggtccacttgatccagaactgagtttaggtcctgaatatctttgttaattttctgtctcaatgatttgtctaatactttcagttatgtgttaaagtctcccactattattttgtcagagtctaagtctctttatatgtctctacaaacttgctttatgaatgcaggtgctcctgtattgggtgcatatatatttaggatagatagatttgctttgtgaattgaaacctttaccattatgtaatgcccttctttgtcttttttgatctttgttggtttaaagtccactttgtcataaactaggattgcaaccctccctttttttgttttccatttgcttggtaaattttctaattgtctaattttctttgttttgagcctatgtgtgtctttgcatgtgagatgtgtctcttgaaggcagcatactgatggggcttgagtttttatctagcttgctattctgtgtcttttaattggggcatttagtccacttacattgaaagttaatattgttatgtatggatttgatcctgtcatcatgatgttagctagtcattttgcagacttgtttatgtagtcacctgatagtgttgctggtttgtatactttggtgtgtttttatagtggctggtaacagtttttcctttccatatttagaacttcgttaaggagctctttcaaggcaggcctggtgatgataaattttctcagcatttgcttgtctgaatagaatcttatttctcatttgcttatgaagtttagtttggccagatatgaaattctgggttggaaaatgttttctttaagaatattgaatattggccctcagtctcttctggcttttaggatttccactgagaagtccactggtagtctgatgggcttccctttgtaagtgacatggcctttctctctggctgctctaacatttttcctttcatttcgaccttggagaatctgacggttatgtgccttggggttgattttcttgtggagtatcttaatggagttctctgcgtttcctgaatttgattattggacggtgttgccaggttggagaagttctcctggatgatatcctgcagtatgtttttcaacttggttccattctccccatctttttcaggtaccctaataagtcataggttttgtcttttttacataattttatattttttggaggttttgttcattgctttttattcttttacctctattcttatctgcctgtcttatttccaaaatacagtcttcaagctctgagattcatttccctacttggtctatttatctattgatgcttgtgattgcattatgaagttcttgtgttgtgtttttcagctccatcaggttatttatgtttctctataaactgactattttggttatcagcacctgtaatgttttatcatgattcttagtttctttgcattgggttagaacgtgctgctttagctcagcaaagtttgttattactcatcttctgaagcctacttctgtcaattcgttcatctcagcctcagctgttctgtacccttgctagacaggtattgcaatcatttggagaagaagagacagtctggctttttgggttttcaacatttttgcattgattctttctcatctttgtggatttattgacctttgatctttgaggttgctgacctttgagtggagttttttgggggtcttttatgttgttgttattttttgtttttcttttaaatgtcaggctcctcttctttagggctgctacattttggtaggtgtccactctagaccctgtcaccttggatcctcctgcacgagaagttatcatcagtgaaggctccaaaacagcaaatatagcagcctgctccttcctctgggagctccatctaatagggggcactgacctcattccagctgagatgctcctgtagcaggtttttggacatccctattgggaggtctcacccagtgaggaggaacaggatcagggtcccacttaatgaagtagtcaggctgccccttggcagagcaggtgcgctgcactgcagggaagtccccttgtccagattgcccaaactttccagagccagcaggaaggaaagtctgtcagctgagctgcagatatggtggctgcccatccccatggtggctccatcccagggggagatcagagttctgtttataaaaccgtggctggagttgctgaaattcctgcagggagacccttctgggtaaggagggatggatcagggtcctacttaaagaagcagtctggctacaatctgccacagcagctgtgttgcactgtggggaattcctccctgtctggaccacccagtttccctggatctggcaggtcaaaaccaaggtttttaatattgcttttgatgtagacttttcgttttccaccgaccagtcttgattattataaaaatagttacttgctgtaatatattgtgccattgttaacatgaaatggttgatgattccccttttaccccctttatccccttggtgttgattagacaacattagaaatagtgacaaataagcaacttttacaaaatatcctgttttgttatagtgatgaatgtgagttagtttgacccaatagggaagctttgaagcacgtataggctgcagcttaatattttaccaatatttcaaactccaaacttttattttactccttgggtgtttctggaaatatgaaattacatatttgaatacctttgaaactttaacttacgatatatttagatactcagaatcttgagaatcgtctttctactcattgtaaggattaccatttgattttaactgcactcagtattgaaatgtgtagtgtgataacactgacaaaacaataggcaaaaataaaaatgcaacatggaggttcttctattttactttgatgttatgattaactgttgtatcttatgacaacgtactgtatgtgtaacagtggagaactattgtgaaaagtcaaattgtaaattgtactcatagtattgcttctatgagaatgaaactcacataaatgaattgcagtctttgcagttacaaccagtctaggagaggtgtttgaggagagtcttttagacagaaaaagcatcagcttatgtttatcaggagcctaagtatcagctactaagtgattcaactgcagtattgataagtcttaaatcaattaaaattatcatctctagtgttttggcttaaaggattacattttggaaacaggaagtgagtagattaaaaagaaataaacaaggttttctggcaaatatatttccatgaaagaaaattaagaatttgtgaaacacaaactaccaaccactgtatctctaaatctccatgaagagatgttggccaaaatccagactttgagtatacttctggtgaacattcaaaaggaagagaagaacatgctattggacactagagaaaggggtatcttcgctatgtgctggaagaaatcttagcaaaattgtttcccttagagccagttaatgtggaaagaagaaatttgttgtctacttaaggagatttccaaaataagggttgaagctatgggcctatgtatttttgttgcttataacaaaatttgagaggaaaaagagaaattgagggaagaacttgtaaagcaaaaaaaaaaaggaagggcttgaccattttggatattctcagcctctccagacagcaaagaatgctaacattttgaaaaggtttccaaataacttcaggaaaataaggtcaagaacaaaagccaggagtgtgactgaataaacttctgttaacatttcagaaagacagaaacatggacatggtactcagttacacaaaggactgttttaagagattaagagtgtgccttgcagacttctcaaccaaaccgcagaatttctaggaagcctatagactacgtccccagccttgtcagcagaagcccaagaaagaagagcttatcttaaaagcagtctgtgggtatggcttttttatgactgagtgagccacagggatatttttcatgagactcacaaagtatttgagagttatttcagcagacattaccagcttggatcaaaaaagacagagagagtacaaaatgaaagaatattgttttgtacccccaattctgctgacaaacagaaggcaagcaaaactactcagctgcaaatacttgtcagctttcatgaaaaagaaagagggcagaaccaacagcacagagagttgaacccagagtaactgagaactatatgcagcccttaaatcccaaccaagcaactctggacatttacccagctggatttcagcacggctattgattagtgactattttgtgccttcactttctccatttttgaataagaatgtctataactattatgctatgactgtgccaccattgtactccaagtttgaagggcaaataacttgttgggtttgctttccagattgtcagataaagattgttatatgcaaggagtctcatccacatgtggaagtaatttagattatgacttttggggttttgatcacatgttataataggattacagacttggggacttgaaagggaatgaatgtattttgcatataggaggaatgtgaattgagactctggagtgcaccccatgatgctcaacttaatagtgttcttactctttcttgattccctccctttaagtggaaatggaacctgtgacctgcttgtaacaaacagatcacaggaaaggtggtctgtgcaattacctcaacctgactgtattatgtaagattatagtggatcttgcaaggagatttttgtctttcccttggaggttttaagaagcaagctcttatactgtaagctgccacacaggaaggagccaaggacagcctgtggctgacagaaacgaacccaaaacttcaattcagcagctggcatggtctgatatttgcatcctcccgacatttatacgttaaaatcctaaactccaaagtgatagtgttaggaggtggggccttcgaggggttattatgtcataggagtaaagtagaattagtgcccttacaagagagacttcagacagatccctttctccttacatcacgtgagaacacagtgagaaggtgtcatctgtgaacgagaaagtgtgtccacaccagacaccaaatctattggcaagttgatcttgaccttcccagcctccagaattataagaaataaacttctattctttataagctacccagtttgtagtactatattatagcagcggaaagagactacgaaagcagcccatggaaactgagttctgtcaaaaaccatgtgagtttggaaatgtccccgtctctagtcaaacctcagatgagatcacaaccctaggcagtatctttattgcagctttgagagacctgaaacagaatacgcagataaattgttccaggactcctgattcactgaaactatgagataataagtgtattattttattatttagaaattatttttatagttttagtggcacaatttttttattgttattgttgttgttacatggatgaattgtatagtggcgaagcctgggatgttagtgcactcattattattcaagtagtgtacgttgtgcccaatacatagtttttcatccctcatccaagtcccaccctcctttgttttgagtcttcgatgtccattctatcactccgtatgtctttgtgtacccatagcttagctctcacttagaagtgagaacatgcagtatttgttttttgattcctgagctacttcacgtagagtaatggcttcaagttccatccaagttgctggaaaagacattatttcattctttgttatggctgaatagtattccatggtatgtaagtgtgtgtgtgtgtgtgagtgtatacatacatacatacataccatggaatactactcagccataacaaagaacgtatgtcacattttctttatccactcattactttttctttatcctctcattggtggtttgggcatttaggttgattacatttctttgcaattgtgaatcatgctgtaataaacttatggatgcacacttctttttgatatagtgacttttcctttgggtagatactcagtaatgggattactcaattgaaaggtagatctatttctagttctttgagaaattgccatactgatttccatagaggttgtactaactgtatgtgcaccagtagtgtataagcattcccttttcatcacttccatgtgaatatctattgttttttggctttttgataatggccattctggctggggtaagatggcatctcactgtgggtttaatttgcatttatctggtgttaacgatgttgagcattttttcatagtttttttgcccagttgtatatgttttttgagaaatttctattcatgtcatttgcccacattttaatgggattatttggtttttttcttgctgatttgtatgagttccttatagattctacatattagttgttggaggcataattttcaaatattttctcccattctataggttattaactctgatgattacttattttgctgtgcagaagctttttagtttaattaggtcccatttatttatttttatttttgttgcatttgcttttggagtcttagtcgtaaattctttgcttgggccagtctccagaacagatttcctaagttttcttctagacttgttatggtttcagaaattagatgtaagtacttaatctattttgagtcaacttctgtatatgatgagaggcagagatccagtttcagttcttctacaggtggtgatccaattttccagcaccatttattgaatagagtgtcctttacccaatttatgttttgtatgctctgttgaagatgagttggttgtaagtatttggctttatttctgggctcttctattttgttttgttggtctatgtttctacttttttattaataccatgctgttttgtttagtatagccttttaatataatttgaagtcaggtcatgtaatgcctccaactttgttctttttgcatagaattgctttggctatttggcctttgctttccataggaattttaggattctaattctgtgaaaagatgatgttgatacattgatagaaattgcattaaatttacagattgctttgggcaacgctgtcatttttacagtattgatccttacaatccatgaatatgtggtatatttccattcgtttctgtcacctataatttctttcagcagtgttttgtagttctctttgtagacgtgttttacctccttggttaagtattttcctaggtaatttttactttttgtagctattataaaagaaattgagttctttatttgattctcagcttggttgttgtcagtgtatagcaatgctactgatttgtgtatataaagattttgtaaactgaaactttatttatttatctgatctaggagtgtttgggaggattctttaggattttctagggttaagattttatcattggcaaacagcaatagtttaaattcctcttttccaatttggatgcctttactttctttctcttgcctgattgctctggctaagattttaatactatgttgaacagaagtggtaacagtggacttctttgtcttgttccagttaatagtggaaatggttttaacttttctccattcagtatgttggctgtgggtttgtcatatatgacttttagtattttgaggtatgtttttcatacttagtttgttgaaggtaaaaatcttcataaaaatcataaagagatgctggattttatgaactaatttttctatgtctattgagatgatcatatggtttttatttttaattttatttatgtggtgaatcagttttattgacatgagtatgttgaaccatccctgcatccatgggatgaaacccagttgatcatggtaaattcttttttgatgtgctgttggatttgctctgctagtatgttaatgagaacttttacacctatattcagcagagatattggtctgtaattttctttttgtttgtttgtttgttatatccccttctggctttggtatccagataataccagcttcatagaatgagttacggagaatcctctccttctcagttttttagaaaaatttcagtggaatcggtcctaattttactttgtgtataaacctcaaattttgcattctaaaattcaaattttagaatttggctgtgggtgcatctggccctgagattgttttgttggcaagtctttttttttttaattactggtttaatctcactacttgttattagtctgtaaagggtttctatttcttcctgattcaagctagagagtagaatgttttgaggacttttttcattcagtttagatattctactttgtgtgcataaaaatgttcatggtagtctcaaatgatcttttgtgtttctacagtgttggttgcaatgactccattttcatttcaaattgagcttatttgagtcttctctttcttttcttagataatttagctagtgatctatcaattttgtttatgttaaaaaaaacactaacttttgtttcagtgttcttttgtatttttgtttcaattttatttgattctgctgtgatccttgttatttcctttctttggttagctttgattttggttcattcctgtttctctagttctttgaggtgtgatcttacattgccagtttgtgatctttcagactttttgatataggtatgtagtgctataaactttccttttagtgttataagctttccttttagcactgcttttgctgtatctcagaggttttgataacttgtgtcacttttattatttattttttaaaattaaatttctttcttgatttcattgttcactcaaaaatcatttagaagcagtttgcttaattttcatgtatttgtttagttttgagggtattttatggaattgatttctagttttattccactgtggtctgagaagatgcttgatgtgatttaaatttttaaaaatttattgagacttgttttgtggcctattatgtggtctgttttggagtatgttccatgagcaaaatgtatattctgaagttttggtgtagaatgttctgcaaatatctgttaggtccatttgttctacagtgaagtttaagtccagtgtttatttgtagactttctgtctcaataatctgtctagttctatcagtggagtattaaagttcccactattactcggctgctatctctttttttagctctagtagtcattgttttatgaatttgggagctccgatgcatatatatttaacattatatatgttatatgttcttgctcaattgatccatcattatataaggaccttctttgtcttttttgtaaacgttgttgctttaatggatgttttacttgatagaaaaatagctactcctgctcacttttggtttccatttgcatgaactttgttttccactcctttaccttgagtctataagaatccttatgtgctaggtggtgcatctcctgaagatagcagatatttggtctgtaatttttatcctttctgccaatctgtattttttagtggagcatttagagcatttatattccacattaatattgagatatggggtattgtttctgtcatcataatgattgttatctagtgactttgttttcctcactgtgttgttattttataagccttgtgaattttatgctttcaggaggttctattctgctgcatgctggtaatttgtttcaagatttagaactccttttagcatttcctgtagggttggtctagtagtgacaaattcagtcagcctttatttgagacatactttatttctgtctcatttataaaatttgttttcttgaatacaaaattcttggctgacagtttttgtctttaaggagaatacagaaaagaccccaataccttctggcttgtagttttagctccctcagttctctgctgagaagtctgggttaatacgatacattttcctgtacaggttgccttgttcttttgtctcactcttaggattctttccttcacattgactttagatagcctgatgattataagccttagtaatattttttttcaatgattctcctaggagttctttgagcctcttatattttaatttctaaatttctagcaaggccaggcttataacatagcaacataatgaggaaaacaaagtcactaggtaataatcattattccagcaaggtcaggaagtattcttcaactattcccttaaatacgtttttcaaattttttcagtttttcttttccctcgggaacacctatgattcttaggtttggtttggccattttacataatcccatatttcttgaataatttgttcattaattcttttttctctatttttctgttactgggttaattcaaaagccttgtcatcaagctctgataatcttccttttacttggtctagcgtattgttaacactttccactgcattttgtagctttctaaatgtatcttttatttccagaaattctgattttttttttgaaatatctctttagcaaatttctctttcatattttgaattgatattttaactttatgttggttgtcacctttctattgtatttcattgagtaagtgaataatcaatcttttgaattcttcatgtgttatttcaaagatttcatcttggtttggattcaacagttagtgagaattagtgtgatctttggggatgttttaggacactattttttttaatattgccagaaatatttttctgatttctcctccatttgtgtagaatatttcttctaattatttttgaatttatttttaattcaacagtgtttttttaacttctttagttttttccccttaaggatgtgattttacttttattatttattgtcacttagcttggctcagggtgctttaagtggtgataattataccatttccatgattatagagaatcttagtgtgatgatttttcagatgctggttgtagtagcagtgtgctaggtgtgtgagcattgtctcctttgagactggaatggcagaatctcatgaatcttatctcgtcccccagtggtgtgcactttaaaaacattttccccaatattttattctctgtgttgaacagtttaggctttagccagtagaaagtacccatggatgaaaaaacagctgtggctataacaggttggtaaatgcaatacccaatggtggacaacagtcccagcattgacaaaggcagctggggaagcgctcattgaaatgcactgaggtattttcaggggtaagaaggggccatgacagctctccttccatgccagaaggaaagcagtatgcctccaagtcacactggcccagtcttccagctattcagatcagacaaatacctcttttcatttgccagaatgctgatgtaccctgtagaatgggattgtgactctcccccttgtgcaaatctgaacctaaaaggcactcgtcttgtgggaatgtagtcaccctgagtattccagaaaggctgtctatagatacacccctgcagagctcacatgggagaagccccagcagtgtcttcagtggtgggtgaggtggagaataaatctcattctccgaggtccttcataacctttagggctgcctgactgttgtgtgagagccacaaactttccctactgagcccagaactgcacctgtgcctctgttgaaagaaaatttccacaagaggaaagaaagttcagagacacagggcctgcagtctagtttcttttgtcctatggggtggtcccttaatgtcgtgcacttccccttctcctaagagtagcagcccctgagggctaggcaactgtgaattctcctgctccttagtgtctagccacccagtagggctgccatgttccagtgtggtgctatagaatatctgcatgggattcagctatgtgatttgttctctagtctcccagcatcaggtaccagcatcagttctgatgggggtaggagaaatacagattcttcaagattttttggttataaatagccttattgtgttggttatctcaaatgcaagctgttgtagtaatgtgcagattcaggacctcctggttatccaggatgatgcaggcaatgctaatagctacagtcatgcaaaagttttctcctaagtaagcactgttattgtgtctgcagatgttgtaatgggctgtgccagttggcttccagctgggaggtgatgctttccaaagagcaccagctgtgatggtaacagtgaaatttctgcttgtcttattttacacagtggaagtattctcgtgcctctggcaataagcaggtccatggagctctcaaaagtccctgtgtgttatattatgctaccagcgcaagtagaggagcaaagctgggtgggggtttagtcatgcaattctggctccccacatgtgggttggggaatgtgtgtttccagtcaaatcttatattgaaatgtaatcccaagtgttgaaggtggggcctggtgggagatgattggatcatgagggcaggtttctcatgaatggcttagtgctacctctgctggtactgtccttgcaatagtgtgtgagttcttgtgaaatctagtcatttaagtgtgtagcacctttcccctcactctcttgcttctgcttttatcatgtaacgtggctgcttcccctttgccttccaccatgattagaagttccctgaggccttcccagaaacagatgctgttatgcttcctgtatggcctgaaaaaccatgatcccactaaaccccttatctttataaattattcagtctcagtattttttttactgcaatgcaagaatggcccaatacagaaaattggtatcaggaatgtggcatttctgtaaagatacctgaaaatgtggaagcagttttggaactgggtaatgggaagaggctggaagagtttgcaagactcagaagaagagagaaaaatcagagaaactttggaacttcttagagactggttaaatggttgtaaccaaaattctgatagtgatacggacagtaaagcccaggctgatgaagtctcagatggaaatgagaaacttcttgtgaactagagcaaaagtcatacatgttataccttagcaaataacttggctgggttgtgctcatgtcctagggatacgtgaaagttttaacttgagaatgatgacctagagtatctaacaaagaacattgctaagcagtaaagtgttcaagaagtagtgtggctatttctaacagcctagctcagatgcaggagcaaataaatgtgttggaacttatatttaaaagggaagcagagtatctaagtttgaaaaatttgcagaatggccacatggtagaaaagaaaagcccattttcagtggaggaattcaagcaggctgcagaaatttgcataagcaaaaaggagccaagtgctaataatcaagacaatgggaaaaaggcctcaaaggcatttcagagaacttcccagcagccccttccatcacaagcccaaaatctaggagaactgaatggttttgtgggccaggcccaggactctgctgccctgcacaccctggggacactgctccctgtatcccagccactgtagctcaagctgtggttcaaaagggcccaggtacagcttggtgactgcttcagaggatgcaagccataaacatggtgagctccacatggtgttaagcctgtggctgcatagagtacaagagttaagaattgggtgcctccgcctagattccagaggaagtatggaaaagcctgagtgtttcaggcagaagcctgctgtaggggcagattcctcactctactagggcagtgaagaggaataatatggggttggagcccccacagagtccacaccggggcactgcctagtggagctgtgagaagagctccaccatcctccagactgtagaatgggagacccatcagcagcttgcaggcagtatgtggaaaagccaaatggattcagctataacctgtgaaggcagctgcaggggctgaaccctgccaagccacagaagcggagttgttcaaggccttgggagtccaccccttccatcagtgtggcctggatgcgagacatggaatcaaaggagattattttggagttttaagatttaatgactgccctgctgggtttcagactttcagagggcctgtagcccctctcgtgtggcccatgtctcccttttggaagaggagtattttcccacctatattcccattgtatcttgtaagtaactaacttgtttttgatattacaggctcataggcagaagagactagccttgtctcagatgagacttcggactttggtcttttgagttaatgctacaatgagttaacactttggagataattgggaaggcatgattgtattttgaaatgtgagacgagcacgacgcgtgggaggggacaagagtgggatgatatagtttggatgtgtgttcctgctcaaatttcatactgaaatgtaattcccaatgttataagtgaggcctggtgggaggtgattggatcatgggggcaggtttctcatgaatggtttagcaccatctcccttggtactgtcctcacaacagtgagcgagttcttgtgagatctggtcatttaaaactgtgtagcccctcctcactttgccctgttgctcctgatctcaccttgcgatgggcctgccccctcttcgccttccaccatgatgtttcctgaggcttccccagaagcagatgctgctgttatttctgtacaccctgcagaaccatgagccaattaaacctgttttctttataaattattccctctcaggtatttctttataacaatgctagaacagactaatacataggggcaagcagtgggactggtgggaatcagagggcagatctctggctgctcaggtcatgttcagggaggagtgcagctgcctgtcttacataaaacaacacacatgggagctgggtgcggtggctcacacctatagtctcagcactttgggaggctgaggcgggcagaacacttgaggtcaggagttcgataccagcctgaccaacatggtgaaacccagtctctactaaaattacagaaaattagccaggcatggtggcacatgcctgtatccctgttactcaggagactaaggcaggagaatcacttcaacatgggaggcagagattacagtgaaccgagatcacgccgctgcactccagcctgggtgacagagtgaaactccgtctctaaacaaatgagtaagaccagaaaagaatacacatggggagcaggcggcagtcagccccactcagctctcatgctcttgccaaggcaggtctcacacccacagtgttttgctagcagcagctagctagtttccaggtagtctgcacttggtactccaaactgccacctaccataagccctcccaactaagagaaaaacagtggctttcaggctgtgatcctcctggtccaccctcaaaggaggggtgcccggctgaggttatataggtggctatagcacacttcccgctcctctcttggttctggcccagggggttcatccccacttgagattattttgcaaacctcagttaggaacctctggaaacctgtaacaaccacctgagtgagctggcacacttccgtgaggtgtcctgtgaagtaggattaggatgattttcctacatctctgctggagtctgagagtacacacaaatgctgctccttcccacattctccctactgctcactaagtcagctccagcgctgaacagagtgaaggcatttccctgtggcctgggttgtcctgctgctcagtgggagtgtgtgtcatggaggcaatctctcccctctcacattctgaagactcacagttttctgcctcactcatggtgtaggttgctgcctgctgcttctttcataaagtctgtagttattttcagtttttctgttaagttcttctgttgtttcttgggaaaaaaaaatactcacagcatgaaactctgcacgatattttgtccttcgaagtggcggagccatgctaacaatgcccccaacccgccatctcggaaacagaattaaacaaacaaagaaaaaacaaatacgttgttgtaatctgaaatgttggtgggaatatgcatcaaagataaaattacaacaaatttaaagatcttaactggtttatatttttaattctagaattgttctaataggctgagcaaaggatgttattttatagacaataaagggctgagaaaagtaaatatagagaacaaaaagtgaattggttgattcaaagttacttttcttataaagattaaagcagaggaaactttcttatcacaccgactaaaactggcctgtttgcggatttggctagtatttatctttcttctaatttcctggacagtcagaagaatatcttttggtttggaggtgtacttcagcatgagtaattttgtactttttgggctgttggacctaacacaggagctcagtccaaaccaatggcctcctataaatgttatctaacataagttggctgggtgtggtggctgaagcctgtaatcccagcactttgggaggctgaggtgggcaaatcactcgaggtcaggagttcgagaccagtctggccaacatgatgaaaccctgtctctactaaaacaaacaaagaaaataaaaaaaaaaaaaaaaaaaaaaaagctgggcatggtggcacacacctgtaatcccagctactcaggaggctgaggcaggagaatctcttgaacccgggaagcagaggttgcagtgagccgagaattctccactgcactccagcctcggtgacagagtgaaacactgtctcaaaaaaaaatgttatttaacataaattatgcagcgatacataagtcacacacagatgctagtataactatacaatgacattatacttataagctatatggatgtggccactaattgttgttgtttactaacagccttaagcatcttaaatctctgagaaaatcatgctgatgataatgataatgtttatataacactgaatgtgttccagttattgttataacttttgtattaattattatgtcttatgtattaatttttgttttaattattgtaaagtctccattctataaacaaaaatattgagatgcaaagaagttgagaaatttccccaaagtcacatgacttgtgaattttgtgtcacttttttctacataatatttatccaatactttatctagtttagtggactgctcctattttttttacagtttttgcttcatcctgtcacatattctaagggataggttgagacatcatgagcaaatacctttaacgttaaatctgtgagtatgtgaatatttcagcctgaagttataggaggaaaagcaagaattattataccaaagcattgcagaaactcagaaaaggtggagaggaaattccagatatgtagtaattggttacagtaaatcccacgtatttgtctgttagtattggcagaattgttaaagccttgagtttgttcaacacaaaaggtacagaaggatattagatttgattgttagagtggagtggaagtgataacacaattaattgttaaaaattagccttttttgcattataaattctgcaagaatataaactatctcacagttggacaaaaaaagaaaaggttgcagaaagcacaccaaatgcactcttttgaagagcataatttgggctatatgttttgctttacccatgaagaaacagcacgtaagaaatacattatcctggaccaaccaggctttcggggatcacagatgtttgtctccatcacaattaaattttcagtgaataaaatacctgctggaatgtgtatttttcctgcctaggcttatgctaaccgtttatgattaataagcttcagaaaccgacgattgtggaatgaatatgacatttaacataacataagcctgaacgggagtcagtgacccagataacatcaatatgctgacactacatgccaatattttgctataaaactctttctttgacacatctaggttggtatgagatatcatctgtcctctacaggtggcctctaggcaaactgagaagaaaaatgtgtgcatatatacaggacatagtttcaccttctcattaatcatctaggaattgggtgaaacatttttgtaatggcagcgtgataaatggactgatttagattttagttaaaataataagtacaacacatttcagatgtatagaatatttttaaaggatacttccagaactacaaaccaactgtcacagatattaacgtgtttgacataaacttaatgtttttaatgaaaattttacacattcagtggactattgatgtcttccattctctctctctctccctcttaagaggtaattatgactttaaatctgtatgtgttctccttatccatatttttatacatttgatgtatttattggtatcaataaatacatttgcatttttatgacattataaaaatgatataatacatgaattgtttcatacttcctttattgactctatgctcttgttaattatctaaaatacatgtaaatatgtccatgtatttctagtttgtacttatgtctactttatcatttgtatggtatttctttccttattgtgatatgtatttcaatattcccctttcgaagatcacttatgcagtttctttttttgcctattaaaatatatctctgaaaaaaacccatcaacagttgtgtattctagtgataggtcttcagaactgaaattagtatacaagggagatgcgtatcttctattgtaccagataatataataataatattctaagtggttataacagatgacatggttagcagaaaactaatatcatttcattttctacatttagacaaaaactaaaaaaaaaaaccaaaaatttgaattgagccaatagaaattgtgaaatatatgttatatttgttccataatttcttttgatttattacaagtgacattaaacattttttcctatgtttattgtctgatttaggttaactttgagttaaccatccatctaattttccctttctgttgtgctgtctaaatgtatttatggatttaaaatatttatatatcttggatatataccactgatgattacatgtctgcaaatatagcttcatacgctctcacttatcttttaacttcatgcagttgtattttaccatgcaaaatttgaaagcattcattttatcaaaattctttattatttattaggttgggttgtctgtaacttgtgttattattctactgcaaataaaataactacattactgttatttatcctagatttttttctatttatttttatgtctttttatctatctggaatatatatattttttgtgcatggtgtatcattgaaatctaactgtatctctctatatatgtatacatgtgtgtacatatatacatatatatttatacactcacatatatacacatatgtctttttctaaaaaatggagatgtcttgctctagaattacatatcgtttagcttattatttattccattgattttataatgtcacttctattgcatggcaatatttatataatcattagcctgtagcttgtatctctatgctattccagttttcttttgtcaccttcagataataagccattaacatgacttactgtagtacaggtgcatttcttttagtattttctttcttcaacttttaaaatttagtttttataaaactctgttttgtatgagttttaaaaagaatgtaacaagtttatttacaaaatgtgtatatttactagtaatccacttagaaatagataaattgatagttttacctattccttatatatttcaaaaattaaatttagtttaatgtaataccttaatagaagaaaatatatcaaaatatgtttataaattcaaggtaaggatgaatccctagagcaagtcccaataagcaaaatctataaaattaaacttctaataagtttgattgtaacaaaaattaaataaaaagcaacaagcaactgcagtatgcttaaatattcttataacaaagtacaattttatacgtgattctgaaagaatccattttcaaatagatataatagacaaaggataagttgtcaaaaaatattgaaaaatgcctctaattgattagatcaggtcaaaaaagttgattaaaatattggaacaatatagacatgaaactgaaaataaatgaatatttgaaaagatactctaactcactaatcagggtagtgaagatttacccaaccaaaataccattcgttttggcaacctagaaaaatacattcattttgggctgggcctggtggctcacgtctgtaatgccagcactttgggaggacgaggcaggcgaatcacgaggtcaggagattgagaccatcctggctaacatggtgaaacgccgtctttactaaaaatacaaaaattagccgggcgtggtggcgcacgcctgtagtcccagctactcaggaggctgaggcaggagaaccgtttgaactcgggaggcaacggttccagtgagccgagattgtgccactgcactccagcctggtgacacagcgagactccatctcaaaaaaaaaaaaaaaaagcattttgtttggagttcagcttgtgtagctattttaagaagaaattagatatttgtaatgaattaaaaatctacatgactatttcctattaacttcacttcttgacaagtatcaaagagaaagatgtgcacataagcacaagtgacatacacaaggaaaacatatccaactttgttttcctagtggaaaataaaaacatttttattattcatctcaactatataacactttgcaagaatataatacagattggtttcctcttagcttttccctaagtcaacttttgcaaagaaacctcccagtcaggttacaaacccattcccttacctgctcctcttcctgagaaaaaacttcaaccatcatgacccaacattatcataaatgtctttccttcatttttttgcttctctttttttactgctgctaggtcagtgaggctggctgcattctcacatgtagtatacagaaaatatttctgagtgcttcctttgaaggtatgaacttttccacaaaagggagtcaaggcatacattttatcagatatccaaaccacgtcctcccaatttgctaaagaattgttgaccagcctgaccaacatggagaaaccccatctctactaaaaatacaaaattagccgggcatggtgacgcatgcctgcaatcccagctactcgggaggctgaggcaggagaatcgcttgaacctgggaggcggaggttgcggtgagcccagattgcaccattccactcctgggcaacaagagtgaactctgtctcaaaacaaacaaacaaacaaaacaaaaaacaaaacaaaacaaaacaaaaaacgaagtgtttactgtgttcttgatttcttgagcatgtgagccttagtaggcgcgaatgctttgcttgccctttaattatcagtttcctgtctttatacacaattagatccacaagaatatattccaaatatatatgtctaaattcagtttgatttactcacacacttttgaaaatagaattgaaagtagttgtcattgtatcacttaggtatcaactgcaggcagcaattctccataattcatcctggccaaaggcaagatcccctttcctcaacatgcccttatttattctgtggaggaatattcctgtgctcctccttttcagcaccattatcatttcacaatattttatctcttcttgattgtgagagtggcacagaaggcaagatacagcagggtattttttcagtattctggttctcccataatatttcaggcaatggcataattgtacttctggttctctttgagattggttttggctatgttgctagttttggctgatgggctggaagggaaagagagaaatgcaccacttctgggatgatgtatataatgctgaagtaagatcctctagaaatctctttgcctccgctatgtttcgtgaacaatgttctagattgttggctgatccataagcctgggtcctagaatgaggtcaaccacaatgtgagagcagagcctcagattacctttcaaaattatgatgtgagtgagaaataaacctctgatgtttaaagccactttagttgggtttagtttgttcatgtgtataaccctagcctatatattcttactgatacacagactatgcttttagttcacaatctcttgcttttaagttaaaacatactttaaaaattgtcacctcctttgaatgttttgtgacagtcttccaaatttctagattttgagacaatttgaaatcaaggtttctctagtaatttttctagttctggagtttaatttcacaacacttttgaacacactagattctatatgagttcattaagctctctccacaatttaaatgagtaaaaaaatcaattttgttgcttcaagaaccaggcatgaaaataaataaagggagaacaagtgacatcttgataggactttctacctgccaaatttctatcttgtaagtcatgcaaatgttccctttttttcaatcttcaaacttatcttgttgagctattattaacaacacctgtgtatgcattctcacacaaacattcatacacacacacacatacgcactcatagcttaacttattaagaagatttaggtaggacatgtcagcatctcagcaaactttgtcactaatgctcccttttaatccaggaagtcatggtttctgctaagtttaaaaactgactgtataactcattaatactcttccaaatatatctgcatatttacatttctgaaacttaaaagcaaataatttatcccttagtttaggcttgcattctccatcagcttttcattgagaaaataagttctgattttggaattggaaatgcaggttaggacattaaaggcaacaagtcaatgatgacagcattaaggaaagtgaggttttattcctttttaatctgcagttaacacattgagcactaactctgtgaatgggcctaaaatatgctgtcttttctaaaactctctcaccatttaccccaggaggtaggtattgtcaacccatctcacagatgagggacttgagacttggagcttaagaagtctcaggatcaatgaggtggccaatccaggtctcgaatacaagacgtgctcactgtagggcccaccctctgtcccttatactatgctgcacacattgttctctttttgttgacactctttatgggcttttctggtggtctaggtcatgagacctaatcaagaccaacatagacaacaacaaaaaacttagatcgtcatctcccaagagaacaaagtgtcaatttttgagtccttccaataaaatggtgaacagaaaaaaaataaaaacacagaagagaatcactacacctgctacataattgaagattttaagtactgagggtttttgttccctgctatgaaataattagtttatttaaacacaaagatacagaatacttatctggaaataaaaaaataaaatactttgataataacctggagtgaatcctttcttgagtgattcccctgaaatctagcaattacagtttgagttttctgttaattttctcaatgggacaagacaagagttcaatagaaataaaatttctaatcttaggcagttctttgtgacttatgagatatcatgatccccaaagtttttaaaggaaaacaaatacctatgattgagcaaaaactatttttaaagccttcaaggcaaaaccaatacgtgttcatggttacatggtagagagcctgtcagagagtgtttaatgaagagctaaagagttctgtgtcttggttagagggcatgcgatcttttcttacatgattatgatctcatgtgctgtgactttattttgttttgtggatatcctaatcataaaatatatagccatttgttatttttctggagtcatgtagtgcattacaaatcataggatctcaacaaggagaagttgagataccaatagcctgaaatatttacagtatgtataaaaaacacattttagaagttgaggtataaagtattgtccatataataatgaaagtatatggataaaaggagtcatgcaatactttcaagtgctaaacaccttctagactaaatagtagaaactaaatagattctacaaagtgagttctgaactggatgcattttctgaacttgcagcacatggagcaaatataagggaatttagcaaagtaagtaagaatttcacaatgcagggccttagaaggtagagcaaaaggttaaaattttactctgacatttttgggaaatcatcaccatagtgtcaacatctaattgcctctgcttgtatgtggtaacaagagaagaaggagggaaataaattaagttcaataaattatggttaaattttaaaataaaaactttggacaaattcaatttaatagagtttatttgagcaaggaaaagaaaaacgattcaggaatcaggtagctcttagaatcacagtagattcagatagactctggagcaactgtgcagctggaaaaaatttataaactgaaaaagataagtgatgacggaaagtggaagcgaagtacagaaactgccggactggttacatctttgcatttgccttatttgaacatggtttgaagagttgaccgtggatgagtggttgacatctgactactgggataggcttaaacacagctattgttatcaaagcataccattaagctctgttttcagattgcctacctactaagttagaatacaggttatccataatgactcacgtatttaagtacagaggctctctcaggccaggtttaattcgatttaccataaggtgcagtgagtcagacagtgtgatgacacattgggttagtggtaatgggagtgaagtaaagtgatcagataaacttaggatatagttttgactttaaaatggcgtgatttgctggttgcatgaatgtgaaatattgagaaatacagaggaatcgaattgtctcctatattttagtgtaaactattgagcaatgtagttttatgcagaatgacaaggaaagcagagggggagaatacatactacgggcagagagcaggaagtcaagtatttggttttggaaatgatacttttgagatgactatgacatatttaagtgctaatgtccatgagtttgtttaatgtttaaatcagggatgcagaacaggaacaagataccagcgttattgacaaaaggcctaggaaggagggaatagacattgaattagaaaagcagagggctcaggactaaaaacgccaatactgagaggtcatttataaagagaaaagtcaataatttaaagaagagaagattccaaggaggaaaagcagaacactttttctttgttaggaagttagagaaggagattgcttcaagaaagcaacagggaactggtccaaattatgtcacattttataaatacattatttataaaaacaagtaaacagaatcattttcactctgcactttcttaaagttttactgtatgtattagtccattttcatgctgctgataaagacatacccaagactggataatttataaagaaaacaaaggttaatggactcacagttccacatggctggggaggcctcacaatcatggcggaagagcaagggatgtcatcttacatggcggcaggcaagacagcatgagagccaagtgaaagaagaaacctcttataaaactatcagatctcgtgagacttattcactaccgagagaacagtatggaggaaaccgcccctatgattctgttgtctcctaccgggtcccacacaacacatgggaattatgggagctaaattcaagctgagatttgggtggggatgcagccaaaccatatcagtgtattaataaaaggtatactaatatatgtatgttaatatactgttttactattttctaaataaaaatttagaatgtagcttcaaaatttttcaacatgttgtacagtagaggaattctatatcttggccatatatgcttcattctgaaggaagtgtttgttagcataaagaaattcataaagatatatttattttaggttggagaataaagtgatgcaatcatgttgataagtaccaaaatgcacttaagaaaagttggaatacatttctgattttaggagaaaaaaactactaaccaataagaaatagacactttaaaaccataatgtagggtaactatgttcatacaatatatacaacaatataggtatgtatatttataatatagtgaactatattctcaaaaaaagttgagaaactaatgggggaaagatatatctattggttaacaattagaagactcaatcaaggagaatacctgaattctgtattactgcagtattcgttatatattcaatcaacactttaaatccaaaagaaaacttcaatcaatttacttatatctgtctaaactgtatttattactcagtctgcatcctaacatgtcactcagagaacacagcaatagtatactaactggcaattttcttcagccttgctcctccccaatttattagctgtacttcaggtagaattatgtaaaaacacaaattggatcatgccatttctacatgcttcacctttcattgaaggtagaattcatacttagtattcgaatttacaaagccctaggtgatatctaccctgtctactcataaaacctcatcttgcatcatcttgctttcttcttggtactcagtctcttctctacatcttttaagtcatttcaacttctcaaatttttaaatacaattttcgcttttatgcataccacttattctgcaagcaggtcctccattctttgcacacacagacattttgcctgagtgtatgctacctgcctgtcatgcctatgtttgtttttattgtttctggaaaggtacttaagaactgttaattatgagttatatttgcctttttatattctgcttcacatataactttgtgcttcccctatcattacataaccatggcttgtcattattacctgctaatttttccatatctcaatgaaactacaaagtttattggaagagataccatgatagcattcttccttgaatgcttgagtttagtggaggacttttctcatatgatgattaaataaagaaataaataagtaaaacacattgtctatggaattataaaaaataatactaagtatgcattttgtgaataaaatattgaagaatagactttaatatccttatttgaaataagtgcgattgtcaacacaagtctcagagctctcaaatctattagggaataataaaaaaatgaaaatatgatttttcaatgaaagaacacatgatataaagaacagtaattaaataaagaatataaataaatcaagattgttagggtaatggatacactaaatttagaaaaaataaaattgaatggattttctggagcagagacaagagcaattcaagaaaagcagccataaatctaagaaaagaccgtgcagatttcgttcaaggagcacaaacaagtgagtctctaaaaaattccaagaaaaaatgaagaagaaaaataaagcaagatgtggaggggggagatcaagtggtcccttgttgatgtggtcagggttgacatttcatttgagtttaactgaaagttactacctactcgtgagcaggtcggaatcatgatgtaatttttatttttaaaaagatcacttgggatgatgtgagaagataacacagagcaaagagttggaccaattaggaccaacctgtcattactaaaatgttgatagtttgctgagcatgttttcatgagaaaggacgtttgatttaaaaaaacaaacaaaaaaccatactgcactaaaagattaaatttggcatgctttaaactttacacctgagggaagtacttcaccctaaatctggccctgataaaacgcagcagttttaatgatagaccacataatctaagctgattaaaaaggaacttgaggatgttagtgtatgagtgacagtgagaatgcggtaggacctttctctctgtctgcccttaacattttttccttcatttcaaccttggtgaatctgacgattatgtgtcttggggttgctcttctcgaggagtatctttgtggtgttccctgtatttcctgaatttgagtgtttgcctgttttgttaggttggggaggttctcctggataatatcctgaagagtgttttccaacttggttccattctctccatcactttcaggtacaccaatcaaatgtaggtttggtcttttcacatagtcccatatttcttggaggctttgttcctttctttcttttttctctaatcttcatgctttatttcattaagctgatcttcagtctctgatatcctttcttccacttgatcgattcagctattgatacttatgtatgcttcatgaagttctgctgtttttcagctcaatcagttcatttatgttcttctgtaaactggttattctagctacgcagccacaaaaaaggatgagttcatgtcctttgcagcaaactaacacaggaacagaaaaccaaacaccgcatgttctcacgcataagtgggagttgaacaatgagaacacacagacacagggaggggaacatcatacactggggcctgtcgggaggtggggggctgggggaaggatagcattaggagaaatacctaatgtagatgacgtgttgatgggtgcagcaaaccgccatggcacgtgtatacctatgtaacaaacctgcgtgttctgcatgtgtgtcccagaacttaaagtataatttttaaaaaattaaaaataaataaataaataaaatttaaagagtgaaaaaaatagattgaatctaaatgatgtggttgtgattatttaacatctttcttcctcttaaatttttgcaatgacatgtattatttatataaacaaatttttcagtgtactagtaaattaatttacttgattcattaaaaatgcatttttttctaaaaattaatataatcatttaacaataccagggtaatgacaaattgaataattctttcagtatattttttcataagttgttcactagaggtgaattaattcagagatcgatatcttagttccagatctatttccacttatttagccatctaggtgtcatataaaacaatgaaagtaaaattgacaaagatcccacctgaatgagtgctttcctaaacttaataagtttacaagtcacctgaggatcttatcaaaatgaaaaactgatttattagatctgggaatgggcctgaaattctacacttcttacagccaaccttgacccaatgctgttggcttatgaaccacacttttattaccatgtcgcaagataaaaattcttctgagatcctactctggatttggagacaatgtgtttagttctaaaggaacaggtgaaagttaacagataaatttgaccaaacaaattatatcaaacattcatctgctaagctgaaagtagtctaaattttgctataattttatgcacaggagatagtgctatgtcctggacaccccttctgcatcacttataaataattggcctcaattttctcttttattccaagcagtccagtgactagtttcatacaccttcctttcatctccaacgtgaattatggcagcactttgccacaggaggattttgtgctctttgcttccatattaaaggattctctgttaatgcagtgtgagcttctgagggagactgttctgcaccatacttatgaatcaacagagttaaagctctagagggtgaagttttctagacaataaggaacaagagccagtaaacaaatagttttcccattctgtcttgcggtcatggatccaaccaatagtcacccatagcagtgggtcaaattgaagatgcatcctttattgtattctctttcgttcttgcttctttcctccaattcttattcccacctctgggcccacagttgtcaataaaaagacttgtaaacaaggctttgcctctgtactgctttccgttgagcccaggctaagaggttaaatgatttagtttgtccaggataaaaagattacttatctagattacttccctacatgaacagggaagatcaatatttctaaggaaattgtgtccagattaaagagtattgctttatatagtaaatccttttaaacacatgccacctttagttagttacaaaataaaaaaaaaagttgattagaattacactatttccttagacttttggttttggtggcattttaaatttaaagctccttactacttgtgactcttaaccgccctgactttgagaaaaaatttctctacctaacatctttgaacattttagtttgcatttgctttgaggtttattttatattttctggcatcaaactatcccattttcttattatgctgagtcccattagcatttcactttaatttattatgtttgatagcattaatattctttttttcattgacttgttttgattgtaaatttagttatactgtaggtgtaataaaagaaacaaatacaaaaacgaagaaaaaataacattactgaataatgtttatatctagttagtatacactgataggcatctcctttatattgatacctgtgcaaaatgaaaccttttatattttcttgataaaatagctagaatcttcttcagagttatttcctgcttttgttttatttttatatgcttccattacccttgtatacaaattatttcctggattgccagttccttgttaacaattttccagatgactgattaagaagtttctacaggtttgaagttgcatcagacttttcatgcaattggctaccaccttgtgatttccatgtactgctgacacaagatatttcttgccattagtctgtttttccccttagttgtataccagactttgcataggtcatctgtttaaatctataaaataaaatgtgaaatgtagcatctcaataacttttcccagctttcattaagtagcatcattcatcatctataatggcatcattttaagtactaaaacgcaacatattcaaacaatgaacacatgaataaaaacaagaaatgatttatttgaaaataaactctattaaaagcatgcagttaaaatgtttagcataaacattatgaccactgcataatcataaacttttactgaaataagtaactataggtactaaactaaattaaattcagtttactcatatatactcactctgatatttttaaatattattctggacttggttatatattctgtccttaatgttgagaatggcacaaacctaggcatcaacaattatctttagctaccctatgtttttatagggtatttaaaaactctatccatatttatcttctaagtgatttaattcaggatctgaacttagttgcctgatgaccaagaaactaatttatcatacccttaatattattgtaggattggtgatctgaattcctcataacagctagaaagtctcacctaaaattagcgtattaacaaaattctcaatacgaggaaatatcaagaaaattaagaaaatcacagaattagggcatgcattttacatatgtcaaaagaaaatgaagagatgggattacatgaaagaataagaaagtaaagaaccatatatgtggaagtttaacaataatgtgtagatagaaaaagggataaaattgattaagtgaaacaatatttattacaattaaaataattgtagatggaataagttctagtcttgaaaaatataagagaaagtttaaattatttagagaattctcaaaaaacacaattcaaataccgaagtgtttaaaatatgttaaaaatgttaaatgaaatagaaagcacatttaacagcttgagaaaacatctaacaggattcctagaatgagacactagaggaaattgtgaagaaactggcatttgaagggataataaaaggaggtactttcttagtgataattattcaggtgtgaagaaaataatgaatcctcagaaacaatgagttctgaatacaaagagaaaatataaaaataaatccatatctagagggcaggaaaatgtggaatactaaaaatgaagaaaacttggttaaaaatactgaaggaaaacatggtgttgtcctccaaaatgaataacagactaacagttcacttggtattagggaaaatacagtacaaaatagaagtataagtgctgaagggaaactgtgctatattacgtatccctactcagctaagccatcagaaaaacccttctagacattggcttagacaaagagtccatgggcaagaacccaaaagcaaatgcaaccaaaacaaagataaatagatgggatttaattgaactaaaatgcttctgcatagcagaagaaataatcagcagagaaaataaacaacccccagagtgggagaaaatattaccaactatgcattccacaaaaaactaatatccagattctgcaaggaacttgaacaaatcagcaagaaaaaaaataatcccatcaaaaagtgggctaagctcacacgtgggggtagcttactgcctggggtactacccttgcccatgcctctagctacaaaacaattcaattgttgtttttgtaaataaaatctcagctagctctgccaactgccaaaagaaaaaaagaaaaagtgggctaaggacatgaatagacagaccattctcaaaagatatacaaatggccaagaaacttgctcagcatcacctgttattagagaaatgcaaatcaaaaccacagtttgatacccccttactcctgcaagaatggccatgataaaaaaaaatagatgttggcatgaatgtggtgaaaaacgaacactttgacactgctggtgggaatgtaaaccagtacaaccactatggaaagtagtatgaatactccttaagaaactaatagtataactaccatttgactcagcaatcccactactgagtatctacccagaggaaaataagtcgttatatgaaaagggcacttgtacacacacttatagcagtacaatttgcattgcaaaaatatggaaccagcctaaatgcccattgataaataagtggttacatacatacatagtgaatgtgacatcaagaagacacaaaaggaaaatgtcaatatcaattatatattggttaggaaggattcatagacatataaaaaagaaagactaatggaatattttaacattaactatatatatatttataaattttattgaggtataatattcataaactaaaactttcttaaagatacaccccattacaagatatatagtatttatagaatcataaaaattcctcttgttttccttccagtaaatatttccccaaaatataaccactctgacttctacaaacacagagtaggcttgcctgtgtttgaaattaatatcataatatggtagattatactatttttatctgaattctcttgtagatcattgtaactgtcagattcattcatgtgttgcagtactgtggtagcacattcatattcattcttttgtagtaatgcacaatataaaaagcacaaattacttcctataatgttgagaaatatttgggtaattcatgtgttcattgtgaataaaactgttgttcttttaccattttagccatcatttgtgattttcaaaatttttaatgaagtttaaataatcaaatcttttagcatgtcaatacttttgttaactgctaataaatatttgtcttcttgaaagttgaagagatattcttctccattttcttctcaaaactttatcattgtactcaacattttggtctactattcattttaaattgataactctgtgtagtgtaaggtagtaatttagataattttttcccaaagtaggaatctaatttaagcattttttaaagcatttactcactgcaccactaaatttcaggagcaaatctgtcataatcaggtgatattatttgtgtggtatgattgtgtttctagattctccactaaattttattgatatttatacttgtttgtatcaatagcatttttaaattgtactgttattttatatgagttcttatctgatactatattctgcaacattgttatccttcaggactgctttcagtttttaagtcccttgcatttttattgcatcatcttatcaataactgccaaaaggaaaaaaaatcagttaagattttaatggagttttgcaccaaaagcaatggcaacaaaagccaaatttgacaaatgggatctaattaaactaaagagattctgcacagcaaaagaaaccaccatcagagtgaacattcaaaaatgacttcatcagatgaagtgtttcctcaatatgccagcagtcaacattataattaataataatattgtaagctttgaccctgttagttcaaggacataatgaagacttacatttctgagttataataaacattgtattaaatgtcctaaccagttcaataagaagtgaatagaaataaaaggcaatcatttttggaaagaacaacataaaattttcgtcgtttgcagactattagttttctaccaagaaaatgcaaaagaaagcactaattatcatttagatttaataagtgaatttgttaaaagtctttggatacaagacaattatataaaagtcaagttcgtacctagtaacaaccaataaaaattagaaagtttaaattattccaatttaaatagcatgcaatatatttaagaaaacagtaataaacagaataagttgtacaagtcttctcagaaaactggaagtattacttttgtacatattagttatactgatttttaaatactgtctatgataactctaaaatatggatcatcctatggcctcttctttacttgtactaaaaggaagaagtccttctcagatatgaagcagaagtctcaaaaattaaaagatttttctaagaaattccaacataaaatgggtagggaaaaaatgttcaaatcttttgatataaagcaaaacaaacgaaatagataattatcaataagataaaagtttaaattggcagcatacttcttatcaaaaaccctggctgtctgtagaaacacaagccaaactttcaacatctttattacacatacaattctatttatagcaaaaatgcactttcaatacatgtctgcatgtgtgtttgtgtatgtgtgtgagacagagagaaagccagagggatagagagagagaaggaaacagattagcatattatccaaagttttgtggatccagtcaaatttggacttgtcaaaattaaacacacactctctcagacacagaaacacacacattaaataacagtgcataaagatggaaattgtagttgttaatatatttggttaacaaaatttaaacacatcataatattctatgttgataagggtgtgttgaactcaggaaatctcaacttgataagcatttgagaaatacaagttgttaaatatatatttataaatataaataaatatatatttttatatatatataataaatatatatatgtttgattacacctttcttttacccaagttccatttgcttagaaattaatcttattgaaatagtcatatgttctaatcatttgatcaactctcttcattcatagctatccatcaaaaacatgccatccatatctgattcaatggtcaaaatacagacatggttttggatggtgtattgtgtatattttactaataagtatagggagaataaaagcaaatctgtaatattaagtagtagtaaacaagaagaaactaatctaactaggaagtagtagagatttagctaaagtgacagtcttaggtggagacctaaattaaagagtcattttggccatgtaataatagcatgttaacatgtggtgacggggtgggagaaagaaggcatgagtggcttatctcaggtccagaagaagcagggtggctgggtgtgaggggctatgagagagaatgatatggtttggctatgtccccacccaaatctcatcttgaattgtagctcccacaattcccatgtgttatgagagaaacctggtgggagattattgaatcatggggcagtttgtcccacattgttctcatgggagtgaataagtctcaccccatctgatagtttcccctttcgcttggctctcattctctcttgcctgctaccatgtaagacatggctttcaccttccgccatgattgtgaggcctccccagccacgtggaacatgaacacgagtccattaaacctctctttcttttcttttctcttttctttctctctctgtctctgtctctctctctttctttctttctctttctctctttctttctttctttctctttctttctctctctctctctctctctccctctccctctctctccctctctctctctctctctctttctttctttctgacggagtctcgctctgtcacctaagctggagcgcagtggcaccatctaggctcactgcaacctctgcctcccgggttcaagtgattctcttgcctcagtctcccaagtaactgggactacaggtgcccgccaccacacctggctaattttttgtatttttagtagagataggtttcaccgtgttagccaggatggtctccatctcctgacttcgtgatccacccgtcttggcctcctgaagtgctaagattacaggcgtgagccaccgtgcccggccgaaacctctttttctttaaaaattacccagtctgaggtatatctttataaacagcgtcaaaactggctaatacagagaataatggaagctgacgctagacagcaggcatggaaaggaaagtaatgcctggtcaccatcacaaagagttctattagtttcccagggctgctaaagcaaaattctacaaactggctagcttgcataagcagaaatagttctatgtgctagatttctgaaattaagctgcttgcagggtttgtttctactggaaactttgaggaaaatctattctatgtcctgccctttgcttctggagattgcagtcaatccttggcacgtagatgcatggctcaaaattctgtctctctcttcacatggcctctctgtgtgtccctttgtgcctctctttccaaatttatctcttataaggacatcagtcattggattaagacacatattgcacataaccaatacatgattacaactatacaaacccaaattccaacatacccttttgggagacaacattcaatgggatatcctgcatgagttttaagtcagaaagtaattttcaaatatttatattatttatttagagctgaattgtattgagctggaacagaaaagcaagactgaaagaaaaaaggccaactagattacttctgaggtaaatgatagaattggagaaaataaaataaggtagataagtagaagtgtagaaaagaagaaaaagttaagatatatttggagatgaaattcaaaggactttctttaaagagattaagagagtaaggaaattaaggaataataacatatgtatctatgtatatataactatgttgtttactgcacagtctttagcataatgtgattactattaatatagatgtctatccacagaagaatagttaaatttattagtatatagtccaactagagaatactgcgcactctctgaaaagaacaaaatgtcctacagataatggcataaacatagcatatcttccatattagttactagctgataaaagaaaaataaaatggacataaaatataatatttatatacatgtgtattttaattaaaggacatcattagaaaatcttaacaatgctttcttttgagtatggaactggattaagaaaaaaagagaaggctttgaaatttctatttacattatttctttattttgtcggcatgttaaatgatgtatacgtgtattatgcttggaataacaaacagatgctgcttttgttatttttataacatgatcatttacccaactttatggtttaaccctaaagagttcaattcagtatatttcttaattccataaaattataccatgtgattcattttacttgatttaacaaataaaaatataaatacattgtaattcatttttggtaaaccatttcacaaaagtgtggggaaattaatttgggaattactctcctcattgaaaaatatctcatttgctaaaataagacagtaaaacagtacagtttaaatatttataaaaataggaaagtttggcaaaaagagaggagtacacacctgtgactactgagttgctgtgaaaatttcatttcctgatacaaaattgtctaaagcacttggcttttgttcagtcacaatccaaagaacaaaaccagccaagttttatataacgaacatctagttccctagagccttgtatcagaaaacctacacaactttttgaattttctagttaaatttgcaataaagttgttaaatgtttttgggtatatagccctcaaattcttaatttgcttcatacattgcattggggttaaaattcatagtgtcaaaatcagctcctttcttacatgtggtataaaattctgtctgatgtttgtctgtctagctcctatcctatctaacacctatcttacttgactagatcctttataggtaccaataattacattatatttttaaggaaattttaaattcactgaaaagagctgaaagaaggacaaaagcagaaagggagaaatatattattttacattgaggacatattttgaaatgctttaattagtatgcagcaggaaggtataataacagctgtaacttccttgattggtgaaatgtcactccataatacaagtttatttacttttcaattattaattgaagagtcttatcattatttcatcctattactgatgaaaccaattactaaacctattactaaaaccaatactaatctaacatcaaactgatggtgaattctataaccttatttgtggttccaaatcttcaccttttaaaattttattttgcatcgtggccacttcctttctccttatacccaggacagtcatggaaattatttcatttctaggcctatgataggaaacataaattttattaaacaagaatgtccaaaagtacttagaaagtttcatgttattgatctcagtgatgattacatggttgttatcatgttgtgaaaaatttctgctgcaatatatttatgatttaagctttatttttcatatgtgttgtgtatcaataaaatctttacagaacgttatcatccaattaaacaccttatgaaattagaaaatcacacaagactgatggattaagatttaagggtgaaaatcacaggaaggcttgatgatttgaagctttcttttccctattgtatttgttatctgagacactgagaattgagacttagccaaggcagttggtctatgctggaatagaagaatgagcagagtatatggctttctgtcttccaaaaattcactaatatttttctctagataggaaaccattttatctttacaactttcttgtgaatttattatcttgatatatcattcttgatatttcaatgatgtttctagatcattgtaattgctgcatatctactaagttttctatttctttaggttcatttgtatcttattcttgaaaattttctattagaattgtgtattttactccttagagtgttttctcttaaacttaaaaaaggtgttctttagttctttagcttatctttcagggccttttcattttacccacttaccaatttctatgcttatttttcttgttggttattatattaatacaatttaattccacaaattagacactaatattttatcatttgtaacaaacaatacttttccaccataaaatcacagtttttcttatgattcatagtctgtctaataaatggcataatgtgaagacaaacattcccctaagtccttttgggtccttaaaataatttatataaatgtcatatcgttatagaaaatatgacatcagattttttcaaagtctttaaatatcttcttatatgttacttttctcatttttatacttgattctacatgagttattggaaattaccaaatatcttgtgtactgcaagttcatcatctaggattgaaacaaatgttggggcttatagatatactgtttacaagagtgtgtgtgtttgcatgtgtgcacgcttgtatgtgagtgtgtgtttaagcctcattttcatcggcaattatagaaacatttttcagtgagaggcttaaggtgtttttctgcatttaatccacagaaatgtttttcttcttacttggtaacttatagaattgctagtatttctgtctaaggggaggatggaaaataaacatagaatcatcagtgtgttctacatgattgtactgctggtatgtctaccttataaaaatgagagacaaatttagcttctggctctgagtgtgcgtagagttcagaataacatttctattaaaatatcttcaaaattgaacaaaatattggaaacatttttcttatatcagacaataggcagtgtagggctacgattcttaagagacaggaagctaacaaagtaagctcaacattttccccagacattttggccaaggacagttctacacagtagctaaaggaggagggactggaataaaaaccagcaatcttgctgagtggagcagacagaacacaaagttaagggaaaagaagaaaatgcggagaagaagtgttccaaaaatcttcgtaagtttggccttgagcctttggcatgcatagagtgaaattctacaagggaagactaagaaaatgttcctggaaaataattatgagggagttataattcagacaattcccagagctcatggatggcaacaaacctttgcgccctcactagctggagaatagaaggtggactaaatacaagcaatattgagtagagaccactatgcttgaaaaaataaattaatataaaataaaatattatctcttaaaaaataagacatttaaaatttattgtctttcctatggcctttgccagtttttgaaattaacgtgccagctttcataaagttggagaaatatttgtttattattgagaacatttttccaaaaataatttttatttctggaatttttaaattattcatacacaaaattttctgcaactgtacattttaaagccatatttttttcttcaacttttattttaaacaaatttacttttaaaattcttggctggccatggtggctcacgaatgtaatctcagcactttgaaatgccaaggtgggagtattgcttgaacttaggagttcataaccagcctgggcaacagaatgagacctcatctcttacaaaaattaaaaaataaaataaaattctagtatgtggcttcaatatgttcactctaattacattaagtaaaagatgagaatatgcccacatttatgctttcttctttaaaagtttccctttctaaataaccacacaagagatcattttccccacatgttaacatgctctaagatataagtctaaactgttatagtctaaattgcatttgtataatctctctctgaaaatattgactgatttctgctttaaaattattatcataattatcatgtcatgtattatcaccaaattcatttgatggtatcaccaaattcatttggtgataatcattctttttaaatagttaaaccattcttttagtcgtaattcaaaaaagatacttgcacacacatgtttatagcagcacaattcacaatagcaaaatcgtggaaccaactccaatgcccattgatcaacaagtggataaaaaaactgtgatatatatatatgatggaatactactcagccataaaaaggtatgaactaacagcatttacaatgacctggatgagattagagactattattctaagtgaaataactcagtaatggaaaagcaaacattgtatgttctctctaacatatgagacttaagctatgaggacccaaaggcataagaatgatacaatatactttggggaagagtgggagggggggcgaggcataaaagtcaacaagtatggttcagtgtataccggtcaggtgatgggtgcaccaggatctcacagatctccactaaagaagttactcatgtaaccaaatatcacctgtataccaataacttaaggaaaaataaaattttaaaaagaattttatataccaagtaaacccaggaaaaaaaggtaatagtactttttttttttgggcagaaaaaaaacccgaaaacactcttttaaaataactaaaccattcttcttaaatagttgttacattgtgagaaagaggtgatgaataattatagcatatctcattctgtgcacatttgcaaagctgttgcttttgatcctaaggatgataccttacttttatctttagttttttttctgattctgctgagatgtgtgcatttgttctttttcatgttaatttgagaaaagttttaattccccgtagtgagggtgaaattataacaaacactcatgtatattctaactagaattaaaaataacattaaaatttaacatgtttaactaaatctgctttaataaaaattacaaattttacagacacagtcaaaatagttttaaaaattcttcccacattctgttccactccctttcacactctcccaagcatcactattcttaacttaggctgtttatttctaaatgttgttaatattaaattctattccttatatattcattaataatagatacgtatatcttatatacaagtgtttttattaaatttacattgaacctgtggtatttaaagtataatctggtgacttgtttcttgatcaacacttgacattgaaaatctatccatataaaattgccagttcattaatttcaactgttgtatgacattaatgataatgcgatttattcattcattctcctagggatggctatttttgttacttctgaattctactacaaaagagtgctgcaataaaaatctttgaacaagttctaatgccgttcaactggaattgaagttttcaatcgttggatatgtcaaaatttaatcagattgtatattgctcaattactttcaaattatgtacaccaagtcattcttgctctggcaaaataagaatattttcattaatatatcattcaacttgaaattgcccagcttttccttctcatttccccccagtcaaatgagttgaattaatactgtctaaaaatatatattcatttgcttacctgttagtatttgttccatgtattaagaagctttgctagtatatgaaaatatatgtattaccatgtcttgtgaattagtacttttatcattttgaaatgtttgttttcatttctgctgaccgttctaacctgggtatctattttgactggtttttaatgtaactactaacatctttttatgttcagcactttttcacaattttactttcaatgtctttatttttaaaatgtatcttctgtagacagtgtacaggtggtcttgttttattgtaaatcaagtgacaatctctatttcataattgacatatttaatccatatatatttaatttaattgttgttattttgagacttaatatccagttttactattttggcccatttatttttggtttattttagatgtcttgccttatcttagattgattgatatttttagtatttaattacatttcttttataaatgtaatttcttgaatatttgtttttattttagcaattgctctgggaatataaaaatcatctttaaaatctatttagagttaatggtactactttatgcagtaggtaaaaacatttcactagcacaatttcatttgcaggcacctaaccttctgtgatagtattgtcttatattgttatatttatgagatacaatcactacagtaaaatactattttctattcattgtgccatcttataaataaacagatgaataaacagatatttttgaacaacctttgcttgccaagataaagtaacgggccagaatttcctttccaatagaaatcaaaaaacaaaagtttgaataacataaatgtcaacgttttcaacatccacaagacaccaggcatagaggggcagtgattcctgatagatggagaacaagcaagatgaatctgaaagggtttcttcaacttattgcctttcagcaagtttctagaccgcagcattgggaagagaacttagagagagccctgaagactcctgggttgaagagatggagctaagattccaggaagaccatggcaactagatctagtatagagtatccataacttttgggatatactgtctcccctcccatgggcatttgaaagattactgattgatatattcatgtgataaaagcacctggaagaattaaaggtaacaaaagcacctggaagaattaaaggtaacaacacccagggctatacaggatatggaatacttcttgtttccaatatcaagtctagaaaacctctttaattatgtaccgttggtagaatatttagaagattccgattgcagttgtgagcaacaagtaagccttagacgaagcacagatcaaatcacacctaaaaattttaaaagcaggatgaacagtgatcaagtaacttaacttcatgccagagaaaagcaaaagtatctatcatttatctatatctatctatctaatgtatatatctacacacacacgtatatatgcacacaaacatatttattactcaacaagataaaattcaccacctgtgacaagcaatcaaactttacaaggcaggcaaagaagctggaaaatatgatccatgccaatgaatcaataacaatctgttgaaacagtccttcaaatgacacagatgtgagaagtggaaaacaaagaatttaaaagttattataattcattttttatgtcctcaaattaaagagtcattttcattagaaataaacaagaataaaactaggaaaaaattacaatatttgaaataaataaactgcatagggcaaatgcagattcaacattgcaaaaaaaaaagattaatgaatatgaacacatagcagaagacaaggggaaacaatacaaaacaaaaaagtagagaatcaggggaaaacattattaaatataatgaaaaataattggcatatccaaagggagaataagaaaaaacaattggagaaatgacaactgaaaatttccccgatttgaagaatattgtaaatgcttagatccaagcagtttaatgaaccgtaagcacagaaggaggaggaagaggaggaggaggacagtgaaaaggacagggtgacaattacaccaagagggatgatataatttttcaaatccagtgataaaaaaatcttaaagaaaattgatgatggaagacacatttgtaagatactgtgaaataaaaaaagaatgttagcagattatgcatcaaaagcaatggaagtgagaagaaggtagagcaacactttcaactcatagaaaaaagggaaagaaaaagtctattttagatatctgtatccaggaaatattatattttaaaataagaattaaaaaaaggatttgttcagatttacaaaactttgttctgacgacaacaaaaaggattcaccacccgcagacccacagtgtgggaaatgtcaacggaagctcttcaggtggaaggcaaatgatataagattaattcagatttccataaagaaatgaagagcacaggaaaagagaacagtgtagatacatgcataagaatgttttccaaacatttaaatatctttatgacttaacttactttttaagcaaaagtaatattatcgattaactatactcattatagccttagaaaaacaagacctacaaatgtaaacatagacatacacaacttagtacagtaactgtttgtaaagagatacctcactttgcaaatacgtactaaaaattcctttaaataaattattttattttattattacctttaatacttttctacaaataagaatacttaaagattagaatctcaaaataataatctctcttgctgtcagtaataagcaacatatgtaatctcctaaattatccttaaagtcaaagtggaaaatatagtttttgtaaatttttgctaaacactagactattcagtaatttaactcatttaccaaaatattatgtttatagttatctttgattttactatagagtatttatttttttaaaattttattttaggttcagggcaatatgtgcaggtgtgttatataggtaaactcgtgcatgggggtttgttctacagattattttgtcaccctcgtactaagcctagtacccaatagttaattttttggatcccctctctcctcccacactctagcctcaagcacgccccattgtctgttattcccctctttgtggccatctgttattattgagctcccacttgtaagtgagaacatgcagtatttggttttctgttcctgagttagtttgctaagaataatggtctccagctctatccatgttgctgcaaaggacatggtcttgttcctttttatgactgcatagtattccatggtatatatgtaccacattttatttatccagtgtaccattgatgggcatttaggttgatttcatatctttgctattgttaatattgctgctgatcattagagaaatgcaaatgaaaaccacaatgagataccatctcacatcagttagaatggctattattaaaaagtcgaaaaacaacagatgctggtgaggctgcagagaaaagggaacacttatatcctgttggttggaatgcaaattaaatcaactattgtggaaagtagtgtgactgttcctcaaataagcattcttatttgtagaaaagatctagaagcagaaatagcatttgacccaataatcccattactgagtatataaccaaaggaatataaatcattttgtcataaagatacatgcatgtgtatgttcattgcaacactgtaaggcattttaattttcattctgacttgtctcttgatctcctctatattaagtcattttttccttcactaattaaaaatttcataagtcaactgtgttaacagtgatttacagtttttttctttgaggcacacattgcccatatttctcacacttattcttttctcaacactatcactaatattatttttcctaaaatgaatttttttacatcacttttccccatcaaaggttttttggagtctttttctaagaaagtattataatctggtcccaactcaatgagttgtcatacaaagtgcattgagcgaatctaaccacaataggtgcttaatacatccacttaaacaactttattccctgccactccacctcatatgtcatttattccaaacatggtgagctcttcataattatccgagtataactcaaggtcatcccttctaacagtttcatgctttttcacctattattttctgtcttcactcctactttgatcttttcaatagcatcagaagaagtgctcatggccttcctaattaggcatagttatcaccatctctcgactccctagtcctttgcttgaacaaaaccaaaactgtggtttattggaccttgctagttgcattttcaaccctaaaatcattgtacatgcttaggaataagtcatttctgaaattatggcatgagaataacaaagaatgttatttacggaactcagtagatcctggttagcctttagaagtgatcccagtgggctcctttataaaatatatttttatccattaaatattgacatccctacatctggcattgcaaactacacaactgcaagagaaatatggtcctgtcagtgaaaacaaaaaatgactttaagatgtaattttgataggttttggtacacgaaggtgtcatgtggcaggcatttagaaagtcttttcattgatattttactaaaaatttgaatagcttataaacgactttagatagtgtttttcctaagacattttttagagcatgttttagaaagagcggatggataatcctccaacccaggtgacgcacaagggcccaggagatcacaagagttacaggaaaacaggatgtgaagagatgcctcaggtgtgtttgaattgtaaacacttcagcattatttaggagcactctaatccacccttctcagagaattgctgacacacttcaggttaaccctaaatcctatttttagcttattgagaaatgtaacttccagatgtgcttttggttatgccaaaattttgcagtgaacatattttcaggcggtaaaattgcagaaacgtgactaacattttaaatgtcaaacaaagttctgtcatgagtgcattgattttttaaaagtctcatagtactaaaagtcttatatcaaaaccaagtcccttttgaaacccatattctcaggccacactctgttccccagttagtgactttcactgctttatttttacctgtatattttaaacaatatgtttataatttaattccttatggtacccactttagacgatatgcatttatttattggcctttagtggttgaaggatccatcttgtttacacagccatttctcacctttactttcctcatccatctaaaattcagccctatcacaatatttggtttcacgttattattgcatgcataattgttaccgggggtccttgctcccagagatcccaagatggcagcgggccgcttccaaaatggtggcaggccgcttccaagtggtggcaagcctcgtatactctgacctggggttcttggcctcacggattccaaggaatggaatcttgggccatgcagtgagtgttatagctctattagaagctgtgggtcatggaagagaaccgtggaacccagtgactagtgttcagctcgattaggacgaacccaggcacttagccgtgcaggaacaatggcaagcctttagcccgatcaggagcggcaattggcgccttgctggatcatgagcacagtggacaccctggtggatccggagggatggaactcagcagcgggtctgcgacggcggaaaacagcagtggtggacagccagcaaaactcagcttgagctgtaacaagcacagaccagaagagagcgcagttgcaagatttaatagagtgaaaaaagagctcccatacaaagggagggaacccaaagagggtagccgttgctggctccaatgcctgggtttatatcccgatcattgtccctcctgctgtgctctcaggcaataaatgattggctatttctttacctcctgtttttgcctaattagctttttagtgagctctctttactacctaattggttgggtgtgagctaagttgcaagcccgtgtttaaaggtagatgcggtcaccttcccagctaggcttagggcttcttagtcggcctagaaaatccacctagtcctgtctctcattatcatgttctgtttgaccatgtggtctgctatgattgttcctttattttacaacttatattttttacttaaattaataataactttgatttttgatgtttcttttgttagtttaacatttatctgctgctaaaatactttgcaagaattgataaccacttagaaattactgtccaaatgaaacagctccgttgtttggggtatattcactcgttcttggtttgggtagagaaagaattcaggacatggacacacatgaggatttaggagcagacgaggagtggatttaggagtggaaagtttaatggaaaataataggagagagagaaaaagcttccctgtgctgagaaagagggttgcccaaaagagggcctccagtttgcggaggaaggcagactgttttgtatagagactagaggaggaggtaattggtttacatagggtccaggggattggtttgacccagtgttccatctacatagcaagcgaaaagattggccctctaaccctaatcttttattatgcaaatgtggcctccattcagccgcggccctgatgcctgtatatgtggttttgagagctgacaacatgctagcagccctcgctcgctcttggtgcctcctcggcctcggcgtccactctggctgcgcttgagaagcccttcagcccaccgctgcactgtgggagccttctctgggctggctgaggctggagccggctccctctgcttgcagggaggtgtggagggagaggtgcgggcgggaaccgggggtgtgtgcggtgctcatggtccagtgtgagttcccagtgggcccaggcttggcaggccctgcacttggagtgggcggccagcgccgccagccctgggcagtgaggggcttagcacccaggccagcagctgcagaaggtgcaccgggtcccccagcactgctggcctgcccatgccatgctcgaattctcgctgggcctcagttgcatccccgtgtggcagggctcaggacctgcagcccgccatgcccaagccccccactgtggtgggctcctgcgtggcctgagcctccctgatgggcgccgccccctgctccgtggcacccggtcccatctaccacccaagagctgaggagtgcaggtgcgtggtgtgggactggcgggccgctctgcccacagccctggcacaggatccactaggcgaagccagctggcgtcctgagttgggtggggacttggagaacttttatgtctaggtagaggattgtaaatgcaccaatcagcactctgtgtctagctcaaggtttgtaaatgcaccaatcagtgctctgtgtctagctaatctagtggggacttggagaacttttgtgtctagctaaaggattgtaaatgcaccaatcagcactctgtgtctagctcaaggtttgtaaatgcaccaatcagcaccctgtcaaaacggaccaatcagctcttggtaaaatggaccaatcagctctctgtaaaatggaccaattagatctctgtaaaatgggccaatcagcaggatgtgggtggagtcagataagggaataaaagcaggctgccagctccagcagcggcaacctgctcgggtcctcttgtactgtgtagaaaccttgttctttcggtcttttgcaataaatcttgcggctgctcactctttgggtccgcactgcgtttgtgagctgtaacatttaccgcgaaggtctgcagcttcactcctgaagccagtgagatcacggacccaccagaaggaagaaactccaaacgcggccgaacatcagaaggaacaaactctggacacaccatctttaagaactgtaacactcaccgcacgtgtccgcggcttcattcttgaagtcagtgagaccaagaacccaccaattccggacagttttacctggaggctgccatgatactggtaagtgttgtgacaagaaagagagggcggaagatgccatattgaatgtacctggcttccaggtatagctgccagcatttacatataaaggctcctagtttgcatatctatgcctgtcttctcaggctgctttctgttagggaagaaacggtttgggggctgatttttattaaaggaaaattccacaagaactttcaccctttctagctgcctaagaattatttcttaactcctgtattacaagtatttaaacattttaaatgatctgtcagtgctggttggt

SEQ ID NO: 94 - DNA, 7288 bp, Homo sapiens
acctaggaccatctagttagttccacaaagacagatgttttgtgccaagtaagtatcatcctcatttacaagaggggtcacaaactgctggcctcccccaacttctacctatcaagttctgttaggcctacatcgtggaatttttgtttttgaatcagtattttaaaattgggtgattttggctgggcgcagtggctcatgcctgtaatcccggcactttgggagactgaggcaggtggatcacgaggtcaagagatggagaccatcctggccaacatggtgaaatcccatctctactaaaaatacaaaaattagccaggcatggtggcgtgtgcctgtagtcccaggtactcgggaggctgaggcaggagaactgcttgaacccaggaggcagaggttgcagtgagctgagatcatgccactgcaccccagcctggcaacagaacaagactccatctcaaaaaaaaaaaaaaaaaaaataggagatttcacatgaaggccagattttcagcttcttaggaaatattttaagatctggaacacagagcccactgttctattctggtgacaatggtttagaatagagtatcagttatcccttggctgggcacggtggcttacacctgtaatctcagaactttgggaggctaaggtgggcagatcacttgagcccaggagttcaagaccagtctggccaacattgcaaaactccatctctactaaacatacaaaaatgagccgggcgtacatgcctgtaatctcagctacttgggaggctaaggcacgagaatcgcttcaacctggaggcagaggttgcagtgagccaagatcgtgccaccacactccatcctgagccacagagtgaaactctcagaaaaaaaaaaaaaaaacagaaagaaaagaaaaaagaattgagtatcagttatccactttagatgactaactttccctcgttctcacctggccactttactcagtcacattagctgcctgattctgttagctgttgagtcaaaaactactcactaaaagcagtgtgttaggatgaattgaggacatgggagtacagtactacaatcctgagtatttcacatcagttactatacaatcccccaagaagaaggaagattgcattggagccaccctcctttttccataatggtttttaatagctcaactctgtctacttgggtaacttatgttagctacaacttcaagataaaaatcacattattgcagaatcttactgctgaaagagagattggaaatcatcgaaaccgaccctttcctttcaccaaaagtaactgaggccccaaaatcttaagtgaccctccagaacaggtgatggcagagccagtgccttctaactgatgttcagtccagtctccaaatttcccctttgtataagaataccagttgtatttgattagggcccaccctgatgacctcatttgtaaatacttatctccaagtaaagtcacattctgactttaaaaccacatcctgggggttaggatttcagcatatgaatttggaagtgggggacagagttcagctcataatacttcactctctccccaccagaatacatgtccttcacccaatgaaaatattccatcccaacaaccccaaacgtctttcagacatcaactctcaagtccaaaatctcatcttaaatatcataaaattgggtatgcgtgacactcagggtatgagtcatcctgaagcaaaattgttctctagctgtgtgtgaacctgggaaaccagacaaaaagttatctgcttccaaaacagaatggtgggacaggcatagaatatacattcccattctgtaagggagaagttgcagggggaaaaaaaaagaaagaatcatggttcccaagcaagtctgaagctagcgggggaaattccattccattttaaggcttgaaaataatcctctttggctagatgttctgtcctcagggctcacaggggaggggatgcatagccctgccttccaggcacagggtcacaggagccccacccccacagccctgggcaatagttctaccctctacaaccaaggaggagccagtcgctgaaccatctttgaagccattggtccttcatttcatcctgtctctgtccctttcagtccatgctgtcaatgtttctgctggtataaaattctcaaaaaccttattggcctcccatgcaagtcatgggggtccaagcagtcagacaagagggcactccgcggatctttttcagataaccacctctctatttctggcatctactgtggaggttgattggatccgtgagtcacgtacctaatttcgttagcacatggctgtccagccacacccttggcattctctcccaatctgaggtactgagagttaagcacttcgatgtagcagtttggcggggtggagcgcggggggggacacaattcacagctgaaatatttctttacttaagctaagactttatcccaattttggtatatctgaccagtcttactaaagctacattttgtaagaccagaaatgagtcttttcaaaaccaaaaggttggtgtgaggacagagaaagtaggcaagcggggagacaggagacgtctatgtgtgcagaaacctgcacctcttctcctccagctacccgtgcaggtcatttccccccaggcccatccaggtctagcgatgtcccagcactgccccctggtggagccctccaccggcctgcaggaagggcatgtgactgactccctcagcgccctgcagtcttgtcccctctggtcccaaaagtgtatcctgccttcgctttgcgataggtttcttcctgccctttgcctggaaattttatctctggttcttgcaaacattatttacagctgtctaattttttctgtctacctcacagctgccaaactaaagtaggtgggaagccattttccctctctaggtcaatgaataccccccgttctccacccgcgcttttgaagattccagcactgctgccaagtcaacccatctgcaggagaacgctttggaaaaaacagactttaaaaagaaaagcaaactgctcttagcccctgatagcttctccacaggagagggaatatggacagagctgaggttcaagacacatgtgctgtttgagctgaatctgtgctgttttcttctttccgtggttacccaacaacgaaggcgtgttgtaccttcttgccttcaaacctgttcctcctcccgtcagatgtccttactcctcaatttgaagttttccttcataggatttctgagaaggactttggaaaaagtgctccagatctctgccagttccttagccatgaaaaccaaacataaaagatcatctggggacattcattcagagcacgttacccacattccaccaccactactctgacagcacaaaacatataccaggagctggggttatgtggtgggggagtccttcctattgtaagccctaacattatgaccctctggggttaaattttataattttcatattgtggagtcccatattttgttctgctttccactagtccaggcttctgaggtcttctctgtgttcattgcttattaattttattcagcaaagattaattgagctcctgcaatgagacacacacactatgttaggtgctggggaacaaaatagggaagggccctaccctcagaaagcttgcaatttatgaaagaatactaacaaaacctgcaaagtggtattttaagttattttgtttcatttttgctattgaaacaaagaaactgagaatttggtatgattcaaaaaatgtttaggtacaagaaaaagaaaaaagcaagaagcacttgccagatttaactataattcctaaaaatgatgaacattttcatcttcaggaacatgaaacatcatcgactattctctacagacaacaggcaaaggttcttactggtccagtacatacaagtccttcaggaagaaaaacatgattctaccaggattgggttgaatagagagagaattgcagtttaagattcatgagtatggaaataaacagctcttatggctaataaactctctatgaactttaaaaagaaaacaagaaaaaaaaaagcatggctttttaaaatccaaagtccttgccttaggaagagacaggactaaagtaaaaataaatgaagtctgtttgaaactcatgagttgcacacctcatgttgccagaagctggtttaaaaagcagtctagctgggatttccatgcaaactcagcaagtcatgaatcaacttgaagccttgtctcccagaggccataggagctgggtgtgtcccagagatgctgtgtcctgattctgtggaaagggtggggaagagaggtcactgaggatgtttctggagaaagttgtgcatggctttccttcttagctaggagggaatagggggtgtgtcaggagggtgaatgggagaagtgagggcagatgagtggatgtgtgagtagtgttagcaagccagattaaacaaactgcttgtggtttaatctgatgctcaaataaaacactttgcctgtatttctaggtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaacctgacgtctgcattgtgcatctcaaaatcctaacagcattagtatctccttttcatttttattacctgttgaaaatgggtttactgaacctggttctttcctataatttttggattttaaaaaatgtgaatctttttgataactccaaaacaaattttttttttctttttttccagatggagtctcactctgtcgcccaggctggagtacagtggcgtgatctcagctcacggcaagctccgcttcccgggttcatgccattctcctgccttctcagcctcccgagtagctgggactacaggcgcctgccacacgcccggcttattttttgtatttttagtagagacggggtttcaccttgttagccaggatggtctcgatctcctgaccttgtgatccacacgcctcggcctcccaaagtgctgggattacagacatgaaccaccgcgcccagccacaaaattgtttttaaaaaaactattttacaaaatctttgaccgtaattatttttaagatgaaaaatatgttatataaattataaaatgttacttaacacaaatataagtattgattgcccaatgttgagagagatcaacaaatgatataaaaccattcactccaaaattataattacattttaaaattaaaaaatgaaaagcattaaactttttaatttgaaaaaaatttaaactcaaaaagttaatttaaaattagttacatttaaatgtaattaaatgctaaaaatctctcttccttccgtctctctgtctctctctttctcccacacacattcactctatatgccccccatttctgaaagcaaaattgatagaaatatagaatgcatctagcagcattaccatattagtttcctaactcatggagctgggacttttaagtaggaaagtcaagcagaaatccaccaaaacagaaaagcacagcaataccacatccttggaatgactgctgcagttagtacaggatcaaagacttgaaggatccagagttggtttccatcacaactacatgtatcttacctgtctgacctctattatgggttacattgtggcactgtgtccccctaaaatttatatgttgaacccgtaacccctagtgccttagaatatgactgtttttggagacagggcctttaaagaggggattaagttaaaatgaggccattaaaatgggccctaatccaatctgagtagtatctttgtaaaaagggggaattaggacacacaaagggacaccaggaatgtacatacacagaggaaagaccatgtgagggcatgggaagaaggttgccaactgcaagccaaggagagaggactcagaggaaccaaacctgctgacaccttgatcttggacttctagccaccagaactttgagaaaataaattaatattgtttaagccaccagtcagtggactgacattttgctatgtcagtaacagcaaattaatacgaactgtgtacaaacgatggatgaattttggaggatgataaattattgtaagcttacttaggcggtggctccactgatagcagtgtttccagaagtctttttgctggagtaaaacaatataatccctgggatatcgaatgaaggtactaaaaaatttttttttgtttttgaaacggagttttgctcttgtttcccaggctggagtgcaatggcaccatctcagctccctgcaatctccgcctccctggttcaaacgattctcctgcctcaacctcccaagtagctgggattgcaggcatgcaccaccaagccctgctaattttgtacttttcgtagagacgggtttctccatgttggtcaggctggtctcaaactcccgaccttaggtgatcacccgccttggcctctcaaagtactgggattacaggcgtgagccattgcgcccgtcctaaaattttcttgtagtgggaaaatggggtggcgaggctgggcgcagagaggctggggctgcggctcagcgtgggctcccctggtgcgcagcagcagctgcgaggagctcactgcggttctagccccgccgcagctg

SEQ ID NO: 95 - DNA, 8931 bp, Homo sapiens
ctgggatacacagaaaagtaagtattgtctgagggaacataaaacaagagaattactgccggcaacagtctatgcagagactgagggaaaattccactgtagcctcttcttttagccttcacacaggatctcctataaagagctccatttttaaaactacaatatgaatttaagagctgctgacagttacctgaaagttttactagtcacttggtcttgttagctagtaaaacctccaaatctaaagaggaaagaggcatgtctataaaattttatagggaaaaatgtagtgttagcaaaaaatatatattagggaaatttgtcctcattaacaacacaatgctgccttagttagctaaagggacctcaaattaaatagatacattattaaatgtaaccaatctcctttaaagtcacccagatctccactttctatgtgggtgcagtcacctgggagaggtcttactaccattctgctagagctctatctaagcagtgtgtgatgctccggccaccttgactcaccagtggctgtcacggaaagtctgaaagtggcaaagagctacaagcagtaaaagataatatttcgtggctggaaaaactcttttaacctgtgatttgatttctcttttgtttccatttatggcagagcctccatcttggcaaggcacgtaatcttatccaagctgtgcaaaacctgtccaaagtgtatgtacaataacataaaaattgaaaggtggaaaaagcgccagcacagacatgtagtgattgagtcctgcatgaaaatacatccaaaggcaagatggtttggagattttaggaagccctggctctttcctctgacacaatcacagcattctagacatccccagtaaatggactctgtgacacagacattgagcaccctgctttgtgccagacaccctgccaggagctcaatggaatcagacaaataacgcacagtgagtgcatggttactgtgcatggttactgaatcagacttttgtgtgtgtggatcctctaagattgtatgtgtcagggtattagccaatgttaaatggcgcagaggaatttgagggtttcttttctcatcagcttttgattttaatcaatgttctattagaaaaagtatcaacatttttaattctgttcaggccacagcttggggaacaagacactaatcttttaataatgttccacctgttcaatggaaatagtgatctttctccattaatttacagaagtatttagttacttgacaaaaatattttgagaacaaaatataaacctttctcagcttcttggaagaaaaactgtatttaaacttaaacgaatgtgtccaatatatgttattcaggaagtacttaagtacctgcttacacttgacttgattgatttgacagtcatttggccacagttctactacttctatgagaggatgacctgaaaaccactagagagaaatatccactctacattaatagaatactgctttttagcagctttgaatgaggagttaaaaatgaataatgaaattaaggttttttgaatgatttgtttaatttatgccattcttttaagtaacataagattgactaactttttttaaaaattcattttagatatgaaaattaagtttatgtacctaggaccatctagttagttccacaaagacagatgttttgtgccaagtaagtatcatcctcatttacaagaggggtcacaaactgctggcctcccccaacttctacctatcaagttctgttaggcctacatcgtggaatttttgtttttgaatcagtattttaaaattgggtgattttggctgggcgcagtggctcatgcctgtaatcccggcactttgggagactgaggcaggtggatcacgaggtcaagagatggagaccatcctggccaacatggtgaaatcccatctctactaaaaatacaaaaattagccaggcatggtggcgtgtgcctgtagtcccaggtactcgggaggctgaggcaggagaactgcttgaacccaggaggcagaggttgcagtgagctgagatcatgccactgcaccccagcctggcaacagaacaagactccatctcaaaaaaaaaaaaaaaaaaaataggagatttcacatgaaggccagattttcagcttcttaggaaatattttaagatctggaacacagagcccactgttctattctggtgacaatggtttagaatagagtatcagttatcccttggctgggcacggtggcttacacctgtaatctcagaactttgggaggctaaggtgggcagatcacttgagcccaggagttcaagaccagtctggccaacattgcaaaactccatctctactaaacatacaaaaatgagccgggcgtacatgcctgtaatctcagctacttgggaggctaaggcacgagaatcgcttcaacctggaggcagaggttgcagtgagccaagatcgtgccaccacactccatcctgagccacagagtgaaactctcagaaaaaaaaaaaaaaaacagaaagaaaagaaaaaagaattgagtatcagttatccactttagatgactaactttccctcgttctcacctggccactttactcagtcacattagctgcctgattctgttagctgttgagtcaaaaactactcactaaaagcagtgtgttaggatgaattgaggacatgggagtacagtactacaatcctgagtatttcacatcagttactatacaatcccccaagaagaaggaagattgcattggagccaccctcctttttccataatggtttttaatagctcaactctgtctacttgggtaacttatgttagctacaacttcaagataaaaatcacattattgcagaatcttactgctgaaagagagattggaaatcatcgaaaccgaccctttcctttcaccaaaagtaactgaggccccaaaatcttaagtgaccctccagaacaggtgatggcagagccagtgccttctaactgatgttcagtccagtctccaaatttcccctttgtataagaataccagttgtatttgattagggcccaccctgatgacctcatttgtaaatacttatctccaagtaaagtcacattctgactttaaaaccacatcctgggggttaggatttcagcatatgaatttggaagtgggggacagagttcagctcataatacttcactctctccccaccagaatacatgtccttcacccaatgaaaatattccatcccaacaaccccaaacgtctttcagacatcaactctcaagtccaaaatctcatcttaaatatcataaaattgggtatgcgtgacactcagggtatgagtcatcctgaagcaaaattgttctctagctgtgtgtgaacctgggaaaccagacaaaaagttatctgcttccaaaacagaatggtgggacaggcatagaatatacattcccattctgtaagggagaagttgcagggggaaaaaaaaagaaagaatcatggttcccaagcaagtctgaagctagcgggggaaattccattccattttaaggcttgaaaataatcctctttggctagatgttctgtcctcagggctcacaggggaggggatgcatagccctgccttccaggcacagggtcacaggagccccacccccacagccctgggcaatagttctaccctctacaaccaaggaggagccagtcgctgaaccatctttgaagccattggtccttcatttcatcctgtctctgtccctttcagtccatgctgtcaatgtttctgctggtataaaattctcaaaaaccttattggcctcccatgcaagtcatgggggtccaagcagtcagacaagagggcactccgcggatctttttcagataaccacctctctatttctggcatctactgtggaggttgattggatccgtgagtcacgtacctaatttcgttagcacatggctgtccagccacacccttggcattctctcccaatctgaggtactgagagttaagcacttcgatgtagcagtttggcggggtggagcgcggggggggacacaattcacagctgaaatatttctttacttaagctaagactttatcccaattttggtatatctgaccagtcttactaaagctacattttgtaagaccagaaatgagtcttttcaaaaccaaaaggttggtgtgaggacagagaaagtaggcaagcggggagacaggagacgtctatgtgtgcagaaacctgcacctcttctcctccagctacccgtgcaggtcatttccccccaggcccatccaggtctagcgatgtcccagcactgccccctggtggagccctccaccggcctgcaggaagggcatgtgactgactccctcagcgccctgcagtcttgtcccctctggtcccaaaagtgtatcctgccttcgctttgcgataggtttcttcctgccctttgcctggaaattttatctctggttcttgcaaacattatttacagctgtctaattttttctgtctacctcacagctgccaaactaaagtaggtgggaagccattttccctctctaggtcaatgaataccccccgttctccacccgcgcttttgaagattccagcactgctgccaagtcaacccatctgcaggagaacgctttggaaaaaacagactttaaaaagaaaagcaaactgctcttagcccctgatagcttctccacaggagagggaatatggacagagctgaggttcaagacacatgtgctgtttgagctgaatctgtgctgttttcttctttccgtggttacccaacaacgaaggcgtgttgtaccttcttgccttcaaacctgttcctcctcccgtcagatgtccttactcctcaatttgaagttttccttcataggatttctgagaaggactttggaaaaagtgctccagatctctgccagttccttagccatgaaaaccaaacataaaagatcatctggggacattcattcagagcacgttacccacattccaccaccactactctgacagcacaaaacatataccaggagctggggttatgtggtgggggagtccttcctattgtaagccctaacattatgaccctctggggttaaattttataattttcatattgtggagtcccatattttgttctgctttccactagtccaggcttctgaggtcttctctgtgttcattgcttattaattttattcagcaaagattaattgagctcctgcaatgagacacacacactatgttaggtgctggggaacaaaatagggaagggccctaccctcagaaagcttgcaatttatgaaagaatactaacaaaacctgcaaagtggtattttaagttattttgtttcatttttgctattgaaacaaagaaactgagaatttggtatgattcaaaaaatgtttaggtacaagaaaaagaaaaaagcaagaagcacttgccagatttaactataattcctaaaaatgatgaacattttcatcttcaggaacatgaaacatcatcgactattctctacagacaacaggcaaaggttcttactggtccagtacatacaagtccttcaggaagaaaaacatgattctaccaggattgggttgaatagagagagaattgcagtttaagattcatgagtatggaaataaacagctcttatggctaataaactctctatgaactttaaaaagaaaacaagaaaaaaaaaagcatggctttttaaaatccaaagtccttgccttaggaagagacaggactaaagtaaaaataaatgaagtctgtttgaaactcatgagttgcacacctcatgttgccagaagctggtttaaaaagcagtctagctgggatttccatgcaaactcagcaagtcatgaatcaacttgaagccttgtctcccagaggccataggagctgggtgtgtcccagagatgctgtgtcctgattctgtggaaagggtggggaagagaggtcactgaggatgtttctggagaaagttgtgcatggctttccttcttagctaggagggaatagggggtgtgtcaggagggtgaatgggagaagtgagggcagatgagtggatgtgtgagtagtgttagcaagccagattaaacaaactgcttgtggtttaatctgatgctcaaataaaacactttgcctgtatttctaggtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaacctgacgtctgcattgtgcatctcaaaatcctaacagcattagtatctccttttcatttttattacctgttgaaaatgggtttactgaacctggttctttcctataatttttggattttaaaaaatgtgaatctttttgataactccaaaacaaattttttttttctttttttccagatggagtctcactctgtcgcccaggctggagtacagtggcgtgatctcagctcacggcaagctccgcttcccgggttcatgccattctcctgccttctcagcctcccgagtagctgggactacaggcgcctgccacacgcccggcttattttttgtatttttagtagagacggggtttcaccttgttagccaggatggtctcgatctcctgaccttgtgatccacacgcctcggcctcccaaagtgctgggattacagacatgaaccaccgcgcccagccacaaaattgtttttaaaaaaactattttacaaaatctttgaccgtaattatttttaagatgaaaaatatgttatataaattataaaatgttacttaacacaaatataagtattgattgcccaatgttgagagagatcaacaaatgatataaaaccattcactccaaaattataattacattttaaaattaaaaaatgaaaagcattaaactttttaatttgaaaaaaatttaaactcaaaaagttaatttaaaattagttacatttaaatgtaattaaatgctaaaaatctctcttccttccgtctctctgtctctctctttctcccacacacattcactctatatgccccccatttctgaaagcaaaattgatagaaatatagaatgcatctagcagcattaccatattagtttcctaactcatggagctgggacttttaagtaggaaagtcaagcagaaatccaccaaaacagaaaagcacagcaataccacatccttggaatgactgctgcagttagtacaggatcaaagacttgaaggatccagagttggtttccatcacaactacatgtatcttacctgtctgacctctattatgggttacattgtggcactgtgtccccctaaaatttatatgttgaacccgtaacccctagtgccttagaatatgactgtttttggagacagggcctttaaagaggggattaagttaaaatgaggccattaaaatgggccctaatccaatctgagtagtatctttgtaaaaagggggaattaggacacacaaagggacaccaggaatgtacatacacagaggaaagaccatgtgagggcatgggaagaaggttgccaactgcaagccaaggagagaggactcagaggaaccaaacctgctgacaccttgatcttggacttctagccaccagaactttgagaaaataaattaatattgtttaagccaccagtcagtggactgacattttgctatgtcagtaacagcaaattaatacgaactgtgtacaaacgatggatgaattttggaggatgataaattattgtaagcttacttaggcggtggctccactgatagcagtgtttccagaagtctttttgctggagtaaaacaatataatccctgggatatcgaatgaaggtactaaaaaatttttttttgtttttgaaacggagttttgctcttgtttcccaggctggagtgcaatggcaccatctcagctccctgcaatctccgcctccctggttcaaacgattctcctgcctcaacctcccaagtagctgggattgcaggcatgcaccaccaagccctgctaattttgtacttttcgtagagacgggtttctccatgttggtcaggctggtctcaaactcccgaccttaggtgatcacccgccttggcctctcaaagtactgggattacaggcgtgagccattgcgcccgtcctaaaattttcttgtagtgggaaaatggggtggcgaggctgggcgcagagaggctggggctgcggctcagcgtgggctcccctggtgcgcagcagcagctgcgaggagctcactgcggttctagccccgccgcagctg

SEQ ID NO: 96 - DNA, 1760 bp, Homo sapiens
aaatcggctcaattacacagcaggagtatgataggggccctacttctccctcctgaggtcccaagtagaaatccaaagctctgcttattttcctggtgtgtagcagacagaactacactgccatgagccctttttcatttatttcttttttctttttttttgaggcagagtcttagtccattgcctgggctggagtgcagtggcgcaatcttactcactgcaacctccgcctcccgggttccagtgattctcctgcctcagcctcctcttgtagctgggattacaggtgcacgccaccacgtccagctaattttttttttgtatttttagtagagaatgggtttcaccatgttggcccagctggttttgaactcctggcctcaagtgatctgcctgccttggcctcccaaagtgcttggattacaggcatgagccaccacgtccggctgccccttttcctttttccttccccttcccctggcacggcgggggctccctgggcactcaccattctggcccagaggaagaagagcagttggtgggacaggcagtagcctgagcagccgggcttggtcatgaggctcctgcagaggtctgagaggccgcagggctcgctgctgtccgtcctgggggaaagtggttccaagctgttaaggatggagcgctgactctgccctgcgtcttcccagccccctagttgtagttgttggaactcccagtagattccagacacccagctgggcatgggggttgacagagacaatacagcagtcctgcattttgatttgctaaatctggctgccctagcccaggaaagatgacgctagagctattctggggttgaggaagccaccaaggctgaaacttcctattgctccatgggccaaatcacatcttttccagccccgaacagtgggtacttgaacccagaccacttggaatctgggcccaacatgcttattcctcctgcaccagccaggcgcggtggcttacacctataattctagcactttgggaggctgaggcaggcaagtcacctgaggtcaggagttcgagaccagcctggccaacatggtgaaaccctgtctctacaaaaaatacaaaaattagctgggtgtggtggcacgtgcctgtaatcccagctactcgggaggctgaggcaggagaatcacttgagaatcacttgaatccgggaggcagaggttgcagtgagttgagatcgcatcactgcactccagcctgggagacagagcgagactccatctcaaaataaataaataaaaataaaataaaataaagtaaaaataaaaaatacacacacaaatacaaaaattagccgggcatggtggcgcacatctgtaatcccagctactcaggaggctgaggcatgagaatcacttgaacctggtaggaggagcttgcagtgagccgagaaagaacacaccactgcactccagcctgggggacagtgagcctctgtctcaaaaaaataaaaataaataaaaatttttaaaaagcagaggtccttggctggggcccagcccctccgtgaatccagctgtgtcctggcctaagcactgctctgaaggatgctgacaggatgcggcctgggcaccggctgcccactttgcccatgggccctgcacctagggctgccctggggccttgttccaagcccaccaaacaccaggataaaatgaggagcccagctaggctcagtcctgtcttcctggagctgcatcctcactggggatggggac

SEQ ID NO: 97 - DNA, 1968 bp, Homo sapiens
aggtgttctactgagtgacagaagaagatgactggggattaaaacaataataccctaattggaaaattagctgtgggaaatcaggggttgataagcagccctcttttccatatcttctccttctgccccactctcctaccgtgcccccaccctacaccccacgggtttcccactccttctcagaggtctggagggcattctcccaccctttccagtggactacccacaggagccctgaagcaaatgcccgaaggaaattcctatcacctgtgtgctctgataggcacttggagctgggatgtggtactaatcagtaaaacataccccgtgccctttagcagctcacagttgatggcagtgagaaatttgtaaacaaaataatctttcaggagagactgcaaaactagaaacaaacgtagtggaggaactcttagaatgtggtccttttgaaaggactcacacccggcccccagagaatctgacttaattggcctgggttgagtatattgttggagagtgtcaaaacactccccaggtgattctgacattagccggggcccggaaccacccccgacctactgaatctgggactccaggagaggcccagccactagtggtttaacaagccccttgggtcaagtttgaaaaccaggggtctgggctgctaagtggcggcatgggaatggaaggttctggaaggtgagcagtgaggttggggcgcaggcctgggaagggagaggctcttcaacagccatcccccccaaccttgtctcagcctagggcaatgggcaggctctcccatcagagcctggcctgagccctcagaggcaggacctccttgagggatgtggaggtgtgaagaccagttctgagaccacagaggctcccttcaagcctcagtctctgaccctgcgggcattatttccatgacttccagtgttgtggctccttatcctttccccacaggctcgccccccaactgagggctggcttttttatttttttgagacggagtttcgctggttgcccaggttggagtgcaatggggcgatctcagctcactgcaacctctgcctcccaggttcaagcgattctctcgcctcagcctgccaagtagctgggattatagggacccaccaccacacctggctgtttttgttgttgttgttttggtatttttagtacagacggggattcgccgtgttggccaggctggtctcgaactcctgaccttaggtgatccatccgccttggcctcccaaagtgctcagattacaggcgtgagccagcacgcccggccgagggctggcttttaaaacaccgaaaacccagacaggaacggtgtccatctccaaccccagacggaaactgtgcccgcacccacaagaaaagcagtcctttgcccagagcaaccaaaccctgaaccccactctcgattcccctctgccccccaactcttccatcccagcggatgggaaacagcgagtccagccgcctccccacctcgggacccccctcccgggccaactgcgcagggcacgaccccgtcgtggtgccccgcgcgctcgacccccaggggttgaggtgaggagggatccccggtgtcccgggaagcgcggcggcttctgcgggttgcgggcggacccccctccccgtggggaggggctgcggccgcgcggagtcgccgcgggtcggaggctcctccccggggtggccgcgcaggaagcggggcgggtgggggcggtgcggggcgcgcacggggccggggcggcgggggaggcgcgggcctgggcggccagccccggcgcacagccgcggccggggcgcgcggcgcggggcggaaaagcctgtttacacagactgcacaccgcctggggaataatgcagtaaaggaagtgagccggctcggcctgactgctccaacttcctgctctcacacacaccagaggggaaaaaaaaagaggagcg

SEQ ID NO: 98 - DNA, 1971 bp, Homo sapiens
gttgttgttgttgttagtgccatatccaagtgtcactcttcagagcatgaatgggggtgcccgagggacttgggtgggggagtgaggagacaaacataaagaagacatctagggaagggaagaaccggaatggaataatcgagatgtgtttgcattcgtgcgtgtgtgtgtgtgtgtgtgtgtgtgtgtgtgtgtgtgtgtgcgcgcgcgcgcctgcggaggggggtggcaaggatccagaaggggagcccaccccttcttccgagctcagctctggggagccgggcgctcaggctcgccaggctgcaaagagagctgagagctgcctcgcgccccgcgcagaaccggcggtggaataaccagcgcctcaagtgtgtgcatctgggaccagggggcgggggagggggacctgcggccccgcggccaacccggttggtgcagacttggggatcccagaagggacagtgcccgcccagtcgcggcgattgagggtccctgtccgggcgcagctcgggccagccgcgtgctccggggccgcggcttctcccggaacccccgcgggcggggcctgccttccggagccggttggcggggggcgggcggcgccggggaaggggccgttactttcccagagcggcggggcgacgtcaggcggaagggcgcggggcgcgcacgctttaaatggcattcgctgtcatccgagctcagagccgtgtgggcagccgcgggctatataagccgcgagcctggccgccgcggggcagacggcgacagcagcggcggcgagcgcctcggagcgcggcggaacagcgccccccgagccccgtgccccccgacgggtccgcccgcccgcccgccctcccgaggagcgccggcccgggcccgcgagggccgccgccaccccgcagcagatttggatcccccgcccggcgagcccccggctgctgcctcccggggggccccggcgcagcggccgccctcggagagccccggcgccccgccgcccggccccgcagacgccggaggcgccatggccgccaagcccggcgagctgatgggcatctgctccagttaccaggcggtgatgccgcacttcgtgtgcctggccgacgagttcccgcagcccgtgcggcccgccaagctgcccaagggccggggccggctgcggcggccgcgccagtctcgcttcaagacgcagccggtgaccttcgacgagatccaggaggtggaggaggagggggtgtcccccatggaggaggagaaggccaagaagtcgttcctgcagagcctggagtgcctgcgccgcagcacgcagagcctgtcgctgcagcgggagcagctcagcagctgcaaactgaggaacagcctggactccagcgactccgactcggccctgtaaggggcgccgcccgcgggggggacgcgcgcgtccgcggtccgcgcggggaccggcgtgtgaaccccgagagtgcccgcgccctgctcccgggggacccgcaaggacccgggaccgccgctcctcgcgcgctcggactcccgccccgctgcgaaccggtcggtgcgcccctcgccgcgctcgccctggcccgggagcgccgggagcggggccgctttcctcgtccttgtaaatgtttattttttaactcttcccagtgcgaactctgctgtgagtgtgtgcggggaggcgcgcccgcgctgagtcggcggcgggtagccactccatgcccttgtccgatggtttgcaactccgattttgcacaccgctccaccgtgccccccagcgcacacccattcacactcacgccaacactctcgctgaacacttttataattgttaggcgtggccgttgggactttgggcgcagcgcggctgctactgcgtctggaggattgatatttatttttgcattgcgatggctgaaggcatttatttaacgatctttttacctggatatgtctgtgaggctcctg

SEQ ID NO: 99 - DNA, 2194 bp, Homo sapiens
cgtcgcttatcataacttgattccaggaattgtattcaaacttaagccacaaaattcaggttttgtttcaacagcaatagcagttttttttaatatgctagtggtcggtcacagaactatttccacaagttgaacagctgtgtctagtgcaaatctgaaggcagcgatgtaattcaatttggactcattcattagaaactgattttcagatgctaccactgcaagactactggagaaatgcaagctgcgctggagatggaattgttcgcagcggcacacaagtttttgcggcaaaggagagagctctaaaagaggaaatacaactagttcatgttaccatgaaccagcgcagtgggacccagaattactgaattaatagaaaactaaatacttctcttaagcagctatgataacttaagaaagtttccagggaagccgtttaatgaaaggaaacaaacaaaaagatgatttattcagtatcctgctccatttttttgaaaaattggaattcctacattccttaattctttgtacatctacactgtgaaagcaacacaaactcaaatggagattgcagcccaaatgaacttaaacctgctgtttaactttcttttgaagttatacatggaaatgaaacacaccacagcaactttcatgacatcttgctaacgaagtttgggttttgaaaaatggaatgactagttgactaaaaacacacacgcgcgcacacacacacacacacacacacacacaaaacaaggagttttgaaaataagcactaagcatctttccaaggaactcactcattccaagaaacttcggttctaactcgcaagctggcggctgctgtgagtgtcctctgaatgcagcctggtcaatgtgtcgccaatccagaaaacacactgccctacctttggccgcgatcttgctttctctaagcatcaaaggtaccctccgctgtcattcctctggacggccacgcgtgtggacacggccgcggatggatgcgtaggacattaccaaacaaacccacacgctgcactttacttcttccctcctggagtgccactagggtccccgcgaggagggctgatcgggtgcggggaggccgagtgcaccgggcgtgtgctgaccaactcgggcccagtgacagtcctgcgacgaacttccaccctcccgcgcggggcgaggggaacgggctgcggggcctgctccgagctcccggctcgatcggtatccgcgaccacgacccccggacgctctctttcaggtgggggtgacagcgcgccccgggcccccgccgccccggaccccctcctcacctgtgctgtcattcgccgagaaaccgggcgagctgagtttggctcttttggggttgggcggtccgtccagcaagttctcagccattttcacctgctcgcgaaaacagccccgggcacgggcggccgggccggcgagggcccggacgggggtcgggggccctgccggctgcgagggagaggagcgagcgcgggccgcgagcgggcgggcgggcgccgagggagagggagggcgcaggccgggtgggggaggcggcggccaaatctcagccacagcaacagcgccccgcagcgctcaccgcccgcccccggccgccgccgccgccgccggccgcggccccctcatcccctgcccgcctcccgagcgcgacactccgcggtgggggcgccccggcggcccggccgcccccccgggcccggctggcagcgacggcgcccggccgggcggctcaggcagtccccgagaacatggtgccgccgccgccgccgcctcgctccccccccgcgccccacttaatgaattcgctcgcggcccgacgacgagggggctccgggctccgctcccggcccgcggcccgccgccgccgccgccgtgaggaaaaacaatgcgccgagcggggtcgccgccgccgccgcggcccccccaccccccgttccgccgccgccgccgccgctgccgccgccgccgccgccgggctccgggaggccgagccgagaggcgagcggggccgccggggcgggcgccgagggccgggcggagcgggccggccgggcggagcggggtgcgcgggcggttgtggggcccgggaccggcggggccgagtagatcgcgctcgaagccccggtcgggtccgcgacaagatggcggctgttga

SEQ ID NO: 100 - DNA, 3707 bp, Homo sapiens
cgtcgcttatcataacttgattccaggaattgtattcaaacttaagccacaaaattcaggttttgtttcaacagcaatagcagttttttttaatatgctagtggtcggtcacagaactatttccacaagttgaacagctgtgtctagtgcaaatctgaaggcagcgatgtaattcaatttggactcattcattagaaactgattttcagatgctaccactgcaagactactggagaaatgcaagctgcgctggagatggaattgttcgcagcggcacacaagtttttgcggcaaaggagagagctctaaaagaggaaatacaactagttcatgttaccatgaaccagcgcagtgggacccagaattactgaattaatagaaaactaaatacttctcttaagcagctatgataacttaagaaagtttccagggaagccgtttaatgaaaggaaacaaacaaaaagatgatttattcagtatcctgctccatttttttgaaaaattggaattcctacattccttaattctttgtacatctacactgtgaaagcaacacaaactcaaatggagattgcagcccaaatgaacttaaacctgctgtttaactttcttttgaagttatacatggaaatgaaacacaccacagcaactttcatgacatcttgctaacgaagtttgggttttgaaaaatggaatgactagttgactaaaaacacacacgcgcgcacacacacacacacacacacacacacaaaacaaggagttttgaaaataagcactaagcatctttccaaggaactcactcattccaagaaacttcggttctaactcgcaagctggcggctgctgtgagtgtcctctgaatgcagcctggtcaatgtgtcgccaatccagaaaacacactgccctacctttggccgcgatcttgctttctctaagcatcaaaggtaccctccgctgtcattcctctggacggccacgcgtgtggacacggccgcggatggatgcgtaggacattaccaaacaaacccacacgctgcactttacttcttccctcctggagtgccactagggtccccgcgaggagggctgatcgggtgcggggaggccgagtgcaccgggcgtgtgctgaccaactcgggcccagtgacagtcctgcgacgaacttccaccctcccgcgcggggcgaggggaacgggctgcggggcctgctccgagctcccggctcgatcggtatccgcgaccacgacccccggacgctctctttcaggtgggggtgacagcgcgccccgggcccccgccgccccggaccccctcctcacctgtgctgtcattcgccgagaaaccgggcgagctgagtttggctcttttggggttgggcggtccgtccagcaagttctcagccattttcacctgctcgcgaaaacagccccgggcacgggcggccgggccggcgagggcccggacgggggtcgggggccctgccggctgcgagggagaggagcgagcgcgggccgcgagcgggcgggcgggcgccgagggagagggagggcgcaggccgggtgggggaggcggcggccaaatctcagccacagcaacagcgccccgcagcgctcaccgcccgcccccggccgccgccgccgccgccggccgcggccccctcatcccctgcccgcctcccgagcgcgacactccgcggtgggggcgccccggcggcccggccgcccccccgggcccggctggcagcgacggcgcccggccgggcggctcaggcagtccccgagaacatggtgccgccgccgccgccgcctcgctccccccccgcgccccacttaatgaattcgctcgcggcccgacgacgagggggctccgggctccgctcccggcccgcggcccgccgccgccgccgccgtgaggaaaaacaatgcgccgagcggggtcgccgccgccgccgcggcccccccaccccccgttccgccgccgccgccgccgctgccgccgccgccgccgccgggctccgggaggccgagccgagaggcgagcggggccgccggggcgggcgccgagggccgggcggagcgggccggccgggcggagcggggtgcgcgggcggttgtggggcccgggaccggcggggccgagtagatcgcgctcgaagccccggtcgggtccgcgacaagatggcggctgttgattcctcaattaaaaaaaaaagaaagttttttttcttctctttccagagcctgaacggggagggggtgggggcggggcacgccggtgcgtcacccccccgcggcgtcaccacgcacggcccccgccccgccccctccacctgcgccggccgtggcggaaagagccgagcgtgctcgggccgaagggctgaaggcgcggccgccaagcgtagggaagctggcggcccggcgcgggccaggcctgcggggcgcctgggctccgggctgagccacagcttttgttctgatggcgaccaggcgtagagggccggggctccgggccccagcgggctccgggagcggcggcctggccgcgggctgggctctcgggcgcggattcgacgccagcccgggcccgcccgtcccgctggggcggcgctgcgtgttcccagctcctcgcgtccccttccccagaccctcctaggtggcgtcggtcgggaacggtcggggcgaccccagcccaggccgcgccactagccttcgccgccggccagggaagtggaatggcctctgcaggttacagaccgcccttgggtcctgccgacgaggtgggcggatggggaaactgaggcggggggcgagcaactgctccaaagtggtcgaggcaggaagtggcagggccgggattcgggtcccgccctacctcgtgacactagggagtgagggggcctcacgcctgttcgcatcccaaggcggcagggcagacaccctcacctgtgagagcggggtggcgagggccggcctgggcggagaagggcccgcgcatcggggcttaagcctggacgctcaggccgcactccccgccccaggcaacttgcctggcgcctcgcaggtgccccagacaggggtgcgggcctggggagtcccccacgcgagaccacagcccgcgggacacttctacgaatacccgaggtgttcccatcccagttagttatctgcccctccaaacttgcccggcttcctcataaaggtatcagcagctccactgtttcctaagccagaaacccgtgagtcagcgcggactcctccctctcacccgccacgcgcccctctacccacggtctttacctgggagactgctcctcccgcactgtcccggtggctatggtggcagctactcacttaagtgttctttgctctccacgttgctccccacgcagcaccagagttaacatcccgaaaagagagggagaaaatctgtttaaaacaactccctggccaggcgcggtggcagatcacctgaggtcaggagttcaagaccagcctggccaacatggtgaaaccccatctctaccaaaaatacaaacattagctgggcgtggcggcgtgcgcctgtaatcccagctactcgggaggctgagatgcgagaatcacttgaactggggaggccagtaagccgggatctcgccattgcactccatcctgggcgacaagagtgaaactccgtctcaaaaacaaaacaaaacaaaacaaaat

SEQ ID NO: 101 - DNA, 3840 bp, Homo sapiens
ctataaatgagatagaagcaatctaagaaacatgtagtcatcttcttctctcaggttgtctggttctctgtcctgcagctagtcagtttttgagtcagtgacacactggttccttattcagagtaaggcaggaccaaacctcggtgctatgaggttcctgccttcctcactccaccaaggatacatttctgggagcacctggttggtaactacaccagcagtctgatggcaaagtctgctggagaaggttgagaaccaatccctttaagagcagtggttcccagctgggaatgactttgttcctcttggagacatctggcagtgtctgagacatctttggttttcacagctaggagtttgtgctctggtgggtatgagccagggatgctgcttgcatcccataatgaacagggcagctcccacaacaaaaattatccaacccagaatgtcagcagtgcaaattgagaaaccttactttgcagagctctcagagagcaggccggtggtggagaacatgaagttgatgggagagtgcattctgaaatcgggagtgtgagtccacctgggagtccctaaaggggagtcagggattatcaaaggtgcacttgaggccctggccagtatacctgtagtaaacgggaagcagcagttctggcttcttcttttcctgtgggggcaggatgacactttgatcctcaaactctgctgtctcttctgcctccagctgtttcaggagctccaggtcactggcagaggtaagctcatcccgaatgtgactccagtcgtactgctggcgcaggaagctctgccacttgttgggggatgccccaggccttcgaggacgcttgctctggatccatcgggctgtgcgctcgttcagcttttccagcacagtggcctcccacgctctggcctccttctcaggaggcagaagccaggcttctctttcctccaggttcacatctagagaaggtggccgacccagcatatctggatgcatgcagggatgatggatgagagggcggggtgcttcccggacggtgctggctggctttgatttcttcagcttcttttcgggattggcagagctttctgtcttcacagccagggaggtgtctcctgttaagggacttgaggaacccaggaacttgaagctaacaggtttctgaggccgggccttcctgatctggggagtatggatgatgtcattggtattgtagaggtggtcaaagctgtactggctataaggaatgctgggcaggcctcgctgccacaccacctcctgagagaaggtaaggtttgcagcagccattttcaaatattggctcttgcggtgtagacggtactgtgagctgaagaagaccataggcacactggagacagaggcacactcctccttgcctttcaattttgagtagtttaaaatcatgccccatcccagtcgtgggggcagtgactgatagaagcaatgggggagaaaggtctttcccttctgggtcctggtcataccgcgtcccagcaaatgcttccttccacactgcctggcctagaggaaaggcctggagatgagacctggcacctgttaagggaatgggaggaactgatgagaactctagagcagcagaaattggtagcccatagcagttcagaaagagaataacttgaaaaacagatggaaagggggtggggaagagccatgtgagttagaagaacaaaagaagaaaatggtgcaacatcctaaatatttcatgtatcagacccgtgtttttggttcttatacttgttcccaaagctcagaccctcatctccgtgtgagggatgactgcttttcagcagtatcccatgcttccagtttgtctttaaatgttgctttctttcattcaaaaggcttatagtgtaaagttcagactattcagcatggcattcagggttctccatgagtttggcctcagtttatgactttgtcctggcatgtaacctctgcttgagccagtccagtctcctggctgttctctgagtatcctctctccacataatgaagcttccttctgtgtcctctacatgaaatggcctttcgtacttgacacaaattctatccaatttccaggcccagctcaatttgtgctgctccataactctttcttgacctatccaggccaccaggtcatacccaagtttataaattcctcctggtctgtaccacttactttaactgttaatcctatgatacctcgcattgttaaatatttgagactctaattccattgcccagtgaccatgtctcccatttcttctgtctttcagagtcatccagcacacctattgctacatagtttttattgttaaaatatttaatagctgtaggccgggcgcagtggctcacgcctgtaatcccagcactttgggaggccgaggtgggtgggtcacctgaggtctggagtttgagaccagcctggccaacatggtgaaatcccatctctactaaaaatacaaaaaattagccaggcgcggtggcatgtgcctgtaatcccagctacttgggagattgaggcaggagaattgcttgaacccagggtgggggagattgcagtgagccaagatcatgccattgcacaccagcctgggcaacaagagcaaaactccgtctcaaaaaaaaaaaaaaaaaatatatatatatatatatatatatattatagctgtaacgtattttatcaaataggtaaatggttttgactcttcatgaattattggatgggttgtttccagattttagctagcatggcaaacactgtagataacaaatgcttagatttaatgttagtttagttttgttttgttttccttttgaagcattcccttggcctaataatgatagttttggaataaccttgctgaggattttacgtagggaagatattatgatcttcctttcctattttaagaagctgaggttcagagaggtaggtaaattgcttcagatcacatagcccgtaagcagaggagtcaggtttcaaatctagcctactagatcacaactctggagcacttaacctccgtgccacactggccttggcccaagcaccactccctaccactcactttgttggccttgcctctccaaggaacaggtaggcctccttatgtgtaaggatgaaggagagaccattattccatatgtttctatcctgctagtgtcaactcctgcccggtgtccaaggtgcccatgcagaccagatctgacttgtttctctttactccttaacacccagcacatagcctctctccctagggcatgatttctcttactgtcttccatgtgtaaaagtgaccgtattgtatttctttctgttaagggcaagttcttttttgtgtgttttttttcttttgttttgtttttttgagacagggtcttgttctgtcgcccaggctggagtgcagcactggcacgatcatagctcactgcagcctcaacctcctgggcccaagtaatcctcctacttcagcctcccaagtagctgggactacaggtgcatgcgccaccacacccagctatctgttttttatttttaatagagatggggtctcactatgttgcccaggctggtctcaaactcctggggtcaacaatctgcctgccttggcttctcaaagcgttgggattacaggtgtgagctacagcactcagcaaaggctcaactttcatctagatgccattaggccagaatcaataacctccctcaaattacgtgacacatgattaatatgctatcactccaggactttttgcacataaggctaaatgtaattgcttcatctcttcacaaccatgaaggcaacgtc

SEQ ID NO: 102 - DNA, 4555 bp, Homo sapiens
cattttatccaattagacaacaaatccccaaagtcagaaaaaccacgtgatatttgctggcatatccatgatgactactaattatgtatttggtaaatgtttgctgacaatatagcccatcaagaaatgatgggaggccgggcgaggtggctcacgcctgtaatcccagcactttgggaggccgaggcgggcggatcacgaggtcaggagatcgagaccatcctggctaacacagtgaaaccccgtctctgctaaaaacacaaaaaaattagctgagcgcggtggcaggcgcctgtagtcccagctattcgggaggctcaggcaggagaatggcgtgaacccgggaggcggagcttgcagtgagccgacatcgcgccactgcactccagcctgggcgacagagccagactccggctcaaaaaaaaaaaaaaaaaaaaaagatgggaaggctgggtgcgggtggctcatgcctgtaatcccagcactttgggaggctgaggcaggtggatcacttgaggccaggagtttgagaccagcttggctaacatggtgaaaccctgtctttactaaaaaaatattaatattagccgggtgtggtggctcacacaggtaatcccagctactcaggaggctgaggcgcgagaatcacttgaaaaccagaggtggaggttgtagtgagccaaggtcataacactgcactccagtctggatgaaagagcgagaaactctgtcccttaaaaaaaaagaaaacaaagaaatgatgggacagggtgagggtaggggagaggaaattctaacacaggtgatttccttctgacccacaacccccactttgctgttggtctggctgacgtggttcacaagggggatggtaacttagatggaacgtgtaaaccaatggaaacatgaaccttgattgaaaaatgaaaaatttctctagatcctgactaaggcaaggtcagcatgtttctcccacatgctggtccaaacagaagctttcttttacggcaggatagggatcagtcccttgtctaatcaaccagtggagttaatgagtatggcagaaggaagggagaggaaagatgacaaaaggagcaatgaaaaggaaacacctgacacatttatctttgtgagaagtgagaatcacctgtaaatgcctcagccaggaaggacaggtagggccctttataaaaggatttgtggaacttctggagtattttgtcattataacattttgttaatagattaacaaggctgggcgcagtagctcacacctataatcctagcactttgggaggccaaggcaggcggattcacttgaggtcaggagttcgaaaccagcttggccatcatggtgaaaccccgtctctactaaaattacaaaaaattagctgggcatgtggtatgcgcctgtaatcccagctactcaggaggctggggcggagaatctcttgaacctgagaggcggaggttgcagtgagccgagatcatgccaccccgactccagcctggacaacagagcgagactccatctcaaaaaaaaaaaaaaaaaaaagattaacaaaaacatggctgggcacagtggctcaagcctgtaatcccagcactttaggagggcagatcatttgagcccaggagtttgggactggcctaggcagcatagcgagaccccatctctacaaaaaatataaaaattagccaggcgttgtggtgcatgcctgtggtcccagctactgaggaggctgaggtgggagagtcacttgagcccagaaggttgaggttgcagtgagccaagatcttaccaccacacttcagcatgggcaacagagtgagaccccgtctcaaaaacaacaacaacaacaacaacaaacacaaaacacaaagaaacaaaaccgtgatagtaaggagagcagatgcctgcttttctgttgtgaagaaacttgggaaccactgtggaaacaggagaggggaaaggagctgtcatggacccttgctgagctccttccttcccccagccttttctcccatccctccccttacctggaaggtcctctctcctcctctctgcctaaatcttgtgccatctcagatccaacacaaattcccatgtctccatgacgactcctgccccccttccctgaactcctacagcacatctgctgtataccacacaattctcactaaattaagcatattgtctttgaaaggttcttgtgtgtctgtcttctaaaaccccttgtaaactcctcgaggacaagggccatttcttctgctgctgctccgtctcccacagtgctgatggcctaatagaccctctgtatggtcttgctggctgactgactgaagggttcagttaggctctcttgctcctgccagcaaagcaaagagtgcacaataaagtcctttcactatgaaatgacaaattcaaagatagaggggctgagaaagtgctcatacagaattattcattgtcttgaatgtctcatagtagccagatcccagaatcctcaggttagatgcggaagtaactttgatccatgtgatagtgctttttagattagtatttcacttaaagggaaagtgtaaagtaatacacattccatgggttacatgagtcaaggaaagggaagagtttctgttacgaagttagctcatatccccaaagacccccccaccaccgtgtttcatagcagtcaggaatttatagaagaaaatattgcgtgcgctctctcactctctctctctctctctccatatatatatatatatatatatatatatatatatatatatatatattttttttttttttttttttttttttttagatggtggagccttactctgtcgctcaggctggagtgcagtggcgagatctcggctcaatgcaacatccgcctcccaggttcaaatgattctcctgcctcagtctccggagtagctgggattacaggtgcctgccaccatgccccgctaatttttgtatttttagtagagacggggtttcactatgttggccaggctggtctcgaaatcctgacctcaggtgatctgcctgcctcggcctcccaaagtgctgggattacaggcatgagcctccatgcccggccttgctttttatatttttgacaataacagagccacgggaagaaaggatgtgattaggggaagaaaaaaggggagaggttcatgttgtctttattttcattaatgaatgtctcaaacattttagggtataaatagcaatcagtatttaggaaaggaagctggattcacactacttggaaatctgggtctttactcatccatggcaatttttgggtatcatgtgctcttacagaatctcatcttatgatatagattcagtttacagctattctatgatgcttgagtatttcaaatattaagtacattgaggctcatgagaattgctaatctgccgtgtgaaactgcagagttgtttcccaagggtagagatgcattcacatccacccacatagtacaaagggggaaatgattacgctggcctggattttttgtaatagtcccgtgacatggcttccacattgctctgtgggctgtggttaaagaacctaatctagaacaagacaagacttgtagatttaaaaagtcacctaagctgtttctttcctagacaaatgggattctagtttgggttttattttattttattattttttgagacagtctcattctgtcatccaggctggaatgctgtggcgcaatctcggctcactgcaaactctgccccctgggttcaagctattctcctgcctcagcccacctagtagctgggattacaggtgtgtgccaccacactcagctaatttttttgtatttttagtagagacgaggtttcaccatgttagccaggatggtttcaaactcctggcctcatgtgattcacccaccttggcctctcaaagtgctgggattataggcataagccacagtgcccagccctaatttgagtttcagagggcaatttgtaccgtttggaaaagatgctggatccttcaatattactgctttagaaagatttggaactctgacccatatttagtacatgacctttctggggcgtggaaaaatatgctctgtcatctaatgtgatgtcaattttctttaaccttccatgtaaatagtgcgcattaagacatgaggtctactgttaaataatttctctttataaacatagtgacaacaagattgtacagtatcaattaaaaagacccaatgtgaccaggtccactgcttcctgcatcttgaagtaagacaagtgttcagcttagagatgagcacctttctttccagagggagaagacatgatgggagaaaaaaatgttctctctgagaatttacccagataaagagctgggtagtcggatctaaatggtcccacagcaatccttttctcgggggaggtgcgtagatctttgacaagtgatgaacgaactttgcttcgtgtggttaggcctgggactgaactttgtaaccagggatttggtgcgcggggcttcacaggctgcagaga

SEQ ID NO: 103 - DNA, 5129 bp, Homo sapiens
tggtgcttttacatacaacattcaaatcccaacaatcacacaagaatattgattacctgtatagagctgatagcgagtattttccagcccaaggaggtagtttatcatggtagatttaccaacactccacggtcccaggaacagtaccatgggcttggaggtaatctctccatctgtgggcaacaggaagtagaaatggaataaaactaacaaaagttcacacaaggggtatggcaccgtactccaaagcatctcaccgtccatccaactgagttgtggaattctccatgaatcagacgtgtgtagcccccagtggcgcttctcttgctacgtaagtgtgatcacccagtaaaaagacacagaagtcacttttgggccttgcccagatccttggcacgtctgcccccaccacaagaaggatctcagtgaattcaacaaaccctgactccgaactcactctgggtgaggtctcctggttaaatctggaggagaaaagcccatagagaaaggaggacggagcttccacatggagagaatctgggttgagaatggaggatggatgtggagcagcttgtataatcttgggtggtctggactcagacccttcctgtctccagcctctgcagctctcctctcctccagcctggggctccccaaattcccaatacagcctaatcctggactctgaggccagtgtctctctctctctttctgccctcttttgtttagaatcagggtctccgttgcccaggctgaaatgcagtggtgcaattgtgccccactacaattactgggctcaagcaatcctcccacttcagcctcccaagtagtagctaggactacaggcatgcaccactatgcccagcaaatttaaaaatttttttttgtagagatggggtcttgcaacgttgctcaggctggtctcaaacttctgggctcaagcaatcttctcacttggctccccaaaatgctgggattacagctatgaaccattgcacttaccctcttctagggccactctcaaacactagcctctaaagtccatgacaaatttgccagtgcccaaaaccaaacaatgaactggcaattcttgggtcctgcatccaatgtccttccgaaggccatgttggggagatgaccctgcaagggccactccaggtgggtccctaagaggaaaaatagaatgctctcgtgctttcaaatccagtggacagggagggaaggggagaggctttcaacgtggggtgtggtcagtcttattgcagattttcaggcctcagctcttccagctcttctctggactacagcacagagggccagtcctgcataactcagcactgaagttctccagactcgtctccctgaggccagcaggccaccctaaaaacactaggcactccccttttgtttcatttatttatcatgattttaatttatttaatttcttggttcaaagatcaggaatataaaaaggtaaacagtgaaaagtctcccatctccatcccagtctgcctcagccctgacaccccctggaataggtaaccactgctgacttcttacatgttattttagacattttaatgcatatataagcaatatttgtagctaacatattccccatctttttttttttttttttttttttttgagacagtgtctcactctgtcgcccaaaccacagtgcagtggtgtgatcatagctcatatagcctcaacctcccaggctcaagcgatcctcccacctcagcctcctgagtagctgagaccacaggcatgtaccaccaagcccagctcatttttgtatttagagtagagatggggtcttgccatgttgcctaggctggtctccaactcctgggctcaagagatccacccaccttggcctcccaaagtgcttctattgcaggcatgagcccggcacccagcccctccccatcttcttttcttttcctttttttttttttttttttttgagacagagtcttgctctgttccccaggctagagtgcagtggcacaatctcagctcactgcagcctctgcctcctgggttcaagccattctcctgcctcagcctcccaagcagctgggactacaggtgcgtgccaccacgcctggctaatttttgtatttttagtagagatggggttttaccatgttgcccaggctggtctcgaactcttgacctcaagtgatccacctgcctcggcttcccaaagtgctgggattacaggcgtgagcccccacacccggccccatctttttacagagagcgttgccatatgcttcctcttctgtatcttgccttcggatgctctggtcttccttctccgaggctaaagctcagtcctaaccaggtggtgtcttatacatggcaggcacatgtacgttgcctgaaagcaacaccatggccctgccccatccctccctgtctgtgaatacacaggagacactcacatctctgtggaagtcaagccctggctgggggccaggaagggataaggaggctgagagggtggcaggaatccccagttacagccacagagatgtcacagtatcttaacaccggcccaggcgacaccaaggagagccctagatgttccggttctccgagacaaaccacaaacagggccctttcctggtgctgtggtttcggctcctcacagcagggggcaccgctggcctatacaggaggtgggaggtgagcctgggagaggttacaaggaagctggccagagactaggagttaagaaccaagcccaaaaggtgagtgcaggggcaaggaagcgggacctccctgcagagcgccatgccctggggactctggagctcctggccctgctgctgtacacacaagtttcctaggagggccaagactccgggtcttagggccaagagagaaagaaaaacccttcgggaggctctgcaagctcataccaatagctgtgcatccactacaaaggggggcgataattggctgctaggctacaaaaaatagtacaggtagctgtggaacagggtattccctgcttccagctgtgtgatcctgggtaacccagcacgtctctgggcctcaggctcccctctgtagagcaggaagaatacaaaccctattacaccctggccacttacagccatccagagcatcaaatgagatcatatagaaacagcccaattaacacagggaaagatttctaatctcattcaaaaaacaataagataccactgctaaattttttaaagatgagtaacatttttaaattgcattgctgttgggaaacaaggactctcatctactgttattgtgagtacaaattggtatcatgggagacaatatggcaacaactagcaaaatgtttaattccagggttccaatttttttttttttttgagacagggtctcactctgtcgcccaggctggagtgcagtggtgcaatctcagtttactgcaatctctgcctcccaggctcaaatgatcctcctgcctcagcctcccgagtagctgggaccacaggcgcatgccaccatgtccagctatttttttctttttttgagatggagtctcactctgtcacccaggctggagtgcagtggcacaatctcggctcactgcaacctctgcctccccagttcaagtgattctcgtacctcagcttccccagtagctgggattataggcacccaccaccacacccagccaatttttggatttttagtagaggcagggttctgccatgttggccaggctggtctcaaactcctggcctcaagggatctgctcgcctcagcctcccaaactgctgggactataggtgtgagccactgtgcccggccatcggattgtttttaaaagtgctatgagccatcacgctgggcccaatttttgtgtgtgtgttttgtttgtttgtttgtttgtttgtttgtttgttttgagatggagtcttgctctgttacccaggctggagtgcagtggcacaatctcagctcactgcaacctctgcctcccgggttcaagcaattctgttgcctcaccctcctgagtagctaggattacagccgccagccactaggcagggctaatttttgtatttttaatagaaacggggtttcaccatgttggctgggctggtctcgaactcctgacctcatgatctgcccgccttggcctcctaaagtgctggtattacaggtgtgagccaccacgcccgcccctaatttttgtattttttgtagagatggggtctgactatgtttcccaggctggtctcaaactcctgggctcaagccatcctcccacctctgcctcccaaagtactgagattacaggcgtgagccaccaggagggtgctggttttccagagcatggcgtggtcacgcaggggaggagcacacagctgtcagagggaaggagggaggtttccacacacacagctcacctaacaggatcccatgtttgtaaaaacaaaaaacaacatccatctatgtgctcacacatgaagaggaaatgcttggaaggcttcactataacgatgtgtttctctgggagtcgaattaaagaagttggaggtcggctgggagcggtggctcacgcttgtaatcccagcactttgggaggccgaagcgggcagatcacgaggtccgcagacagagaccatcctggctaacatggtgaaaccccatctctactaaaaatacaaaaaattggccaggcgtggtggcaggtgcctgtagtcccagctattcgggaggctgaggcagaagaatggcgtgaacctgggaggcagagcttgcagtgagccgagattgcgccactgcactccagtatgagtgacagagcgagactccatctcaaaaaaaaaaaagctggaggtcaagaatataatttttatttttcaacgtataccattctgcactatttgaatttttgcaacaagtgtgtcttatttttattattttgaaaatcaattttgtaaagaatccaggcccaagggaagcagagtggaagggcaatagcaggaggggaaggaacggagtgatcagaggactcaggcaccacccatgagtagacagggggcacctgtggcctctggagcacaggagggattgaaataggcatcatcgcctttgaa

SEQ ID NO: 104 - DNA, 9525 bp, Homo sapiens
agataaggttagggtgttgggtaaatggctatggtgaggtcaactcctaccttcctctgactcacagcctcctccctcaccctcctgactgggctccctcactgaagcctcagctgaagattccaagtcaacactttattttgcagggcttctgctaatgtttctgaaagataacatcactgccaatcataacaccacttactgtatacctgctttgtgtcaggctgggatctaaatactttacatgtcttacaatcttattcagccctcacaataagccaacgagctaggtggatcaatacccctattttatattttttttactttgagacacggtctcaccctgtcaaccaggctggaatgcagtggtgcaaccttggctcaccgcaacctctgcctcccaggctcaggcagtcctcctatctcagcctctcaagtagctagaattacaggtatgtgccaccacgcccagctaatttttaacacaccccctttttttttttttttttttgagacaggagtcttgctctgtcacccaggttggagtgcagtggtgcaatctcagatcactgcaacctccacctcccaggttcaagtgattctcttgcctcacctcccaggttcaagtgattctcctgcctcagcctcccgagtagctaggactacaggcgtgtgccaccacatgcagctaatttttttatttttagtagagatggggttttgtcatgttgaccaggctggtcttgaactcctgaccccaggtgatctgcccacctcggcctcccaaagtgttgggattacaagcgtgagccaccacgcccagccaacacctctattttctaagggaagaaatgaagtctcagagaggttgagcaacttgtttaaagttgcaccgctgctactgcagctgggagatcccaaggttctggccgactccagagttcatgttcttaaggtccagtgtgtccagctgtgaatgctaaaactcccaaactcaaagtcaaggatctagtggaagcagggatgacctccataagcagcccaaacccagctctctggggcaaattcttttttttttctttttttttgagatggagtcttgctctgtcacccaggctggggtgcagtgatgtgatctcagctcactgctgactacacctcccaggtttaagcgattctctgcctcagcctcttgagtagctgggactacaggggcaagtaactctatcaggggtggggccaagaattatgaattcaaattgcttattctataaaccatactttcgtgttctaaacaaggtttagatagtggccacccttgtgtattaaaaatggtagcattctaaacccacataactatccaccatgttccacagaacatttctgtcactgtagaaagttctattggatggcaccgctctaaatgggaagatggacaggaaaggggcatgaagggaaccaggagactagttgaaaccggaataatatgccatatatacatttgtttaatgaaaagaaaacaatgttactgggttctagctggatattgttggaaaaacctctgaatttgagatcttttatctctgtcaaacagattaaggagtgttagagaggcattaaagacatagtcgcaccaaactgagactttctcccttttttttagagctagggtcttgctctgtcacccaagctggggtgcagtggcacctgtaacctcaaaccagtttgctgtaacctcaaactcaaaaaaaagactcaagggatcctcccacctcagccttccaaatagctgggactacaggtgcccattgagaaggagtcttgctctgttgcccaggctggagtgcagtggtgtgatcttggctcactgcaacctccacctcccgggttcaagtgattctcctgcctcagcctcccaagtaactgggattacagatgtgcaccaccacgcccagctaatttttgtatttttagtagagatgaggtttcaccatgttggtcaggctggtctcgaactcctgacctcaagtgatctgcccaccttggtctcccaaagtgctgggaatacaggcatgagccaccgtgcttggctaacacctggttaagttttaaactctttgtacagacagggtctccctatgttgccaacgccggtctcgaactcctggcctcaagcaatcctcccgcctcagcctcttaaagtgctgggattagaggcgtgagccagtgctcccagccatttgcttaattaggaggattgaaaacgaatagagaaaggaataacttttccagtctgcaattccatgttccttaatggtttttgctgccctgactgtgatcttgcttcctgccccacatattcaggcacggatcgagttcagctttgcaccccagcactctacagaagaaggcaccgaggcattgagaatggaggtcacctgtccacggtcacacagccggctagtggcagagccaggacccagacatggttcttcctagtggagatgagacaaaagacagatggacggctcccacctcacggagtttacattccaggaaggatggcgcaagctttaaacaattttcacctgattcattagttggccacaaacaggttgaatgcaagaagcttagggagttggccgggcacagtggctcacgcctgtaatcccagcactttgggaggccaaggcagatggatcacgaggtcaggagattgagaccatcctggctaacacggtgaaaccccgtctctactaaaaatacaaaaaattagccgggcgtggtggcaggtgcctgtagtcccagctattcgggaggctgaggcaggagaatggcatgaacctgggaggcagagcttgcagtgagctgacattgtgccattgcactccagcctgggcgacacagcgagactccatctcaaaaaaaaaaaaaaaaaaaaaaaaaacttagggagctaaagagcgcgtggtcagaggccctagtgtaggttagaggcttgggttgctcccctgaagaaggaatgcttaagccaaaactaaaatttcagtaggtattggcctggcgaagagaggagaaagaacattctagactaaaggaccagcctgtgtgaaggctgttagtgggaaggcagcttggcattgtagggacagtaggtgcctgaggtatacagagggaggggatggccggtggttcaagcagaggctggtgagggagacctcttgttcccctagtgatgctgatgtacccctttgctgtgtctccacccggccccaaaatgcggcttctcttggcacagacatgtccagggcttacctttcatttctgatgaccccaaagtgagtgttacagggtcctctctctttttggcttcctcccagaacacctgccctgatgtgttctgtggataaatgacatcttccaccaaggcgaggagactgttgatgtccatcaagttcactgagtcccagcccaaggcgggggatggcaccttgagagctttgaagagggagctgacgattcttgacacatcctggtggggaaaggggccataagccaaggtgaggggtgcagcacaggggtcaagagcacacgccctgggcctggcaacctgtgtagggacccctgctctgcccactgagatgtgatagtgacctccctgagcttccatttgtcagctcttgaatccctcttctagggtttgaactcattccaggctgtactcctcaaagcgtggcacacagtaggtgctcaatgaaagcttactgaatgcatcaacgcagagcggggagtctcgtccatgggcttccagcctgggagtctaccatgaaggcataattctttgcacacagtagatactcaaaaagtatgtgggtgtatgcgtgtgtgcacatgtgcatgtgtatgtacatgtctgtgtgtctctctgtgtatgtgtgtgcatgtatgcatatgtgcacctgtgtgtttgtgtgtgcatgtgtgtacagatgcatgggtgcatgcatgttgcatgtgtatgtgtgtcttcagttgatgaattttggcacctcacgttgccaggcaacacagggctgctgggtctcaagccccaggcctcacccccacttctgctgaggctacagcaccccccaggctagctgaggttgaggacctgccttggtcactgcctcaggtgtcagaaggccgtcctccatgggctgtggggagggagtcaggttgggggacccccggtcccattttccagtgttctgctccttcgcgacccggggacgggtgttctgaaagatctgaacaatcaggaggttgatggggaacatgaggatggagctctccaggccaatcatcacctcctgccaggtgaattcaattttacctggggaaagggaaggaagggatcaaagggagaggccaccgcccggagcccagtcccttctgccccttgtggaagctggctgtgcagtgaagggttaaccctgcccaacgcctgggaggtcaccgctcagcccttggaagttcccaactgctaagaatgtctttgtttccctagggtcttgggtcacaccggatggtctgtgctaatgatgagatttaggtgggggcctagaccatatgatgtcagcttgacctctagaggggctggaggcgaagggcagccaagtgggtgtcagccatgcctatatgttggagccccagtaaaagctctgaatagtggctgggcatggtggctcatgcctgtaatcccagcactttggaaggtcaaggtgggtggattacctgaggtcaggagttggaggccagcctggccaacatggtgaaaccccttctctactaaaaatacaaaaattagctgggcatagtggtgggtgcctgtaattccagctactcgggaggctgaggcaggagaattgcttgaatccgggaagcagaggttgcattaagccgagatcataccactgcatttcagtttggatgacaagagcaaaactctgtctcaaaaaaaaaaaaaattgtgaattgcaaggctggagtgagtccccctggttggcaatactccatgtgcactgtcacacatcctcaggagaagtcagcaccatccacgactccactgggagaggatgctggaagctatgtgcctggtctcttctggcccctgctccatgtgtctcttccctttgctggttttaatctgtatcctttctgtgttttttgttcttttggtttgtttgtttattttttttttttttgagatggaattttgcatttttttacccaggctggagtgcaatggtgagatctcagctcactgcaatctccgcctcctgggtttaagtgattttcctgcctcagcctcctgaatagctggaactacaggtgtgcaccaccacacccggctaattttgtatttttagtagagatgggttttcaccatgttagccaggcttgtctcaaattcctgacctcaggtgatccacctgccttcgcctcccagagtgctgggattacaggcgtgagccaccgtgccagctgtatcctttcactgcagtaaaccataactatgagtacaatgggttctgtaagtcctgctagtggatcactgaactggagggcggtcttggggactctggaatggcagtggcattgctggagcagtgaaggctcaggtccaccagccactaaccctgacctccatgacactgggaattacccaagtccatcttttgctcagctgggtccttggggaccccccagaacatgatgctggtcagcatggtgcacagcagcagggagaagcagcaggacaccctctggacgcgggtgaagctgctgcgagcgcagcggctgaagatcgaataccagatgtgtccatcctggaagcccgcggaagtcttcatgaaaaacaggtggctgcaggcaggcagggagagagggacaggcatttagggagacaggaatgggggaaactggtctctgtgggtcgttcttgggatgagaagcaggaagagcggcagagatttgtttctaagattgttcacactttttttttttttttttttcagataatgtcttgtgtcttgctctgtcacccaggctggagtgcaatggcacgatctcggctcactgcaacctctgcctcccagattcaagcaactctcctgcctcaaactcccaggtagctgggattacaggtgcccacaaccacgcctggctaattttttgtatttttagtagagacatggtttcaccacattggccaggctggtttcacactcctgatctcaagtgatctggccgccttggcctcccaaagcgctgggattacaggtgtgagccaccgcgcctagccacatttttttttcggatggagtcttgctcttgccaggcaggagtgcagtggcatgatcttggcttactgcaacctctgcctctggggttcaagtgattctcctgcctcagcctcccaagtatctgggactacaggtgtgagctattttttttttttgtatttttagtaaagacggggtatcaccatgttggccaggatggtctcgatttcttgaccccttgatccacccgcctgagcctcccaaagtgctggtattacaggcatgagccaccgtccccggctccccccccaatttttttttttttttttaatagaagaaacacagcatcttagcagcatcacttagagttaacaatgaaggctctggaagtcagattagaattacagacggccctcttcccagctgtgtgacctcgggcacgttactttgttctttgtaccttagatgacttgtctgtaaattggggcaagtaataataacagaacctacctcactggattgttgaaaggaataaaagtgatgattctgtaaagcatttggggcagtagctggcatataggtcaatattcaatcagtgtcagcattgttatttttgctgtaattttaatataataatatagctaaaatactattagttttgttacagttagatcattggagtacagtggttaaaaatcccaggcatgacggagtgcagtggctcattcctgtaatcccacgactttagcagggcaaggagagagggttgcttgtggtcaggagttcaagaccagcctggccaatgtggtgaaaccccgtctctaataaaagtacaaaaattagccaggcatggtggcatgcacctgtaatctcagctacttgagtggctgaagcaggagaattgcttgaactcaggaggcagaggtcacagtgagccaatatcgtgccaccatactccaacctgggtgacagagactctgttcaaaaaaaaaaaaaaaaaaaaaaatcccaggcatggccaagcacagtggctcacacctgtaaccccaaaactttgggaggctgatacggaggatcccttgagcccaggagtttgagaccagtctgggcaatatggtgaaaccccatctctacaaaaacagttgggcatggtggtgtatgtctacagtttcagctactcaggaggctgaggtaggaggatctcttgagaaggtcgagaccatcctaggcaacatagcaaagattcgtctctacttaaaaaaaaaaaaaaaaaagaaaaagaaagtgaggcatcgtggtgcatgcctgcagtcccagctgctcaagaggctgaggtgagaggattgcttgacccaggggggtagaggttgcagtgagctgtgatcgtgccactgcactccagcctgggtggcggaacaagaccttatcttaaaaataaagaaaacaaaaataaagtacctgaattgttttctgtcctgctccgtggccacaggaaacaccttatcgaggacgcaatctccaacattgatggatagccaggagttgcacaggaaataccacttccggtccatcaccaggtcatagaccagcacccggctcacatacctggagaagggacccagagttttgaggataaggtggagcaggggaggagacttcactggacatcaccaaggtaacagttttgcaaacatgaacccaaagaacaagagctcctcagaaaaagaaaccatatttttctttgttcttggtgccttaattaaaattcgcgtcacataaggaggtcagctactgtagagagccaactctgggaagctgccatgtttccacaaagatgctgcaaaaggatgcattcggagaccattaacctgtacacatggcaccaagctcagggccagcgtccaggcatgagcaagtaaagccaaattgtgtaaagtgtgcatgttcaggcaggtgcaggctggggtacgcagaacatggtcctctcttgcgtttctttctttctttttttaaattttagacagaatcttgctctgtcacccaggctggagtgcgatggagtgatcttggctcactgtaacttccgcctcccaggttcaagcgattctcctgcctcagcctcccgagtagctgggattacaggcatgcaccaccacacccggctaattttgtatttttagtagagacagggtttctccatgttggtcaggctggtgtcgaactcctgacctcaggtgatccacccacctcggcctcccaaagtgctgggattacaggcgtgagccaccgcgcctggcctcctctcttgcgtttctaaccaaagaatcaccgtctatcttgggctgaggactttgtgggtatcttctaacctgatttaggtctttgaggtatggggaagaattgaaattatcttgcctatcctgtgatgtcagatcgagcagcagttttccctgttgctatacagccaacaagaacagcaatgatggctgggtgtagtggctcacgtctgcaattgcagcactttgggaggccaaggtgggcagatcacttgaggtcaggagtttgaaaccagcctggccaacatggtaaaacctcatctctactaaaaatacaaataaataaataaataaattagctgggcatggtggcgtatgcctgtaataccagctactcaagaggccgaggcaggagaatgacttaaacccaggaagcagaggttgcggtgagccgagattgtgccatcactccagcctgggtgacagagtgagactctgtctcaaaaaaaaaaaaaaaaaaaagaacagtagggatagcaatagccgctcttcactgagaatttactacatagcgggggctatgctaagatgctcttgatatgcattttctcatttcaggaagggcagccccgtaggaatgcaaaagccacctatgtcaaggtcacaggcttttctggggcagctgacatccagtgatgcagtacctacagggatcaagacctgggtatttcaacccaacttgggacagctccagagctccccagtggtggaccacactgttgctgggctgcatcacagcttgacttttctgccatcctgcctccttccctctgttcccaggtgctggtcccagggccctgtaataaacaccctgcatatgcaactccatctgagagcctgcttcccgggagcaacctacagcg

SEQ ID NO: 105 - DNA, 13203 bp, Homo sapiens
aggggctttattttgacaccactttgtttcaatacaaacagtccagaaagaaagtcaagtccctctgggggaggggcaaggggaagagtggtctgtgttgcttgggagcccaacctacaacccaaaggtgggggctgggctgagactgccggtgcggcaggggaagatggcaccaagaatgacagtgcttggctcagctgccagagggtgaggcccacagctctcactggcgggtgctgtccaggccaagcccagaatgatgcagaggaaggagctcagccccaggagcctgcctctgcctctcacatcctctgcttccctggccagcatcaagctcacagcatccagagtcgaatcacagcagacaagaccctccatggccaccaacccggggaagaagggataaagaatgtcacagagggtcctgcattccacagcagatggtacagagggaccctgagacaccctgaaacaatcttccaagtgcttactgtagaaaggggtggtgagacgggagaacccaagggtctccggtctgatcccaaatgaaacctttaggtaccaggtaaagtttccagcccttggtaacgcccagacaaaggtccttcccctctcctggcacccagaagaggccactggcagcagcagcagcagcaagtccgcagcctctttccccatgggacgggtctacagtgaactccttccaggcctccccctggttccagaggatggggacccaaggcctcgaactagaagaaccctagagccagcaaaaaaagccttctaccttccgctttccctacctggggaaagtctggacccagaataagccatcgtgggggaaccccctttcccagtatggcaggataagtgagcagcagctgtgggggcaggacagaaggacaagagtctaacacacggagggtggtgtgagagggaataaagggctcagtccacaggcagaggacaagggctggtactgaccattcccctcacaggagtgagcgcctcaaaggccaccccacacacacaccacacatacgaagtaacaaatcctccccagcttccacaaggcaaagcatccccagcctgggaactgtggagttcttgttgccgtcaccatcgtaagcctgagtcacagagctcggatcagtaggaaccgtagcgatcctgggggcgaggggggagaaaaaaaaaaaaaaagtcagaggctctaagctgcagcagcttcccagcaaacacactgcctgccccagcaccccacagcaagactggggaggcaggggctggacagcccggtgaggcaggagtccacggtgagagctggggcagcggccactcgggcacccgacaacagggaagccctgcctggcctcacagaagctgggaagagaagagaaagagcggtacaggtgacaaggccagggaagatcatggcagacacagaggcatcttggagaggcccggccctggcacggagctgaaaggaaggaagctgccctccaagaaaatgcctctctctagactcttgctttttcgtttgtggttttttttttgagacaagagtttcactcctgtcacccagactggagtgcagtggcatgatctcagctcactacaacctccaggttcaagcgattctcctgcctcagcatcccgagtagcgggattacaggtgcacgccatcatgcccagctaattttgtatttttagtagagacggggttttgccatgttggtcaggctggtctcaaactcctgacctcaagtgatccacccatctcagcctcccagtgctgggattacaggcgtgagccaccacacccggccgaaaatgctcttaaggctcagaggggctgagcagtagcagtgtctctatgtggtggcgaagggcaaacctcccagcactcctcattaggccccacttcagcctcacctgcaaggaattcatcacaccattggccagcacagccattttcccagccacagacttgacaccctgcttaaactgggcaatgtccgctgtaggcagcacgttccccagagatacacttcctgtaaaacaagagcagggtgacccagagcccagcaagaagcccttcccagtcacagcagggccctcccgccctgctcccaggcctcacttggtgcctgccaccccaccagggccctacctgctccgtgagctccatccatgtccccaaagaggtctgaagagctgatggcactgctgcctgagagctgctgcagccgagacctggcctcatactgtggtgaggaaaaggccaggcctggggatcttggggctgatgacccaaggactcacacaggccaggccctcctggtgctaaagcccaaagcagcggcagggagaaagctcatgcttctgcctgctgcctcggacctcagggcagacagccccacttacctctgcatccacctcccgcccaaagaacatgtcagatgagatggctttggctcctgcgaatttctgacgcgcctcactagactcgaggcctgagctccggctctccacttccctccggtttgtggctctgaggggaagatgtggaatatctcggactcctcccattatcatcaggggaggcagagtacagaggccaaacagagcaccagtggccttttggtgatgggttaccaggtcccattctgtctgtggctctgtggctctgggcccctctcccctggtgaggagtcacccttctccacattgaggccaaggcccagagagcttaggaacctgcactaggcagggtggaaatacagcctgcagtggcctaggctcctgcccaaaagcacacagcttcgtcagcattcaggaggccacacaactgctgctaccctaatcctagtgacaacttgcctagtactacaatgagcatatgtgtcggtctgcctggctttatacctactcttgtcataactatgaatagcaaactgccccctttactctcaaaagcatcctggtgtggaaagggagatggttgctctcatctcacgctgagtatgtggacactgggccaggtatttccggagaccctatgaagtagttacgttcccattttatacggggataactcacagatattatgtcaactaaacagatcccagattaagatggagtagggttttaaaaaataagaagggggctggagacataaaacccctgaaaggaggtcaggactgaagcatacaatcaggctcctccggccagagaaatggaccccaagcaaaagaagctgccaggccctctatgatgacaaagcacaactcaaaccgaagcctgactgctgccctgtctaatgaggcaggcaccagccactggtggctatttacgtttatcagaaattaaactacatcagaaattgttgctcagttgcaccaaccacattttaagggctcatagccacatagtagtggctaccatattaaacaacacagagaacattcccatcaacacagaaagttcttctagacagtgctgccttagaattctctaccttcagcttgtttaaaaaaaaaaaagaaagaaaaaagaaaaaacagcccactctacctttctgaaataggccggatgcttgagatggtcacttctggctccttctcctctaccctgtccataccccaggcagcatctgtatcccagcgggagccaaagctttcccctaaggaaaagggattgtccttgtacctagggagacagtagagtggctcagagaagcctgatgaggaacacagcagccaagtttacagctagaaaacagccttactttgggggtccagaggcgaaagtaccaacatcgtcaaacaagtccagctgcgagcgagaggattttgcactcactggggtttcctgctcaatcacctgcatctcagacagcacggagtgggagacagagctgcgcagcaaagcagagccaggcatgagaccaaaggataggcatcagcatcaccgcacaagagacaatgcccagcaactgggttctccttcacggagcgtcacccagagccttctgtccttacccaagcacagggctgggccagaccccaacagaaggctagctgtgtgtggtgacctgtgaagcacacctcagaattctttacacatcagctttgtttattccacgtaggagttccctggccagtgacggtttgcctgttataatttaattttatttatttatttgagacagattctcactctgtcgcccaggctggagtccagtggtgcaatcttggctcactgcaaccaccacctcccaggttcaagcgattcttgtgcctcagcctcccgagcagctgggactacagtgcacgtcaccacacccagctgattttttgtgttttttcagtagagacagggtttcgccacattgcccagcctggtctcaaactcctgagtacagacaatccacccgccttggcctccaaaagtgccaggattataggcgtgagccactgtgcctggctcgtgttgtaattttaatattgtgcaccagatgccagtggtctctgtcctgaacaactccctaccttgtgcactatgaaccccatccttcactgatggggttcacaaagcaaaggaatggatgaagaaatgccccagcaccagggaaatgaacataactgcatcaaagaatgagttcttcatcatcctactctttattaaaaaaaaaaaaagccaggcaccgtggctcacacctgtaattccagcactttgggaggccgaggcgggcagatcacgaggtcaggagatcgagaccatcctggctaacatggtgaaaccccgtctctactaaaaatacaaaaaaattagccgggcatggtggcaggtgcctgtagtcccagctacttgggaggctgaggcaggagaatgacgtgaacttggggggcggagcttgcagtgagccgagatcgcaccactgcactccagtctgggcaacagagcgaggctccgtctcagagagaaaaaaaaaagcacctcaaagcacaaagactggccttatgcactaagacctagaattgctgtctcgtttctcaaagaaaaggggtctagggttggcaggcaatacaatacaactcttgatgcctctcattcctctgtcaggctccacaaggacactttaaggactaatttgatttaaatcaattcattaaaaaatatctatagcttttagctagaagaaccccaaggagtgattattttgcaatagggctgagttgggccgggcatggtggctcacacctgtaatcccagcactttgggaggccgaggcagccggatcacctgaggtcgggagttcgagaccagcctgaccaagacggagaaaccctgtctctactaaaaatacaaaattagccaggtgtggaggctgaggcaagagaatagcttgaaccccggaggcggaggttgtggtgagctgagatcacaccattgcactccagcctaggcaacgagattgaaactctgtctcaaataaataaatagggtgagttgggtttaagtaaacaattgttgcactgctaaaaaactgttcatatgccttaaccccttggtcatcccttaacccagtcatctattaacccagtcattcctatgtgactgaagcagggaaaggagggagacccaatgtcctttcaagttaaaatgttatgctctggctggatgtggctcacgcccgtaatccaagcactgggcgccgtggctcacaccggtaatcccagtactgtgggaggccgaggcgggcagatcatttgaagctagtagttttacaccagcctgggcaacatggtgaaaccccatctctactaaaatacaaaaataagctgggcatggtggcacatgcctgtaatcacagcttctcaggaggctgaggcaggagaattgcttgaatctgggaggcggaggctgcagtgggctgagatcacaccactgaactccagcctgggtgacagagcaagactccatctcaaaaaaaaaaaaaaaaaaaagaaaagaaaagaaaaaagaaagccgggcaccgtggctcatgcctgtaatcccagcactttgggaggctgaggcaggtggatcacttgaggtcaagagttcgacatcagcctggccaacatggtgaaaccccatctctactaaaaatacaaaaaattagccagacacggtggtacacacctgtaatcccagctgcttgggaggctgagacaggagaatcacttgaacccaggaggtagagattgcagtgagccaagatcgtgccattgcactccagcctgggtgacagagtgagactttgtctcaaaaaataaaaataaaaagccatagcagccagacatggtggctcacatctgtaatcccagtactttgtgaagccaaggtacttaaacccaggaattcgagaccaggctggacaacatagcaaaaccctgtctctacaaaaagtaaaaaaattagctgggcatggtggctcccggctgtggtcccagctatttgggaggctgaagtggaaggatcacctgagcccaggaggcagaggttgcagtgagctgagatcacaccattacactccagcctaggcaacagagcaagaatctgtctcaaaagaaaaagaaagaaaaccacagcaaaccgagtggttctgaaacaggaaggattccacccaaactgagggcatttgaaatgtgggggatatgtgagggtattacagggagcacaaatggcatctctagacaggaattaaggatgatactaaatgcaccgcaattctcagggaggtctggaaaaataaactgtcccatgactcaaagtgccatcaagaaaaaccaccctagtctcttgaagatactgaaataacacctgatcctgtgttttgttcacatacctattcagtcattcaacttactgagcacatacctactatgcgccaagcactgtattagggactttagaacaataagccaagtgatctattcagacttggagaaacaataagcctagcatcccaaactgctaggaaggccccgcaatggttcccagaaaacaacggcatttccctgccacacccggagctgagcctcaccttcgggataccaagcccatgcccaacctttctgcctgctctcgcttcttcccttccagattctgtagcttcttttcctctttcttacgatcaatctggagctcctggtaggccagacgcatggaggcgacccttagggggaacaaaggtgtcagtggccaccacccatcctgacctgtccaacatacccacccaccaagccccgcagaagcctgaggccccggcagcaaacacttacatggactcctccgcctgcttcttggcatcggctgcctgctgctcacggagcttctctgccacctgagcctgccgctcaatctcactgaagctctggctgctcaccttctgggcccctaggcctttcttggcacccagctgggaacagaatcatgtaaggggccttcccaatcacactctcctcagatccctcccaggttcaggcactgtagccacacccacaaggaaaaggcccttcttaaaatttagggtaaaaaacaggagcccaaccagcatggccaagacaatagtgctccgctggagctgggcatgggcggctcacacagccccagcagagcccgggcctgaggacggcagttaatgctgacagggccaagtatgtgccaagcactccgccaagcactagatgtgctccatctcaccgactcctcccagcagcccttgaagacaggctttaaatccctttaaatctttaaatccctttcacaggcgaggttcggagaaacacagtacctttgccaaagtcatatagctggtaagtggtaaggtcaaggagtgaacccaggtagcctgcacccagctcctaacccctctaccataccacctctccccacctacccctttcttagctgctgctggcttcttcttgccaatgatggagcttttcagttctgcgtgagaaacgggtaggcatgagctaagacaaaggcagctcagaggcagtagctcagtatacaccatgcagcttcatggcaagagctcctaagaacagcttcaggcaagggaaggcaaagctgccaccaccagctccaaccagcggtgtcaaagccaaagacagacgtggctggggtatttactggcacccagcagagtgagacaggaacctagacctgaagcaccagagacgtccgaagcaccagagacgtccaaattccctgaaccaaaacaaagactgcgaggcagggagcatatggtgagcaccaggctccgcttctaaagcaggaagctgagaacaggggctgggctccccaagcagctgtcagttacctctggcaggaagggcccctttagctgacagatacacggactctggaggagaaacagacttgtggctaacaagaggcccaccccagagcctccacagagctcccaagcccagcggtctctatgaagccctgcttcagaccaagctatgccagccttctcatggatcagtctgacagtcactctgctgggttccagccccaacccccaagagtcaacagaacaaaccgaggtcagcaaatggactgttcgccctgaaccaagtctgaaagacactaaggaaaatgtaggaaagagttaaaggacaggctggggtactggctgagaaagaacaatgtcacctccagccttcggcagctcagagctgtccctccacccccggaaatgcaccagacaagccagccctgcctcagagcccagggataggtgtccagtctcatgctggcctccccaacactttggctagacccagccccacactcagaggcagaccccaggccttatacaccagcccacccagattcatcaattcaaagggcttggctctaaaatcagtgttgcatccactatttcaatcacagtccccactccagagaatcagatagatgctcagtctcctgtggcctctgtccacacggccaggcagtaggacctctgaaaagaacatttgaggtccaccctctcccagacaccccacgcctgcccgctggcatactgacccagtgaggctttgggtgaggtgccaagcaggtctgtgttggggccatgctccggctctgtggatgcaatggtaggagttagagatgagctcctagcttcctgcaacctccccttgaaagaagtgatgggacaagaatcggtggctttcctcagcttgccaccaaaagataaaaggaatatctaccacttcctccaaggattaaaatgaatcccggcccacccaaagatacaggaggacccctgctcctattgtcatggccagatgtccccttccaaaccctgagtcctctcctaggaccagggcacctggttggaatctgggctgaactcacgtgccaggccactgctctctgtagacggggctggctgctgggtccctgaaggctcagtggctggcgcatcccaggcagggggctgaaaaggaggccagatcacagatgcctcggtgagccactcctgctggcaagaagcaccaagacctacaagcaccttgtggacaagaaatcatactccaaacccatgaggaaagggactggagggtagcaaacaagatcacagttgctattcactgtggaagaaagcaggaagacaagcagcccccaccccaaccccttcactatttacttagagccagagcccattctcctaacttaaagacagttaactaccaccacctaggcaggcacagatctaaaggctcctcatatatgaatatatttaattatcactacaacccctatgaaggagctacatcgccattttagaaactgaggttttgacaggttgagtgacttggccaccatcacaggaatgcggagtagagaacaggaattgaagccaagagtctaacttcagcacccagggccagtaaagaggaaaccctcctcaaaggggtggggcggggaggagagaatcctttcactgtccccaagcacagtgcctttttttttttttttttttttttttttttttttttttttgagacggagtctcgctctgtcgcccaggccggactgcggactgcagtggcgcaatctcggctcactgcaagctccgcttcccgggttcacgccattctcctgcctcagcctcccaagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccactgcgcccggcccacagtgcctttcttataggggaagaatccaggaaaatttgtttggggcaccggacacctcttgaaacttcaagaagctgcctctcttccccgccagcccaatttataggagtcgatttctaaggagggctacactgcacctccatttatggaggaggaaacacctaggcctacccagcaggaacagtggacttcatacgtggtgtccaagacatcacatcaaagcaaatggaatctacaaccatgatcacagaaggcctgggccttggtaaattgcctgtcaagaacaactgggaaaacggttccttgtgggcactcacttgagtgtgttctgtgaagaaatcagagtccttcttctctggggagtgattaggaacggcactactcatgttgtctatccaaagctagaaaggagaagacacccctaaaacacagggctctgaatactcctaaccctcctgccccagccccaagaacaggcacttacatcagtgccatgcctagccagggccgcactccccagctgccggatcttctcccggtacatctgggcagctcggctattatatttggtgttggcatcattggctgtgcatccatgttggcgaaaaaaagccgtctggagagcaaagaagagagcagcgcgtgctacgggtgattctcaagaaggaaacgtgttggctgtaggagacatctccttatgacagcgaagttattatctatacaggatgatacacgctactgacaccggtttttcagagataaagtttctcgaaattcctgcaaaaaacaccttgcagcgggccatcctctgatatgactgaagtccaggccccactgaacgctgcctgagcacaacatcccatacccagcctccccatccttcatccagggcaggcccacaagacccaatgactgtgaaggctcccaactcctgtggcttttccccaagaacacctgcccagtttaattggaatctgaaacccatttaagagaagctgtgaccagtttcgaagttttcagaaaatagcttatggtggtgttatagaacagagaaccctctgaacagggaaaacgacagggcctcttagggagtcgtgcaaagttagtaaccaggcagaagaatggaaggtgagggaagtagaaggagctttaccgcattggcattcccgccgacctgcatacacctcagctggaaccagttccagttggaatccaactctgtggacctgtgtacaagggctgcgtctcacccactagcagataccagcaggatttccctggcaacccggatacctgtcacttggcctcaggctgctgtaggcacccaggaaacattaatcagccatcaccccatttcctccacactaccctgtccatgaaaactctcctcttcgttcatttactccaaagagtactaattatgtccccagatccgaaaggaggtcacattctcaggcacgcacgcctggatttggctttcccctaatggatggtcacagtctcactagagacatactggtctaacaacatatcagcaacaacaaggtcaatgcctccctttcccctcaactaacgctcagagtctcaagcctgaccgtcaaaaaagaggaagttttggcccagaggcggagacggaccgcccatgtgccaaagggcccacacaggtggttccctctggcaggaggctaccggaccctctcggcccagaggcttcccaccgaattcagagcggcccaagtcgaggcagccactctcccttgttgcccagacacccctggccggccgggtggaaacacggcaaccgcgcggagagcctacctgatgaagctcagatggacgcccagggagcggtgcaccccggaacagtcaatgcacaagaaaacaccgtacgtgatgctggcccaactcggattcttggcgccgcagtcgaaacaggcctgggtggaggcggcgatgagcgaatcgtcaggggccccgagtaaaggccaggcaccgacaccccagaaacataacccacctccgcccttctccctccctcaggccccagcgggacgagagactccgcgcgccccctgctcacgcaccttgttggttggaactgcgcgaagcctcttaaaaagagtctggatttcggtcttgttcggctccgccgccattttctctccttcccagacacaaccgcggctgacgggtcccgccgcgggccaatccacggcggggagggcgggctcaccaggccggcctcagcggtgcctgggccagccgaggggtggggtgattggagtccgatctggaccaatgggcagccggcgggacgggggcggcgacgacaaccgcggccgcaagaatcaacgccgcgccgggccaatccgcagccggggcggggcgacggcgcgcggaccggcccaaacctcctcgcgcgcgtagtacccttccccccgcccctcccacgccgcaacccccaggtggagtcgcccccacgccgcgcaggctgcgggaggctgggggcggggacccccactccagctaattacagatcgatgaataaggattaggctgcccaaacactcctcgtccctccggcccgaacgggcagacgcattggcccgcgtctcgcccagccttcagccgttctcggttaacagcaagcctgacagcgagtcccctccactccagattagtatctcgaagttccagagcaggtaccaagcaggcaaacccttttccaaccccggccccataacagacgctaggcctctctctagatgccctctggtggcctggcaagggtgtcctatcaaaaaaatgcacatgagcccgacagtggtgtttttgttt

SEQ ID NO: 106 - DNA, 13302 bp, Homo sapiens
ctataaatgagatagaagcaatctaagaaacatgtagtcatcttcttctctcaggttgtctggttctctgtcctgcagctagtcagtttttgagtcagtgacacactggttccttattcagagtaaggcaggaccaaacctcggtgctatgaggttcctgccttcctcactccaccaaggatacatttctgggagcacctggttggtaactacaccagcagtctgatggcaaagtctgctggagaaggttgagaaccaatccctttaagagcagtggttcccagctgggaatgactttgttcctcttggagacatctggcagtgtctgagacatctttggttttcacagctaggagtttgtgctctggtgggtatgagccagggatgctgcttgcatcccataatgaacagggcagctcccacaacaaaaattatccaacccagaatgtcagcagtgcaaattgagaaaccttactttgcagagctctcagagagcaggccggtggtggagaacatgaagttgatgggagagtgcattctgaaatcgggagtgtgagtccacctgggagtccctaaaggggagtcagggattatcaaaggtgcacttgaggccctggccagtatacctgtagtaaacgggaagcagcagttctggcttcttcttttcctgtgggggcaggatgacactttgatcctcaaactctgctgtctcttctgcctccagctgtttcaggagctccaggtcactggcagaggtaagctcatcccgaatgtgactccagtcgtactgctggcgcaggaagctctgccacttgttgggggatgccccaggccttcgaggacgcttgctctggatccatcgggctgtgcgctcgttcagcttttccagcacagtggcctcccacgctctggcctccttctcaggaggcagaagccaggcttctctttcctccaggttcacatctagagaaggtggccgacccagcatatctggatgcatgcagggatgatggatgagagggcggggtgcttcccggacggtgctggctggctttgatttcttcagcttcttttcgggattggcagagctttctgtcttcacagccagggaggtgtctcctgttaagggacttgaggaacccaggaacttgaagctaacaggtttctgaggccgggccttcctgatctggggagtatggatgatgtcattggtattgtagaggtggtcaaagctgtactggctataaggaatgctgggcaggcctcgctgccacaccacctcctgagagaaggtaaggtttgcagcagccattttcaaatattggctcttgcggtgtagacggtactgtgagctgaagaagaccataggcacactggagacagaggcacactcctccttgcctttcaattttgagtagtttaaaatcatgccccatcccagtcgtgggggcagtgactgatagaagcaatgggggagaaaggtctttcccttctgggtcctggtcataccgcgtcccagcaaatgcttccttccacactgcctggcctagaggaaaggcctggagatgagacctggcacctgttaagggaatgggaggaactgatgagaactctagagcagcagaaattggtagcccatagcagttcagaaagagaataacttgaaaaacagatggaaagggggtggggaagagccatgtgagttagaagaacaaaagaagaaaatggtgcaacatcctaaatatttcatgtatcagacccgtgtttttggttcttatacttgttcccaaagctcagaccctcatctccgtgtgagggatgactgcttttcagcagtatcccatgcttccagtttgtctttaaatgttgctttctttcattcaaaaggcttatagtgtaaagttcagactattcagcatggcattcagggttctccatgagtttggcctcagtttatgactttgtcctggcatgtaacctctgcttgagccagtccagtctcctggctgttctctgagtatcctctctccacataatgaagcttccttctgtgtcctctacatgaaatggcctttcgtacttgacacaaattctatccaatttccaggcccagctcaatttgtgctgctccataactctttcttgacctatccaggccaccaggtcatacccaagtttataaattcctcctggtctgtaccacttactttaactgttaatcctatgatacctcgcattgttaaatatttgagactctaattccattgcccagtgaccatgtctcccatttcttctgtctttcagagtcatccagcacacctattgctacatagtttttattgttaaaatatttaatagctgtaggccgggcgcagtggctcacgcctgtaatcccagcactttgggaggccgaggtgggtgggtcacctgaggtctggagtttgagaccagcctggccaacatggtgaaatcccatctctactaaaaatacaaaaaattagccaggcgcggtggcatgtgcctgtaatcccagctacttgggagattgaggcaggagaattgcttgaacccagggtgggggagattgcagtgagccaagatcatgccattgcacaccagcctgggcaacaagagcaaaactccgtctcaaaaaaaaaaaaaaaaaatatatatatatatatatatatatattatagctgtaacgtattttatcaaataggtaaatggttttgactcttcatgaattattggatgggttgtttccagattttagctagcatggcaaacactgtagataacaaatgcttagatttaatgttagtttagttttgttttgttttccttttgaagcattcccttggcctaataatgatagttttggaataaccttgctgaggattttacgtagggaagatattatgatcttcctttcctattttaagaagctgaggttcagagaggtaggtaaattgcttcagatcacatagcccgtaagcagaggagtcaggtttcaaatctagcctactagatcacaactctggagcacttaacctccgtgccacactggccttggcccaagcaccactccctaccactcactttgttggccttgcctctccaaggaacaggtaggcctccttatgtgtaaggatgaaggagagaccattattccatatgtttctatcctgctagtgtcaactcctgcccggtgtccaaggtgcccatgcagaccagatctgacttgtttctctttactccttaacacccagcacatagcctctctccctagggcatgatttctcttactgtcttccatgtgtaaaagtgaccgtattgtatttctttctgttaagggcaagttcttttttgtgtgttttttttcttttgttttgtttttttgagacagggtcttgttctgtcgcccaggctggagtgcagcactggcacgatcatagctcactgcagcctcaacctcctgggcccaagtaatcctcctacttcagcctcccaagtagctgggactacaggtgcatgcgccaccacacccagctatctgttttttatttttaatagagatggggtctcactatgttgcccaggctggtctcaaactcctggggtcaacaatctgcctgccttggcttctcaaagcgttgggattacaggtgtgagctacagcactcagcaaaggctcaactttcatctagatgccattaggccagaatcaataacctccctcaaattacgtgacacatgattaatatgctatcactccaggactttttgcacataaggctaaatgtaattgcttcatctcttcacaaccatgaaggcaacgtcttcatgaaggcaagttaagagaaagagggtggtcacaagatgatgttttctcctgaaacagtggctactcccactggctgaaaatagaaaggctagagcaagacggccaaacagacccctccagcgattgtctccatgcaggaacaccaaactgaacaactgtccccacaaggaaagcacctttaggccggatgcggtggctcacgtcagtaatcccagaactttgggaggctaaattgggcaaatcacttgaagtcaagagttcaagactggcctggccaacatggagaaaccccatctctactaaaaatacaaaaattagctgggcgtggtggtgggggcctataatcccagctacttgggaggctgaggcagaagaattgcttgaacctgggaagcagaggttgcagtgagacgaaatggtgccactgcgctccagcctgggtgacagagtgagactccttatttaaaaaaaaaaaaaaagcatcttcataagaaacaaaaaatcaggtgagtgatcacagtacctggttttcacatcgtatcaagaagaggcactgaagagggtgggaaagacggtcctgcatcgcctatgcccccctccctcacctctggcacaacagcttggagagagaatctgtgcatgtggtggagcgagaggagtgtgggattttgcattggaactcactgctgccctgtcacagcacagcactacactgagcagaattctgctggcacccacagaggacacatttagatcagctctgggccagaggagaatcctcaggtagagtgggacagacctgagtcccagctggttctgccaccagctgaccaaagtggcctggggccctgaatacatatgagtgacagtcaggtcacaaggactatattccttaggcaaaccctggagatgcactggtcatggaggcagtggactttgggtgtgtgtgaccgcgtgtgacaccaactgtggtgaacaagggagtgcctgcatcattcctcccccaactccagacagggcagctcagggagagactcctacttggggaaaggagagggaagagtactcaagttgcaagacaaagtccagaagactttgagtagcagctcagccacaggaaaataaagcaccaggcagaatcctgaggctcctgattccaggcctttgctcctaagctacatttccagacctaccctgcgccagaagggaatccactgctctgatgggtcagatttatcctggcaggattccccacctgctgactaaagtgcccttgggctttgagtaaatatcagtggtagctaagcagttctggccacaggccttgggcaggatccaatactgtactggtctgcaaagcttcaggtgtgacccagtgcactgccatctgtggtggccatgggagtgctcatgtcacccttccccccaactccagacagcccagtggggagagagattcctgactgggggaaagagaagagacaaagtgagagatgttgcctgggtaaccggggaattttcccttatcttacccaaggccaccaaagatacaggagtatccaggagttggcaacagttgcaggggtcataggcttagggcaccccctggtatacatcagctgcagagaccgtaggcttaagtcacagcacttaatcccctttgaatatatagaaagccttctcaaggaggatgggtacaaataagtccagactgtaaagacttggaataaatacctaactcttcaatgtccagacattgatgaccatccacaagcatcaagaacatccaggaaaacattatttcaccaaatggactaaataaggcaccagtgaccaatccaggagtgacagagatatgtgacctttccagacagggaattcaaaatagtagtcttgaagaagctcaaacttcgagataacaccgagaagaaattcagaattctatcagaaatttcaaaaagagattgaaataacaaaaatcaagcagaaaggctgctctgcctatggagtagccattcttttgtttctttacttctctaataaacttgctttcacttcgcaaaagaaaaaaaatcaagcatcacttctagagctgaaaaattaagttgactaaaaaatgcattggagtctctcaacagcagaattggtcaagcagaagaaagaattggtgagcttgaagacaggttatatgaaaatacacagtcagggccaggcaggatggctcatgcctgtaatcctagcactttgggaggccaaggcaggtggatcacctgagatcaggggttcgagaccagcccggccaacatggcgaaaccccatctctactacaaatacaaaaaattagccagtcatggtggcaggtgcctgtaatcccagctacttgggaggctgaggcaggagagttccttgaacctgacaggcagaggttgccaccgtactccagcctgggtaacaggggcaaaactccatctcaaaaaaaaaaaaaaaaaaaaaaaaggagtgatttaggatgtccccagataaatgccctttagcctgtgacgtaaagaatctttagttacaatgcaaacatcccagaaagaataccatattaccattatcaattattagaaattcttaaggaggctatgcgcggtggctcatgcctgtaatcccaacactttgggaggctgaggtgggcagatcacctgaggtcaggagtttgaaatcagtctggccaacatggcgaagccccatctctactaaaaatacaaaaaattagcgggtgtggtggtgggcatccgtaatcccagctactcaggaggctgaggcagaatcgcttgaagctgggaggcggaggttgcagtgagccaagatcgcgccactggactccagcctggacgacaagagcgaaacttcatctcaaaaaaaaaaaaaaaaaaaaaacttaaggaatagttattatctgatatgatggcttattaagaaggaagggaacacatgataggtctgttttgaaaaggaatggggacagaacaaaatattactaggtctgatcaaaagaggcttgttctggcttgtctttgtctgccttggagtcacgggacaggtgtaaggccaaattgtgcacttcccagtcatgttaccttgggcaaataatttaaaatctgtagtttcccaatctgaaaattgagtctgatacctgttctaatttagtgttgattgatatgaagctcaaaatcagaaacatgtatgaaagttctttgcaaactaaaatatatgtgtgaggaattgttattattagtttagaggatggactgttgtccttagaaggcaagtctctgggtcctacagttagatgcactgagcgcttcgggaagaatttagggctatggggtactcagcaattaaaagagagggtgcttagagaaggaagaaaggacttattaatggagtttggaggctccttattattgaaacttacacattacgtgaccagcattatgaggcagcacccacttccaacaaatagccctctagaaccaaaagcagagtggcaggtcctgggtccttttgtacacagcataaaaaattaagtcaatcggccaggcgtggtggatcatgcgtgtaatcccagcactttgggaggctgaggcgtgtggatcatctgaggttaggagttcaagaccagcttgaccaacatggtgaaactccgtctctactaaaaatacaaaaaattagccaggcgcagtggtacatgtctgtaatcccagctacttgggaggctaagacaggagaattgcttgaacccaggagtcggaggttgcagtgagccaagctcgtgccactgcactccagcctgggcaacagagtgagactctgtctcaaaaaaaaaaaaaaaaaaaaaaattaagtcaatcctggcataactgcagaccaggccctggaatgagcaacccaccagcattatctgcatttctaggaacttgggctagaaggggaggaatggggttggaagggttaggctacatgcctctagttaaaacctgatgaacttcctagatccccaactagaaaatgtaggagttggactaaattcctctcctgcctctaatattttatgaatacagaactcaactcaaaatgggtagtatctcagagattccaaatttagttctacttttctgtttgcttatcagtcgcttaccctcaccctctggtctgatacctttatcctgtacaagtggtcaaagtaggttgagtaacgtgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaactttttttgtagagacagggtcttactatgttgtccaggctggtttcaaactcctggaatcaagcgatcttcctgccttggcctccagaaatgctgggactgcgcctggaatagatacgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaatttctcaccatgcactcacacagctatacagctgtctccagagattactctggaaactctgctataaagatgacctggtctaatgccttgatttgttttttgtttgtttgtttttttgagacagggtctcactctcctggagtacagtggcgtgatcatggctcactgcagccttgacctcctgggctcaagcaatcctcccacatagctgggagcataggcacatagcacaccactctcggttaaatttttttttttttttttttttttttgtagagatagagtctcaccatgttgttcaggctggtcttgaactcctggactcaaacgatcctcccaccttggcctcccaaaatgctaggaatacaggcatgagccactgcaccaggcctaatgtcctgattttataaatcccaaaactggggcccagagaggagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctacaaggcagtcctcagagagaagcaaggttctgcatcttaaaccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctgtgagaaattgcatcttatttattgattatttattgaatggtagtttcatggagtttttcgtctttttttttttttttgcgagggagtctcactctgtcgcccaggctggagtgcagtggtgtgatcttggctcactgcaacctctgcctcccaggttcaagcaattctcctgtctcagcctcccattacaggccacaccaccacgccccactaattgttgtacttttagtagagatggggtttcaccatattggccaggctgttctcgaactcctgacctcaagtgatgcacctgccttggcctcccaaagtgctgggatttgcaactgtgagccaccacacccagcctcttggtcattctttgaaaaataaacctcagccaggcgcaatggctgacacctgtaatcccagcaacttgggaggctgaggtggcggatcacctgaggtcaggagttcgagaccagcctgaccaacatggtgaaaccccatctctactaaaaatagaaaatttaaaaagaaaatcagctgggcctggtggcgcatgcctgtaatcccagctacttgggaggctgaggcaggagaatcgcctggacccaggaagcagaggttgcagtgagccaagatcaggccattgcactccagcctgggcagcaagagtgaagtgcagtctcaaaaaataaaaataaaaaaaccctctagatgtatgcggctccatattctcccaccacaagggtttataaatcctgagaaagaggcaaagcagggaacacatgaccacatagctctggcaggcgtcagattaccaggctgataaaacagatggtaaagtagaagctgtccgttgacttttccattcccctttcagctcctccactgctacttaatctcctttgcccacacagttcaatcctattttccctgatctccaaatcctggctagattattagccattaacactagcttttacaaggagactcttcaatcttgtatttctagtagtataatttcacacgtacagaaattctttaagtcatagaagtcttacagatacagaaattctgatcttcaggagtcctgttgtgaaacaaactaatttatcctgacagcaggaaagatttctgggcctaaggctctgtctcgttgacccagctcatgctattcaggtggtccatctcttggttccaggcaagactgctgctgctgaccaacctgaatatggactttagcacttgggctcaagctgcactcagatggttggaccaccataaaagagcgagagggtacgtttttggtatgaaaagtaaagactaggccgggtgcagtggctcacgctcataatcctagcactttgggaggccaaggtgggcagatcacaaggtcaggagattgaaaccatcctagctaacacagtaaaaccccatctctactaaaacatacaaaaaaattagccgggtgtggtggtgggcacctgtagtcccagctacttggaggctgaggcaggagaatggcgtgaacccaggtggtggagctttcagtgagccaagattgggccactgcactccagcctgggtgacagagcaagactccatctcaaaaaaataaataaataaataaaaagaaaagaaaagtaaagactaaaaaaattaaatattataaccctgctaaggcaggaggatcctttgagcccaggagtttgaggctgcagtgagctatgatggcactactgcaacccagcctcagtgacagagggagaccctgtttctaataaaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggccaggcgtggtggctcaggcctgtaatcccagcactttgggaggccgaggagggtagatcacctgaggtcagaagttcaagaccagcctggtcaacatggtggaaccccatctctactaaaaatacaaaaattagctgggtgtcctggtacgcgcctgtagtcccagctacctgggaggctgaggcaggagaatcacttgatcccaggagacggaggtttcagtgagctgagaccgcgccactgcactccagcctggggggacagagcaagactccaaaagttctggaaatggataatggtgatagttgtacaacaatgtaatgtacttaatgtcactgacttgtacacttaaaaatggttaaaatgggcttgttccagcagctcatgcgtgtaattctagcgctttgagaggccaaggcaggatgatcacttgaggccagagttcgagaccagtctgggcaacatagcaagaccctgtctctaaaaaaaaaaaaaaaaaaaaaaggttaaaatgaggccatgcatgcctacaatcccagcactttgggaagatgaggtggtagggtcacttgtttgggaagaggaggtgggaggatcctttgaacccaggagttcaaggctgcaatgaaccatcatggtgccattgcactccagcctgggtgacagagcaagacctagtctctaaaaaataagagttaaggccagacacggtggctcatgcctctagtcccagcactttgggaggctgaagcaggcagattacaaggtcaggagtttgagaccagcctggccaacatggtgaaacctcgtctttactaaaaatacaaaaatcagctggccgtggtggcatgtgactgtaatcccagctactcaagaggctgaggcaggtgaatcactggaacccgggagccagaagttgcagtgagccgagatcagaccactgcactccagcctgggcgacagagcaagactctgtcttgaaaaaaaaaaaagaattaaaaaaagaaacatggccgagtgtagtggctcttgcctataatcccaacactcagggaggccaaggtgggaggattgcttaagcccaggagttcgagaccaggcaacatagggagaccccatctgtacaaataatctaaaaagttagccaggtgtggtggtgcatgcctgtggtcccaggtgctcgggaggctgaggtgggagaactgtctaagcctgggaggttgaggctgcagtgagctatgatcgcaccactgcactccagcctgggtaacacagtgagacaccccgtcttaaaaaacaaacaagcaaataaacaaatactatgcataaaacctcaaggctcaagaaacaacagtttgaaatagttagatgtgtgttttttttaattttcatgtcttatcttttctgcttttttttttttttttaagggatgaggtcttgctctgttgcccaagctggtatcgaattcctcctgggctcaagcaatctcctgcctaggcctcccccctaacagctggaactacaggcatctaccactgcattcagcta

SEQ ID NO: 107 - DNA, 14456 bp, Homo sapiens
gaggcacttcaagtattaatgcttaatctcttgggtgaatcaaagacagcagtatcaatgctgaaacattatcttattaaatttaacccacatgaaatcctgagtgatgttgcttcgggggaaggggtaggaacggatagagtttcacagctctgtgacaatgcaaccttgcattcattcattacctcttcttcagatagccataaatattggctgaaggcctactatgtatgtgtcaggcatactgcatacattggaaaacaattgttttttttgagatgaagtcttgttctgttgtccaggctggagtgcagtggcataatcttagctcactgcaacctccacctcccaggttcaagtgattctcctgcttcagcctcctgagtagctgggattacaggtgcatgccaccacgcccaactaatttttgtatttttagtagagatggggtttcaccatgttggccaggctggtcaactcctgaccgcaggtgatccgtccaccttggcctgccaaagtgctgggattacaggcgtgagccaccgcgcccggttggaaaaaatcttaagtagacaaataccctcttctcgtgaagcctaatattatttgaaaacaatggagttttctccaggacggtgtacgcagcgccaatggttctcagcctcaccttggcctgatcctgagcgtccttcctcctcgcccagatcaccaccagcacgtagaccacacacaggcagcccacggtggtcacgaccacagggttgtcctcaaaggtggcaaagagctcagcagtctggtggatgttgatggcattggacatcaccaggaacgtgcttccgaagaaagtgaggtggttgcagaggcagtgtgtctggtaggggctggtccgaggccccacctacaacccataaaggggctgtcagtggagacgctcgggaagctcaaccccggctcgctcgagcccaggggaggagaacggtgttcgctttgaagagtgcacactctgctggggtgtgtggtgggaagaccgctgggagaccagcttcaaaagccccttttgatctttttttttttttttttttttgagatggagtctcacctgttgccaggctggagtgtagtggcgagatctcggatcaatgcaatctccacctcccgggttcaagcaattctcctgcctcagcctcccgagtagctgggactacaggcatgcaccaccacacccagctatttttttttgtatttttagttgagacggggtttcaccatgttggccaggatggtctcaatctgctgacctcatgatccgcccgcctcagcctcctaaagtgctgggattacaggagtgagccactgtgtttggccaatattttttatttaattaaaatatggagataatattatttatatttttgtgtccatcattctcagtggacaactgtgtatatgttgccagtctgctttcctttttttttctttttcttcttctgagacgggatctcactctgtcggccaggctggagtgcagtgacacaatcttggctcactgctgcaacctctgcctgctgggttgaagcaattctcatgcctgtgtcccccaagaagctgagattacaggcaagcgccaccacacccggttaatttgggtattttcagtagagacggggtttcgccatgttggccaggcaggtctcaaacaggctgatctcaagtgatctgcttgcgtcagcctcccaaagtgctgggattgcaggcgtgtaccacagtgtgattcgcgtctgcaatctgagcttcttgggaggctgaagcacaagaattgcttgaaccccagaggcagaggttgtagtgagctgagatcacgccactgtactccagcatgggcgacagagaccctgtctcaaaaaaatacatatatatggcaagtaaatttgagatctcctttgtccctcttcccctataggcaaccaggatcacaaatttggcattcacccccgtggtgcacctggtgctcattcacaggacaaatatttgtggggtgctaattctacatccagcaacaggctaggtgctgagaggacactggtgtgactaactcatcccagtttgccagggcctttcctgcttttcaaacagaaagtcctgagtcccaggagctccttcagtcctgggcaacccgggacagttggtcagcttatgccgaaaagcaaaataacctgggggaaccacaggaagaaaaagaagaaaaagagaaggacacaggtttgagtcctaagctggcattgtggcacaaagaaggtgtgatggcacttacacaggtggtgccttgtggtgcaggacaacatggccgggcagcaaggggaccggagtgaaccagggcaggggctgccatctgtgcctgtgcttcacacccacatggccacccccaatcccccgcgagctcacagtcaccccctagggccttctggtgggtaaagaagatggtttgtttgtttgagacagagtcttgctctgtcgcccaggctggagtgcagtggcatcatctcggctcaccgcaacctccacctcccaggttcaagcgattctcctgcctcagcctcctgagtagctgggactacaggtgcccaccaccacacccggttaatttttgtatctttagtagaaatggggtttcaccatgttggccaggctgctcttgaactcctgacctcaagtgatccacccgcctcggcctcccaaagtgctgggattacaggcttgagccaccgtgcctggccctacatgtaagatttgggacaagtcagttgagtttcctgagcctttgttttgtcccctgtaaaatgagagtcacagctgtcttggagatgattgtgcagatctgatgagccgatgtaagcaaagcatggagctctgcacctggcacagaactaagggctgagctatgagttcattctcttggaaatgacaccctggcctcccttaacaacctagaggcagcaggccttcctgagtcattcgtcgcctgggtcaatgaccatttgttctcagtgatgaacaaagcacattgttcctgttgcactgggggctcccagtgcatggagggagacagacgtcatttaaatgatctcatgcgtagaggtgaaatgacccctctgcttagcgctatggatgaggagcactggggttggatgctctggatgtgtgtgctctgggggttcacaataggaaatctgacttagggagttaagaacagttttctcgaggaagcaatgcttaggctgaagcgaggatgaggcgggtatcctaggcaccaggaacagcaaaggccccacggagaggctcaagatgctgtgccagaggcaccaaaagggaaccctacatgagctgggcacagcccaccaagctgcctcatctccttcacttcgctctccttacctggcatcctgagtcgtcccaagtctcctggacctcatcccagaacacacagtgagacaggaaggtggtgatgccaaccgtgaggtccctgccgggggctggctccaggtcagactcagggaccacagtcaaatagtagaccccttctccaaaacgcaggtcctgtgggctcaggatccacgtgggcagctcatctgtaggaaagggggttccaggtcagcctgaagcctccttgagatgggcgttaagatcatgggagagggtgactgagccacttggcagggaagcagaccctgccggttttcccccacccctgatgtcctacaagcactctctcctcctgagaccaggagcatagaagaaggggcactccccagtcagggtgcacagctgactcaggcagacaagggctcaaacacagattctgccccttattggctgtatgagctcagaccagttccttttccttaacctctttgttcttatctggaaagtagagattttttttttttttttgagacagagtctcgctttgtcatccagggtggagtgcagtggtgtgatctcagctcactgcaacctctgcctcctgggttcaagctattcttgtgcctcagcctcctgagtacctgggattacaggtgtgcaccacctcgcccagctactttttgtattttcagtagatatggggtttcgccatgttggccaggctggtcttgaactcctgacctcaagtgatctgcccggcttggcctcccaaaatgctaggattacaggcgtgagccaccacacttggctgaaagtggaaatttcaatagttccccctgccaagggttgtcatgaggattgcaatgaggtcagtcctatatgagcttgtaaacttctttggggcatatagtaagtgctcacctaatgttggcaaatagtaacaccaataaaaaataagccactgaatgtgtggggtggtttttttctttgcttttcttcctgtggcttctgatttccaagtgaagctgatcataccccaggcagcagctcaggaaatggtcacaggcctacctggagccaccattggtacgaggtgagtttgggcatcgtagctgctcttgttggggtggtagccatagcccaggctaagcgtgagtgcaatgtctggtctccagtgcagctggatccccaaggttgcctcccctgaagtcacgttcacccacaaagcttcaggactggtcaggttcaacacggtcggctggctgtgtctttgtgaatgccggggcagcaggatctgtgatcagaaacaatcctattgaaggtgtgccaggaaggcaatgccagcccgtgggcatcaggactgctgtgtagagctgtgtggcctgagcacctgggaacagaaatccaggccgggctttgctcattgtattagtttcctaaggcttctatcacaaatgaccactgtgggaagcttaagacaatatacagttgttatcttttagttctaaaggctggaagtgcaaaatcagtttcccagggctaggggagaacatacttccctgcctttttcagcttctggtggccgcctgcattccttggctcatggccccttcctcgcattactccagcctcttgcttctggcatcaagtcacctttttgtcttctggagtcacctccctttctgcctcccttttataaggacccctgggaagacgcggagcccaccagataacccaggataatctccccagctcaggatgggcaagactcaagcacatctgcaaaatcccttttgcagttttgttgggtttttgtttttagacagggcctggctctgttacccaggctggagtgcaatggcatgaccaaagctcactataaccttgaagtctcgggctcatgtgatcctcccactttagcctcccaaagtgatgggattacaggtgtgagctaccacacctgacctcccttttgcatttaaggtgacatattcacaggctccagggatgagaacacagacatcactaaaattgttattgaattaggcattgatgagaaaattgtagaagactagaatagaatcattaaaattttgaaaaaatgtatttaggttgcaccatggtatgtttacgtttttgtttaaagaaaatctaactggacattttattttttatttatttttttgagatggagtcttgctctgttgcccaggctggagtgcaacggtgcgatcatggctcactgcaaactctgcctcccaagttcaagtgattctccagcctcagccttctgagtagctgggactacaggtgcctgccatcacgcccagccagttttgtgtttttagtagagacggagttttactgaacacaaatgagcaaatgcacgagaaagtgctatgcaaactgttttactgttggccaggctggtctcaaactcctgatctcaggtgatcgactcgccttagcctcccaaagtgttgggattgcaggtgtaagcccttgtgcccagcctaactggacattttagaggctatgtagtgggaatggtttatgtaacgaagataactaaaattccaaacaacagatttatataaccaggaaaactctggttatatacccaaggattggtgaatgaacatgcatttgtagttttaagttaagtacaatgattaagctagggtaaggacctttttttgtttgttgttcttttgttttttgtttttgagatggattctcactctgtcgccaggctggagtgcagtggcacgatcttggctcactgtaatctccgcctcccgggttccggccattctcctgccttagcctcccaagtagctgggattacaggcccgcactaccacactcagctaatttttgtattttttttagtatagacagggtttcgccacggtggccgggatggtcttgatctcctgacctggtgatccactcgcctcagcctcccaaagtgctgggattacaggcatgcgccagtgcgcccagcctgttgctgttattttttaaaccaatcttggttcactgcagcctcgacctcctgggcttaagcaatccttctgcctcagcctcctgagtagctaggaccacaggtgcatgccatcacacctgactaatttttgtattttttgtacagatggtgttgcacattgttgccgaggctggtcttgaactcctggtctctagtgatcctcccaccttgatctctcaaagtgctgggactaccagtcccaaagtgtgaactaccaggaccagctggtaaggatcattttggaaaattctcttctctaaccattttttaaaaaaaataattggccaactttcaatttcaaccaagttgaaaaagaagacagaggctgggcgtggtggctcatgcctgtaatcccagcactctgggaggccgaggcaggtggatcacctgaggtcgagagttcaagaccagcctgaccaacatggtgaaaccccgtctctaataaaaatacaaaaaattagccgggcatggtggcgcatgcttgtaatccagctactcgggaggctgaggcaggagaatcactcgaacccaggagacagagtttgcagtgagccgagatctcgccatcgcactctaatctgggcaacaagagcaaaactccatctcaaaaaaaaaaaaaaaaaaaaaaacagaaatgtggccaggtgcagtggctcacacctataatcctggcactttgggaggccaaggtgggaggactgcttgagcccaggagtttaagaccagcctgggcaatatagtgagaacttgttgctaccaaaacttaaaaaaaaaaaatcaactggatgtggtggcgtgcacctgttgccccagctacttgggaggctaaggtgggaggatcgcttgagcccaggaggcagaagttgcagtgagctgagatcatgccactgaactccagcctgggcccacctaacttttgacgacaccccaaacttctacctcgatattctccgacagattcttcacaggtatgagttgaccactagggctggtcacacggaggccaccgacagtcccgctgacatcaaagtggcttcgggctggaaaggggctctttgggaaactcatgatctgaaaccaagagcaaggagtgttggccaaggcccctgagaagctggagggtgaaagacaaggtcctaagactcaaggagaagtagccctggcgtgtggggcgggtggggcctgccttcggctgctgctgcttcccctggcatgtttccagcctcagggctgaggccgcagagaacctgcgctagaggacccatatcagacttgcttgggctgagcaatgactggaatgtaaaaccatccaagtctttttttttttttttttttgacacagtctcgctctgtcactcaggctggagtgtaatggcacaatctctgctcactgcaacctctgccttccgggttcaagccattcccctgcctcagcctcctgagtagctgggattacaggtgtgcaccaccatgcccggctaattttgtatttttagtagaaatggggtttcaccatgttggccaggctggtctcgaactcctggcctcaggtgatctgttctcctcagcctccccatccaagtctttcttccccaaaagccagtaagtctttaagagaaagatgtttgctttcactagagctcagggagtacacagttagacgtgctttaatttgcggatggaagagagcctgggttggccatttccaagttatgacactaagctgaagagctttatttccagtgactacctgaatcaaggctgttggagaaattttgtagcacaatggaaagagggtaaatctgggagcccagaggtgtgggtctgaaggccggcagagccacttacttgtggctttgggaaaatcattgaacctcactggtacagcgggcatcatcatactaaacacaaataaggaaatgcacgtgaaagtgctctgcaaactgtaaaggctgtccccaaggacgctactaccgttattacctttatatccacgggctcctggccgccctccagagagctgagggaggaggcagcgggcagcatgaaggttgcagagtctgcggcatcagggcgcagggaggagccttgccaactccagggttgtattctggccacaaggtgaggacagaggtggcaggggagggaggagaaagtcagtgttcgagggagccctcacacctcctgcactactgggagcccagcttcaccatcagagtgggggtgtgttttgattcccataggtggttcagcatgtttgtttcagcagaagcagcacaagaggcagctagactggaggctccatgagggtggggctttgccagcctggtttactactgtatccccaatgtctacagcagcgcctggcatataacaggtagtccatcagtattttcgttgaatgaataaatgagcttggatgcaggtttttctccagggttatctccccttcccacctggacctctgacgtcatgtcttaaccccgccccatcttttctggtctttgaccttgcccctttctgatcttgttggggaccccacttcagatcgttcctctaatcaggatactgctttgggaaactgtctgtgagatctaagagggaaaccctggcaggaggaactgaggcttggggcagagggtcccagtgttgccagcagcattgtccagctcctgcttgtcaggtggaggaatggaaggtgtggagcatcccaggtatggcatcagtgctcactgagagatgagccctctgtgtgtgtgtgtgtttgtgtgtgcgcgcgcacgccaaaagtaagaggatcttgagtccctgcaggcccaaggagcagtggctggtcagacacatgcacagcatggttaacagcaggctagtcccattcattcagccccctggcctgcacagctgccatgtgaccgtctctcaggactccttcaggtggatctaacactgggcttggcactccatgcctcccttcctgtgctgtgcaaacactcaacatggtgacaagggggccttctctcggtgggaagcccttcccagctctaggtcccatcacttctctagctccaaggctggtctcctgagctctgcctagcacagggctttggagtgccggtgtggaatgaaccaggttaggggatgagctttcttggggacctgtaacgcagctggtttgtacctgtttgtgtacacagagatggagggggtggccagcatggctggaaggccccctggcagttttcccagcaggagggtggtctgcacatgctccatgactcgaagcagccgcagcactgtggcaatctgaaaaaggaggcaggaagatgttgctatggacctgctgccatacaccatctttggttactgtcaccaggccaatgtgggaccttcaggagggatcgggagagtacagagaggagggagtaagactgcctcggaggtggcccaagaacagtactcataaagcttccagactggcttttgtgagcccattccatcctcacagtaactcggtgtggcaggggcttcactagccccattggacagatgggggatggaggcacagagagggtaggaggctgtgggaggtcacaaattgataaggggaagagccaggactcacggcaaagcatatggctacagagcccgtgtgctgggctgtcagacaatgtggctgtctgggctgctgacatctgccagcaccctaaggcttgttccaggggaaatggacagctgagagcgaggccatttcaccaggtcacctgggcttcgaatctgctccccacccgtcccaacccccagatgagatgcatcctgacaccacggctggtgcggggacccaggaagggctggatgtttgcacataattcctgttggggcacagatcgtgtgggtgtgagtgtgtgtgagtgtatgtgtgcatgtgcgcacacacgtgaacacacagtgtgagggtgacatcactgcatgtgaatgtcagtgtttgagcgtgtgtatgtgtgagcgaatgtgagtgtggtcctgagcgtgtgtgggtacagtgtttgagtgtgtgagtgtgcacaggtgactgcatgattatggagtgtgcaaccatatgtgagggtctgtgagtatgtgagtgcatgtgactgcatggccctgtgtgaagatgcgtgtgtgtaaatgtgcatctgtgtgcaaaagtgtgtgcttgaggccgtgtgagtatgaggtcctctcagtgtgtgtgtgagcttgcacatgagtgtgagtgtggccatgtgtttttgtgtgtgtttgtggagattgagtgtgtctgagcatgtgcgtgtgtgcatccacgcatctttgcgtgttgtgtgtctttcagttcttcctgaatggaggtgatggccccatgtgatcaagaaccatgcaacagcaagaaatgggttttgtggctctgtcatgatgccatctaggaggctatgtccccaccaggatgctggggccacgtgacacagtgctacacctattcttactctgggcagctgcctctcttctgtgttcttggtaaaatgagccacaagtttacccagacctgctagtgggtccatatgatctctccagttggcagcttatttgggatgaggcagagtgccttgatttacacataaggaaatgaggcttaggtaagctctgtaacttgcccaggtcacaagcctcctaagcgacagaggcaggattcaaactcagaccgtctcattccagagcctgtgatttggccaccactccacactgcctcccagaagccctgctctctggaaattttctctttttttctttctttttttttttttgagaaggagtttcactcttgttgcccaggctggagtgcaatggcgcgatcttggctcactgcaacctccgcctcccaggttcaagcaattctgcagcctcagcctcccgagtagctgggattacaggcgccggccatcacgcccggctaattttgtatttttagtagagacggggtttctccatgttgaggctggtcttgaactcctgacctcaggtgatcctcctgccttcgcctcccaaagtgctgggattacaggcttgagccaccgcgcccggcatgctctctggaaattttcttccacctcccagggcaacaccttaacctctgtgccgcactttcctcatctgcaagatggggggggaaagttccacctagaaaagctgatgtgactaagcattcagtgtgtgtgaggtctgcatctggcctggacacccacctggctgctgctggcctccgcaggctcttctggtctgttgctcagggaagcttccagcacactgcccacagcctgaaacaggtccctggtggctgcctggcgcctctggtcctcagggcgggccttggcactcactgtcaacagggcctcactggcatgctgtagagccaagctggcctcccactgggttcacccaaataaggaaaagcgatgtgagcctctgcttaagatagaccattcctgtgtcattcaagggacaagggaagcaaggaggggaacaagccaggaaagagctgggctagacctggcacacgagctccctgtatctccggcttgagaccagggcctcccaccttacagtcctctgagatcctctaggagagtagcctggtctgcctctgaatccttcccagaacgccctgcacagtgcccagcacatagcaggtcttcaagaacattcaatgactaggggacggatggatggatggatggatggatggatggatggatggatggataaatgaagggtggataggcagtttgataaatggatgtatggatgataggtggatgggtggaaaatggatggatggaggatgaatgaatgaatgggtggatggaggatgaatgggtgatgaatggatggatggatgggtgggtggatggatggtagatggatggatgggtggatggtgggtggatggatgaatggtgggggggtggatggatggagaatgaaggatggataagtgggtggatagatggatggatgacaggtggatggatgaatgggtggaagatgaatggatggaggatggatgaatgatggatgaatagatgggtggatggtagatgaatgaataggtggatggttgcgtgggtgggtgggcggatggattcagtacatattcaaattttgtagttttctatgtatttttgaaattatttgtctaatgtctggctgtctcagtaatctgaaaggaccgtaatggcagatgccatgtctacatgatttgctgctgaattctcaatgcgttgcacattacctggcacatacttgacattcaggaagcatttgttaaatgaatgatgaaattaatgcatgcatgaatggatagaaggatagagtggaggatgtgtacaggtccatgtatatacagtgtatatgcatgtaaatagatggattagcaaatggatgtgtaaatgggaagtgtcatatcaagaattagccccagaatcaagaccagccttgctggcttcaggctggaagattttaggagcacaacctcctaccagagtgcgtggggcaaagccaggacagttctcttctcttctgtttttttgtttgtttttgagatagattcttactgttgcccaggctggagtgcagtagcgcaagcatggcttactgtaacctcgaactcctgggctcaagtatcccttatgcctcagcctcctgagtagctgggactacaggtataagccagtatttaggtgttgttttttttttttttttttttgtaaagatgtggtttccctatgtttcacagactgggcttgaactctacggatcaagtgatcctactgcctcaggctcctgaagtgctgggattacaggcatgagccactgtgctggcccgctttccctgtttttagggcttctttttattgttattttttttcatagggtttgctctgtctgccatgctggagtgtagtggcacaatcatggctcactgcatcctcgaccttccgggctcaattgatcctcccacctcaacctcccaagtagctaggactacaggtgtgtaccatgatgcccaaccaattttgttttgctttgtttttgtttgtttgtttgtttttttgagatggagtctctatcacccaggctggagtgcagtggcacgatctcggctcactgcaacccccacctcctgggttgaagcaattctcctgcctcagcctcccgagtagctgggactacaggcgcacaccaccacgcccagctaatatttgtatttttagtagaaatggggtttcactatgttggccaggctggtctcaaactcctgacctcaggcagtccacctgcctcggcctcccaaagtgctgggattacaggcgtgagccaccgtgcccggcctttgttttgtttttgaagggatgaggtctcactatgttgcccaggctggtctcaaactcctggcctcaagcgatcctcctgcctctgcctcccaaaatgctgggattacagacgtcagccaccgtgcctcacctatggcttcttttttaacccttggctgtcagaaccctgggaacacggtgttttaatttgagttctccaagaagcagatcccagagcaagaatttgagagcaagtcatttatttggacatgatcccaagaaacacttgtggggagtagggggtgtgagacagggaagggtggaagccagtacaggagtgtgatcaagcccattacctgggattcactcctgcttgggattatccatcaagaggggtgaggtagctggggtgtttataagccagcttcattagtcactgaacactgcatgaattcacagccatatgggcaggtacagtaggctctgagggtcagagaagacccccagaaggataaggaagcacaggagctggcagccagatgtcaggctggcatgtactgaagttgagaacatgggcagtcagtagcagtgtctggactcac

SEQ ID NO: 108 - DNA, 14463 bp, Homo sapiens
gagccagaatttcttcaactctaacaagttcttttgcgtaattttacatctcagaaataggagtgtagcttctaactcaggcacacatataatgacttggtgttttttccaaagggaaaattcctttaaattgctgtcttttcccttgcaagcagactcagaaaaaaaaaaaaaatgaataactagctacataaattgttgtcttgtctcaagatcaaatggatgttaacattgaggaaatagggtattatttatacatatatatgtataccctagggcaagggtaacctcgggtaatatgatagggctatttttcctgccttgggcctgcccagagggggtgctccaggttcatttgttgaatatataaataaaggaataaaagcccagggactagactgctggcagtagggaagggatgggtggaggggaggagggcgggtgcctgaggcagggtcctgaccttcaggggctgggtgacgaacatgctctccacgaaggagacagccatggagatgagccacctgagggagctggccctcccgtagtgcaggccgtagagcatggtgaagaaggccgccacgccactggtggccgctaccaggagccagcccaccaggatgcaccaccagggcaggccttgagggggtttgctcacctgaagagcgctgcaaaggaggtggacagacatagttagggtggccacacccccaggcaatctcaaggtcaaaccccactctactctgatcagcatgaccttggccaagctcctggacctctcagatcctctgtttccttctctgtaatctatacctatctcaaaggtctatgccatagtctgtggagtaaaagcagttacatttactcagtgcttagtaggggcaagtccccgcactaaatgctacacacagatttgctctgttattgctcagggcaagcctagaaggcagataccatagaatcttgttttaagttttctccccccgggtgcagtggttcatgcttgtaatcccagtactttgggaggccaaggagggcggaccacaaggtcaggatttcgagaccagcctggccaacatggcgaaaccccgtctttactaaaaatacaaaaattagccgggcgtggtggcgggcacctgtaatcccagctactcgggaggctgaggcaggagaattggttgaacccgggaggtggaggttgcagtgagccgagatcgtgccattgcgctccagcctgggcaacaagagcaagactctgtctcaaaaaaaagaaagaaaattctcatcatacaaaaattagtgagcacagtgaatacccaggtgtttattagctggcaaccactatcaccccttgtcacacttatttcatctgcccctcagccctgttttgtttttgtttttggctggaaaatttcaacataaattccagacataatacaaaataattcctagtcacttcagaatgcatctcaaaagtggccatttttgccaggcgtggtggctcacgcctgtaatcccagcactttgggaggctgaggcaggtggatcacttgaggtcaggagttcgagaccagcctggccaacgtggtgaaagcccatctctaccacaaatacaaaatttagctgggcgtggtggtgggcacctgtaatctcagctattcggggaggctgaggcaggagactcacttgaacccaggaggcagaggttgcagtgagccgagatcacgccattgcattccatcctgggtgacagagcaagactctgtctcaaaaaaaaaaaaaaaggcaattttcttactgaattacgatgctgttttcacacagctaaattaacagtaatttttaaatgtcacctagtaacctgtctgtattcaaagttcactggttatcttaaaaaatgcattttgttttaagtttgaatcaagagataggcgtcatcattcccattttaaagatcaggaaactaagcctgagaagttgaggagccggtccaagagtgaagtgcacagatgggaaacagcccacaggaacaccgttgtgactgtagcatgcggtacaaagggccctgagtgccttccagcaaacagacctgttcaaacccggcctccctgaatgtgtgcaggaatcctgcattgtttctgcctggcaaggtctgggtggacatccttccaagattgttcagaatgccctttccagacggccccaggctggggcaggcaggcacccactcagcccccagggaagtggattacctggcatgtgcaggggcccaggtgcccggctgtacccccaggccgcccttcagggtctgcagctgcctgagggcctaggcatggctgtggggctgggagaagcctcggggccccaccagccgcagctcttgctccacgtgttccagctgaaggtacagacactgcctgtaggcgctgtccttccaggggccactccgtgccgccttgggcttgggacactgtgatttctctggaggacaaagaagaaagcgatcagcttgtgctgagtcacagagcaaaccagctgcaatacaaacaacagccaggtggggcggcatgcgcaggtggtcccagctactcgggagactgaggcaggaggatcgctggagcccaggagggcgaggctgcagtgagctatgatggcgccacttcactccagccagggcaacaaagccagatcctgtctccaaacaaaacaaacaaacctccccccacaaaacacaacagtaatagtaccagcttctgagtatgaaatgcttgctatgtgccaagccctgagaaatctgaggttcaaagagacggagtaaggttttagggtcacacagccagttaggattcgatgtttctcttttagatttttatcagagtcattcttcaaatttccctacacatcaagagaacagaggagaatcccatactcatcactccagctacaacaatgaccaacatttggccagtcttgtctcatctcttttcttctcctggagctttttttttttttttttttgcagtgaagtctcactctgtctccccagctggagtgcagtggtgttatctcagctcactgcaacctccacttcctgggttctagaagcagttctcttgcctcagcctcctgagtagctgggactacaggcgcacgccaccacgcccagctagtttttgtatttttagtagagagatggggtttcaccatgttggccaggttggttctaaactcctgacctcaggtgatccgcccgccccggcctcccaaagtgctgggattacaggcgtgagccacagtgcccgccctcaccccccgactcccccaccccctgggcccagagtattttaaagcaaatactttaatatggtaagacttgaatttgaacccttttttgtctagtgccaaatatagtgtaatcctgtccctttgtttttttgttttttttgttgttgttgttgagacggagttttgctcttgtcgcccaggctggagtgcagtggcgcaatctcagctcactgcaacctccgcctcccaggttccagtgattctcctgcctcagcctcctgagtaaccgggattacaggcacccgccaccatgcccagctaattttttttttttgtatttttagtagagacggatttttaccatgttggccaggctggtcttgaactcctgacctcaggggatcggccagcctcagtctcccaaagtgctgggatcacaggcatgagccagcacgcccggccaatacagtgtaatccttaatcttgtgtttttagcttttttaaaaattatgaaacatctcaaacatataaaattagagcaaatgatgagatgaagccacacagcgacacagcgtcaaaatgatcaaaatgacgcagcgagactccgtctcaaaaaaaaaaaaaaaaaagaagaaatgcagttataatcttgtatcttcccttcacctacaggacaagcttttctaactgtgcttagcatctccaaggcagagcactatcccacctggaggttgccttgagagacagcagtccatctgcaacccaaagaacgcctccgacgaaactgtctctcatgttgagagtttcagccacttgtacaggctagccctgcccaggaaggtgcaagctggacctcctggtagataattctaattcactgaagtgcgttacgccgacccccactggcttgcttcctctcctccccgccattcatgccaagtctccttttaaaatccctgctttctgcctcagaggtgtagtgatatccttaagtcaggaagcctgtacttcttcccctaagctagctttggaataaaaagttacttctctttctctctccacccaccgacctctatctctttttgagacagggtctaactctgtcccacaggctggagtgcagtggcgtgatcttggctcactgcaacttctgcctcccgggctcaagtgatcttcccacctcagcttcccaagtagctggggctacaggcacatgccaccatgcccagataaaaaagtcactttttttttttttttgagacagagtctcactctgtcgcccaggctggagtgcagtggtgcgatctcggctcactgcaacctccgcctcccaggttcacgccattctcctggcacagcctccctagtagctgggtctacaggcacccgccaccacaccggggtaattttttgtatttttagtagagacggggattcaccgtgttagtcaggatggtctcgatcgcctgacctcgtgatccgcccgccttggactcccaaagtgctgggattacaggcgtgagccaccgctcccggtcaagagtcactttttaaataccagatctcactctgattaactggactctgcaaatggcaagcaactatatctgcattttggttacagccaggtatatgcatctccagccctgactcagataaggttagggtgttgggtaaatggctatggtgaggtcaactcctaccttcctctgactcacagcctcctccctcaccctcctgactgggctccctcactgaagcctcagctgaagattccaagtcaacactttattttgcagggcttctgctaatgtttctgaaagataacatcactgccaatcataacaccacttactgtatacctgctttgtgtcaggctgggatctaaatactttacatgtcttacaatcttattcagccctcacaataagccaacgagctaggtggatcaatacccctattttatattttttttactttgagacacggtctcaccctgtcaaccaggctggaatgcagtggtgcaaccttggctcaccgcaacctctgcctcccaggctcaggcagtcctcctatctcagcctctcaagtagctagaattacaggtatgtgccaccacgcccagctaatttttaacacaccccctttttttttttttttttttgagacaggagtcttgctctgtcacccaggttggagtgcagtggtgcaatctcagatcactgcaacctccacctcccaggttcaagtgattctcttgcctcacctcccaggttcaagtgattctcctgcctcagcctcccgagtagctaggactacaggcgtgtgccaccacatgcagctaatttttttatttttagtagagatggggttttgtcatgttgaccaggctggtcttgaactcctgaccccaggtgatctgcccacctcggcctcccaaagtgttgggattacaagcgtgagccaccacgcccagccaacacctctattttctaagggaagaaatgaagtctcagagaggttgagcaacttgtttaaagttgcaccgctgctactgcagctgggagatcccaaggttctggccgactccagagttcatgttcttaaggtccagtgtgtccagctgtgaatgctaaaactcccaaactcaaagtcaaggatctagtggaagcagggatgacctccataagcagcccaaacccagctctctggggcaaattcttttttttttctttttttttgagatggagtcttgctctgtcacccaggctggggtgcagtgatgtgatctcagctcactgctgactacacctcccaggtttaagcgattctctgcctcagcctcttgagtagctgggactacaggggcaagtaactctatcaggggtggggccaagaattatgaattcaaattgcttattctataaaccatactttcgtgttctaaacaaggtttagatagtggccacccttgtgtattaaaaatggtagcattctaaacccacataactatccaccatgttccacagaacatttctgtcactgtagaaagttctattggatggcaccgctctaaatgggaagatggacaggaaaggggcatgaagggaaccaggagactagttgaaaccggaataatatgccatatatacatttgtttaatgaaaagaaaacaatgttactgggttctagctggatattgttggaaaaacctctgaatttgagatcttttatctctgtcaaacagattaaggagtgttagagaggcattaaagacatagtcgcaccaaactgagactttctcccttttttttagagctagggtcttgctctgtcacccaagctggggtgcagtggcacctgtaacctcaaaccagtttgctgtaacctcaaactcaaaaaaaagactcaagggatcctcccacctcagccttccaaatagctgggactacaggtgcccattgagaaggagtcttgctctgttgcccaggctggagtgcagtggtgtgatcttggctcactgcaacctccacctcccgggttcaagtgattctcctgcctcagcctcccaagtaactgggattacagatgtgcaccaccacgcccagctaatttttgtatttttagtagagatgaggtttcaccatgttggtcaggctggtctcgaactcctgacctcaagtgatctgcccaccttggtctcccaaagtgctgggaatacaggcatgagccaccgtgcttggctaacacctggttaagttttaaactctttgtacagacagggtctccctatgttgccaacgccggtctcgaactcctggcctcaagcaatcctcccgcctcagcctcttaaagtgctgggattagaggcgtgagccagtgctcccagccatttgcttaattaggaggattgaaaacgaatagagaaaggaataacttttccagtctgcaattccatgttccttaatggtttttgctgccctgactgtgatcttgcttcctgccccacatattcaggcacggatcgagttcagctttgcaccccagcactctacagaagaaggcaccgaggcattgagaatggaggtcacctgtccacggtcacacagccggctagtggcagagccaggacccagacatggttcttcctagtggagatgagacaaaagacagatggacggctcccacctcacggagtttacattccaggaaggatggcgcaagctttaaacaattttcacctgattcattagttggccacaaacaggttgaatgcaagaagcttagggagttggccgggcacagtggctcacgcctgtaatcccagcactttgggaggccaaggcagatggatcacgaggtcaggagattgagaccatcctggctaacacggtgaaaccccgtctctactaaaaatacaaaaaattagccgggcgtggtggcaggtgcctgtagtcccagctattcgggaggctgaggcaggagaatggcatgaacctgggaggcagagcttgcagtgagctgacattgtgccattgcactccagcctgggcgacacagcgagactccatctcaaaaaaaaaaaaaaaaaaaaaaaaaacttagggagctaaagagcgcgtggtcagaggccctagtgtaggttagaggcttgggttgctcccctgaagaaggaatgcttaagccaaaactaaaatttcagtaggtattggcctggcgaagagaggagaaagaacattctagactaaaggaccagcctgtgtgaaggctgttagtgggaaggcagcttggcattgtagggacagtaggtgcctgaggtatacagagggaggggatggccggtggttcaagcagaggctggtgagggagacctcttgttcccctagtgatgctgatgtacccctttgctgtgtctccacccggccccaaaatgcggcttctcttggcacagacatgtccagggcttacctttcatttctgatgaccccaaagtgagtgttacagggtcctctctctttttggcttcctcccagaacacctgccctgatgtgttctgtggataaatgacatcttccaccaaggcgaggagactgttgatgtccatcaagttcactgagtcccagcccaaggcgggggatggcaccttgagagctttgaagagggagctgacgattcttgacacatcctggtggggaaaggggccataagccaaggtgaggggtgcagcacaggggtcaagagcacacgccctgggcctggcaacctgtgtagggacccctgctctgcccactgagatgtgatagtgacctccctgagcttccatttgtcagctcttgaatccctcttctagggtttgaactcattccaggctgtactcctcaaagcgtggcacacagtaggtgctcaatgaaagcttactgaatgcatcaacgcagagcggggagtctcgtccatgggcttccagcctgggagtctaccatgaaggcataattctttgcacacagtagatactcaaaaagtatgtgggtgtatgcgtgtgtgcacatgtgcatgtgtatgtacatgtctgtgtgtctctctgtgtatgtgtgtgcatgtatgcatatgtgcacctgtgtgtttgtgtgtgcatgtgtgtacagatgcatgggtgcatgcatgttgcatgtgtatgtgtgtcttcagttgatgaattttggcacctcacgttgccaggcaacacagggctgctgggtctcaagccccaggcctcacccccacttctgctgaggctacagcaccccccaggctagctgaggttgaggacctgccttggtcactgcctcaggtgtcagaaggccgtcctccatgggctgtggggagggagtcaggttgggggacccccggtcccattttccagtgttctgctccttcgcgacccggggacgggtgttctgaaagatctgaacaatcaggaggttgatggggaacatgaggatggagctctccaggccaatcatcacctcctgccaggtgaattcaattttacctggggaaagggaaggaagggatcaaagggagaggccaccgcccggagcccagtcccttctgccccttgtggaagctggctgtgcagtgaagggttaaccctgcccaacgcctgggaggtcaccgctcagcccttggaagttcccaactgctaagaatgtctttgtttccctagggtcttgggtcacaccggatggtctgtgctaatgatgagatttaggtgggggcctagaccatatgatgtcagcttgacctctagaggggctggaggcgaagggcagccaagtgggtgtcagccatgcctatatgttggagccccagtaaaagctctgaatagtggctgggcatggtggctcatgcctgtaatcccagcactttggaaggtcaaggtgggtggattacctgaggtcaggagttggaggccagcctggccaacatggtgaaaccccttctctactaaaaatacaaaaattagctgggcatagtggtgggtgcctgtaattccagctactcgggaggctgaggcaggagaattgcttgaatccgggaagcagaggttgcattaagccgagatcataccactgcatttcagtttggatgacaagagcaaaactctgtctcaaaaaaaaaaaaaattgtgaattgcaaggctggagtgagtccccctggttggcaatactccatgtgcactgtcacacatcctcaggagaagtcagcaccatccacgactccactgggagaggatgctggaagctatgtgcctggtctcttctggcccctgctccatgtgtctcttccctttgctggttttaatctgtatcctttctgtgttttttgttcttttggtttgtttgtttattttttttttttttgagatggaattttgcatttttttacccaggctggagtgcaatggtgagatctcagctcactgcaatctccgcctcctgggtttaagtgattttcctgcctcagcctcctgaatagctggaactacaggtgtgcaccaccacacccggctaattttgtatttttagtagagatgggttttcaccatgttagccaggcttgtctcaaattcctgacctcaggtgatccacctgccttcgcctcccagagtgctgggattacaggcgtgagccaccgtgccagctgtatcctttcactgcagtaaaccataactatgagtacaatgggttctgtaagtcctgctagtggatcactgaactggagggcggtcttggggactctggaatggcagtggcattgctggagcagtgaaggctcaggtccaccagccactaaccctgacctccatgacactgggaattacccaagtccatcttttgctcagctgggtccttggggaccccccagaacatgatgctggtcagcatggtgcacagcagcagggagaagcagcaggacaccctctggacgcgggtgaagctgctgcgagcgcagcggctgaagatcgaataccagatgtgtccatcctggaagcccgcggaagtcttcatgaaaaacaggtggctgcaggcaggcagggagagagggacaggcatttagggagacaggaatgggggaaactggtctctgtgggtcgttcttgggatgagaagcaggaagagcggcagagatttgtttctaagattgttcacactttttttttttttttttttcagataatgtcttgtgtcttgctctgtcacccaggctggagtgcaatggcacgatctcggctcactgcaacctctgcctcccagattcaagcaactctcctgcctcaaactcccaggtagctgggattacaggtgcccacaaccacgcctggctaattttttgtatttttagtagagacatggtttcaccacattggccaggctggtttcacactcctgatctcaagtgatctggccgccttggcctcccaaagcgctgggattacaggtgtgagccaccgcgcctagccacatttttttttcggatggagtcttgctcttgccaggcaggagtgcagtggcatgatcttggcttactgcaacctctgcctctggggttcaagtgattctcctgcctcagcctcccaagtatctgggactacaggtgtgagctattttttttttttgtatttttagtaaagacggggtatcaccatgttggccaggatggtctcgatttcttgaccccttgatccacccgcctgagcctcccaaagtgctggtattacaggcatgagccaccgtccccggctccccccccaatttttttttttttttttaatagaagaaacacagcatcttagcagcatcacttagagttaacaatgaaggctctggaagtcagattagaattacagacggccctcttcccagctgtgtgacctcgggcacgttactttgttctttgtaccttagatgacttgtctgtaaattggggcaagtaataataacagaacctacctcactggattgttgaaaggaataaaagtgatgattctgtaaagcatttggggcagtagctggcatataggtcaatattcaatcagtgtcagcattgttatttttgctgtaattttaatataataatatagctaaaatactattagttttgttacagttagatcattggagtacagtggttaaaaatcccaggcatgacggagtgcagtggctcattcctgtaatcccacgactttagcagggcaaggagagagggttgcttgtggtcaggagttcaagaccagcctggccaatgtggtgaaaccccgtctctaataaaagtacaaaaattagccaggcatggtggcatgcacctgtaatctcagctacttgagtggctgaagcaggagaattgcttgaactcaggaggcagaggtcacagtgagccaatatcgtgccaccatactccaacctgggtgacagagactctgttcaaaaaaaaaaaaaaaaaaaaaaatcccaggcatggccaagcacagtggctcacacctgtaaccccaaaactttgggaggctgatacggaggatcccttgagcccaggagtttgagaccagtctgggcaatatggtgaaaccccatctctacaaaaacagttgggcatggtggtgtatgtctacagtttcagctactcaggaggctgaggtaggaggatctcttgagaaggtcgagaccatcctaggcaacatagcaaagattcgtctctacttaaaaaaaaaaaaaaaaaagaaaaagaaagtgaggcatcgtggtgcatgcctgcagtcccagctgctcaagaggctgaggtgagaggattgcttgacccaggggggtagaggttgcagtgagctgtgatcgtgccactgcactccagcctgggtggcggaacaagaccttatcttaaaaataaagaaaacaaaaataaagtacctgaattgttttctgtcctgctccgtggccacaggaaacaccttatcgaggacgcaatctccaacattgatggatagccaggagttgcacaggaaataccacttccggtccatcaccaggtcatagaccagcacccggctcacatacctggagaagggacccagagttttgaggataaggtggagcaggggaggagacttcactggacatcaccaaggtaacagttttgcaaacatgaacccaaagaacaagagctcctcagaaaaagaaaccatatttttctttgttcttggtgccttaattaaaattcgcgtcacataaggaggtcagctactgtagagagccaactctgggaagctgccatgtttccacaaagatgctgcaaaaggatgcattcggagaccattaacctgtacacatggcaccaagctcagggccagcgtccaggcatgagcaagtaaagccaaattgtgtaaagtgtgcatgttcaggcaggtgcaggctggggtacgcagaacatggtcctctcttgcgtttctttctttctttttttaaattttagacagaatcttgctctgtcacccaggctggagtgcgatggagtgatcttggctcactgtaacttccgcctcccaggttcaagcgattctcctgcctcagcctcccgagtagctgggattacaggcatgcaccaccacacccggctaattttgtatttttagtagagacagggtttctccatgttggtcaggctggtgtcgaactcctgacctcaggtgatccacccacctcggcctcccaaagtgctgggattacaggcgtgagccaccgcgcctggcctcctctcttgcgtttctaaccaaagaatcaccgtctatcttgggctgaggactttgtgggtatcttctaacctgatttaggtctttgaggtatggggaagaattgaaattatcttgcctatcctgtgatgtcagatcgagcagcagttttccctgttgctatacagccaacaagaacagcaatgatggctgggtgtagtggctcacgtctgcaattgcagcactttgggaggccaaggtgggcagatcacttgaggtcaggagtttgaaaccagcctggccaacatggtaaaacctcatctctactaaaaatacaaataaataaataaataaattagctgggcatggtggcgtatgcctgtaataccagctactcaagaggccgaggcaggagaatgacttaaacccaggaagcagaggttgcggtgagccgagattgtgccatcactccagcctgggtgacagagtgagactctgtctcaaaaaaaaaaaaaaaaaaaagaacagtagggatagcaatagccgctcttcactgagaatttactacatagcgggggctatgctaagatgctcttgatatgcattttctcatttcaggaagggcagccccgtaggaatgcaaaagccacctatgtcaaggtcacaggcttttctggggcagctgacatccagtgatgcagtacctacagggatcaagacctgggtatttcaacccaacttgggacagctccagagctccccagtggtggaccacactgttgctgggctgcatcacagcttgacttttctgccatcctgcctccttccctctgttcccaggtgctggtcccagggccctgtaataaacaccctgcatatgcaactccatctgagagcctgcttcccgggagcaacctacagcg

SEQ ID NO: 109 - DNA, 19719 bp, Homo sapiens
acactgcctattagtctcatgttctaatcagtcactatcagccatttctgtttttttccaagatttcattctgactcttaacacctttagatttgctctgaatcaattctttcctttgagcaaggaagacataacatttctttcttctaatgtaaaaagagtcctgtgaggcggggtgcagtggctcatgcctgtaatcccagcactttgggaggccaaagcgggtggatcacttgaggtcacaagttcgagaccagcctgaccaacatggtgaaaccctgtctctactaaaaatacaaaaatttgctaggcgtggtggtgggcgcctgtaatcccagctactcgggatgctgaagcagaagaatcacttgaactggggaggcggaggttgtagtgagctgagatcgcgctccaacctgggtgacaaagcgagactccatctcaaaaaaaaaaaaaaaaaaaaaaaaaaagagtcctgtgagactccagggcagtttagcaaagatgcccatacaatgcatctcctccaaatggtccccaccagcttggacgtgctgggggactcagccactctgctgaggcctccctcctttctggggtagggtgtgtgcaactaggagctgtggaaccacctctgacaggccagctcacactttgccatgtgacgctccccgacttctctcaggcgatttgaaatccctcctgaagagatgagaagtagctgaattaaccccatttctcctatatccctctgctcaaggagttaaaatggatttgcggtgagcaagtcttagatctctgatatttaacctcataggaataaaaaatacaactgccaacttttactttggttccagtcctttgggttatagctggatagaaacacatccactagccatcttccacatcaacagtcatcaaaaaaaaaaaaaaaaaaaaaaaaaagagtcctgtgagactccagggcagtttagcaaagatgcccatacaatgcatctcctccaaatggtccccaccagcttggacgtgctgggggactcagccactctgctgaggcctccctcctttctggggtagggtgtgtgcaactaggagctgtggaaccacctctgacaggccagctcacactttgccatgtgacgctccccgacttctctcaggcgatttgaaatccctcctgaagagatgagaagtagctgaattaaccccatttctcctatatccctctgctcaaggagttaaaatggatttgcggtgagcaagtcttagatctctgatatttaacctcataggaataaaaaatacaactgccaacttttactttggttccagtcctttgggttatagctggatagaaacacatccactagccatcttccacatcaacagtcatctaaagctggggtccctaacccccaggccatgggcctgtaccagttcatggcctgttaggaaccgggccaccacaacaggatgtgagtggtgggtgggcaagcattaccagtgagctctgcctcctgtcagatcagcagtggcattagagtcacgtagcatgaaccttactgtgaactgcacatgtgaggggtctaggctgcgcaccctttatgataatctaatgcctgatgatctgaggtggaaccatttcatcctcaaaccatccccaccccgctggtctgtggaaaaattatcttccacgaaaccggtccctggtgccaaaaaggttgaggactgccgatctaaagggagcacacaaagtaatgactcttggcagggtacagtggctcatgcctataatcccagcactttgtttgggaggctaaggtgggaggaccccttgtggccaggagttcgagaccagtctgggcaacatagtgagaccctatctctaaaaaagttaaaaattagctgagtgtagggtgcacacctgtggccctgatcctcctgcatcagcctcgcgagtggctgggactccaggtgcgtgccaccatgcccaactaagttttgtatttttttgtagagacggggtctcaccttgttgcctagactagtctgaaactgctaggctcaagcgatctgcctgcctcatcaaattgtatggtttaacaggattaattttatagtatgtaaattcaagctcaataaagctgttattgaaaaagaatcctctggctgggagagtggctcatgcctgtagttccaacactttgggagtctgaagagggtgcatcacttgagcccagaagtttgagaccagcctgggcaacacagcaagaccttgtctttacaaaaattagctgggtatagtggtgtgcacctgtagttccagctactcgggagagtgaggtggaaggattgcttgagctcaggaaggtaaaggctgcagtgagccatgattgtaccactgtgctcagcctgggaaacagagtgagaccctgtcaaaaaaaaaaaaaaaagaagaagaaaagagagagagggaaggggaggggaagggggaagagaggaaagggagacatgaaggaaggaaagggagaaggaaaggaaggaaaaaaaggaagggaggaaggagaaaagaaaaagaggctggacacggtggctcacgcctgtaatcccagcactttgggaggccgaggtggacagatcacgaggtcaagagatcaagaccatcctggccaacatggtgaaccccgtctctactaaaaatacaaaaattagctgggtgtggtggcgcgcacctgtagtcccagctactcgtgaggcagaggcaggagaatcacttgaacccaggaggcggaggttgcagtgagccgagatcacgccaccgcactccagcctgggcgacagagcgagactttatctcaaaaacaaagccaggttgtgtggaaatcctgtggctgtccacagctgtctggcgggtgcctccacagcaggcacagaatgtgcctgtgcctccaaggatagactgagcccagggaaggacttcttgccaagtggatgcaaaggcacaactagcaggccaggcaaccctgtcagccaggtgtggaggcatgcacctgtgattccagctaccctggaggctgaggcaggggaattgcttgaaccaggaagatggaggttgcagtgagcagagatcacgccactgcactccagcctgggtgacagagcaagactctgtctccaaaaaaagaaaaaaaaaaaaaaggaatgggtgacaactgctgttagtttctgcacaccactgggcccatctgaacagtaatcctacaaagagtcatgggaaatagagtcttgtggaagatgtgcacattttgtttcataagctaatttcttggtcaccttctttccctctttgtcttacagagtgaagaatgatgaacttgtgaaagttcaggtatgggtgggctgagtgtggagtgggagggtagagccagcccaagggaaaagggcagaatgctgggtcaggagtttgatgcactttccctgttaggtgcactttccctgttagcattgagataggagctgccttattggtaactagtggccctaaaccacttggttatacctaagttatatcagatctcaagtgattgtatgttcctgtgaggctcttcctagttatagttagtattttataattttgtgagattatttttagtacgtagaaaggggattgcctagatgctaatggtgcttcagcccatgaactgggagctctagcacatgaatagtgggtaatgatgggaagtagccacattcccgttattaacccctgccttccctgttagcttcctgcttacatgcttcaggaattgcctgggcactccacttttctggagtttcagggaagaccttagatagctgcttgttgtaccgatttaggttttccaggacaatctggtctctctttgcaccaatctggtggatgatctggacttcatctgtgaacagacaaagaaacaatgagtcccctataacctccctatttcctttctccctgggttcctaatcaccaggatcagacccaacttccttttgccctaatctaagcccctaggatccatgactgccatactctggggcatcccttgaaggtgaccattgcttagaaatatcacagtgataaatcactatagtgtctgtgggggaaaaaaaaaagaaaaaggaaatgtcatagctagtcacctcattagaggcctgggagccaaggatggtgatttccttcctaaggcagaacctatggccgggtgtggtggctcacacctgtaatctcagcactttgggaggccgaggtgggtggatcacatcatcaggagttcgagaccagcctgggcaacactgtaagacccccgtctctacaaaaaatacaaaaattagctgggtacagctactcgggaggctgaggcaggagaatcagttgagcctgggaggtggaggttgcagtgaagatagcaccactgcactccagcctaggcaatgggagtgaaaccatttcaaaaataagaaaagaaccggctgggcaccatggctcacgcctgtaatcccagcactttgggaggctaaggagggcggatcacaaggtcaagagattgtgaccatcctggccaacatggtgaaaccctgtctctactagaaatacaaaaattagctgggcgtggtgatgcgcgcctataatcccagctatttgggaggtggaggcagaggttgcagtgagccaagattgtgtcactgcactccagcctggcgacagagcaagactccgtctcaatagaaaagaaaacaaaagaaaagaacctatgtaaccacttagaggccttatcccttataaaaagctagatactaaaaaagaggcacctaattaatctcatcagtcatgaatacttagagtaattttgttaaacactttgagaagactttcagctgcagcagtttaggaacaagatggggcttgggaagaagaaacagcttggaacacgaagacctagattgagtatcctggaagcccaggcatctaagggacagcagtagggacagggaaggtggcaaacatttactgaacaccttaaacagacattgagcaagaagcattacagatgctttctcatctactctactcaaagtgcatttttgttaacatcacttcacaaataaggtacttgtggctcagaggaattatataatttactgaaggttactaaaaaaatactgagccaggatttaaacccaaatgtgcctgactccaaagccctgattttttccaacatagcaccttggtgggagaatatctcgaagtgggagaatatctcgaagtgagagaagggagaagggtagatagagaagagatggattgttcccaaagtcttgccaactttacagttccacccttcattgcctctttagtaagatagagggatagagaaagcggggagagagagcagttccctccctattagttatcactccccgacccaactcctgtgctagtgtgggtgctgggtcatgaacatgaaaacctgggtcatccagggcctcttgtccatacccacaactgtttccagcccccagcaatcttccaccttcctggcccatgtccccgtgtgcccctaccacaggggcccagctctattaccaaagtaaatctcctgttcaaaggtgttgtctgtggagtaggcaaactttccagctcggggagtcacctggcgaaagtagctctgggtttggggctgggagaggctcgtcttttcatggatatcctcagtgctcttgttgccaggcatgatctcaactgtctctgcttgttggaagtaactgggcaatcttggcaggggtgagaaaggagggaaaagggggaaagagtaggaggtggatccccctttccattaaatccacagctcgttccctttcctctttaagctcagctcctatacacgtgagcattgcagaacaccaatgtttaacttttagccttgtccccatggtgccagttgaatgtggagctgccagaagggcctgtctacagctgtcctgcctggctactaaaggatccatgccttctgcagccaccaagcagcagggcagagtggcggtgctccagcataacccttttttaacattcgtactcttagaggcggcatggccttggggaagggatcccacctccttcgtcatctcactctgtctattctgtgtgtggttatttaatgtccatccacctggtggtggacaggctgtaagctccttaaaggtacatatctgtgtctgttgcttttacattgtattcccagcactttgcagagtgcctggaaagtagcaagaacataatttatatttgtccaataaatgaataaataaatggatttccactgatttttagttcactcttggaaatcagggatagtgtaatagctccagtcttccctctagctataaatgagatagaagcaatctaagaaacatgtagtcatcttcttctctcaggttgtctggttctctgtcctgcagctagtcagtttttgagtcagtgacacactggttccttattcagagtaaggcaggaccaaacctcggtgctatgaggttcctgccttcctcactccaccaaggatacatttctgggagcacctggttggtaactacaccagcagtctgatggcaaagtctgctggagaaggttgagaaccaatccctttaagagcagtggttcccagctgggaatgactttgttcctcttggagacatctggcagtgtctgagacatctttggttttcacagctaggagtttgtgctctggtgggtatgagccagggatgctgcttgcatcccataatgaacagggcagctcccacaacaaaaattatccaacccagaatgtcagcagtgcaaattgagaaaccttactttgcagagctctcagagagcaggccggtggtggagaacatgaagttgatgggagagtgcattctgaaatcgggagtgtgagtccacctgggagtccctaaaggggagtcagggattatcaaaggtgcacttgaggccctggccagtatacctgtagtaaacgggaagcagcagttctggcttcttcttttcctgtgggggcaggatgacactttgatcctcaaactctgctgtctcttctgcctccagctgtttcaggagctccaggtcactggcagaggtaagctcatcccgaatgtgactccagtcgtactgctggcgcaggaagctctgccacttgttgggggatgccccaggccttcgaggacgcttgctctggatccatcgggctgtgcgctcgttcagcttttccagcacagtggcctcccacgctctggcctccttctcaggaggcagaagccaggcttctctttcctccaggttcacatctagagaaggtggccgacccagcatatctggatgcatgcagggatgatggatgagagggcggggtgcttcccggacggtgctggctggctttgatttcttcagcttcttttcgggattggcagagctttctgtcttcacagccagggaggtgtctcctgttaagggacttgaggaacccaggaacttgaagctaacaggtttctgaggccgggccttcctgatctggggagtatggatgatgtcattggtattgtagaggtggtcaaagctgtactggctataaggaatgctgggcaggcctcgctgccacaccacctcctgagagaaggtaaggtttgcagcagccattttcaaatattggctcttgcggtgtagacggtactgtgagctgaagaagaccataggcacactggagacagaggcacactcctccttgcctttcaattttgagtagtttaaaatcatgccccatcccagtcgtgggggcagtgactgatagaagcaatgggggagaaaggtctttcccttctgggtcctggtcataccgcgtcccagcaaatgcttccttccacactgcctggcctagaggaaaggcctggagatgagacctggcacctgttaagggaatgggaggaactgatgagaactctagagcagcagaaattggtagcccatagcagttcagaaagagaataacttgaaaaacagatggaaagggggtggggaagagccatgtgagttagaagaacaaaagaagaaaatggtgcaacatcctaaatatttcatgtatcagacccgtgtttttggttcttatacttgttcccaaagctcagaccctcatctccgtgtgagggatgactgcttttcagcagtatcccatgcttccagtttgtctttaaatgttgctttctttcattcaaaaggcttatagtgtaaagttcagactattcagcatggcattcagggttctccatgagtttggcctcagtttatgactttgtcctggcatgtaacctctgcttgagccagtccagtctcctggctgttctctgagtatcctctctccacataatgaagcttccttctgtgtcctctacatgaaatggcctttcgtacttgacacaaattctatccaatttccaggcccagctcaatttgtgctgctccataactctttcttgacctatccaggccaccaggtcatacccaagtttataaattcctcctggtctgtaccacttactttaactgttaatcctatgatacctcgcattgttaaatatttgagactctaattccattgcccagtgaccatgtctcccatttcttctgtctttcagagtcatccagcacacctattgctacatagtttttattgttaaaatatttaatagctgtaggccgggcgcagtggctcacgcctgtaatcccagcactttgggaggccgaggtgggtgggtcacctgaggtctggagtttgagaccagcctggccaacatggtgaaatcccatctctactaaaaatacaaaaaattagccaggcgcggtggcatgtgcctgtaatcccagctacttgggagattgaggcaggagaattgcttgaacccagggtgggggagattgcagtgagccaagatcatgccattgcacaccagcctgggcaacaagagcaaaactccgtctcaaaaaaaaaaaaaaaaaatatatatatatatatatatatatattatagctgtaacgtattttatcaaataggtaaatggttttgactcttcatgaattattggatgggttgtttccagattttagctagcatggcaaacactgtagataacaaatgcttagatttaatgttagtttagttttgttttgttttccttttgaagcattcccttggcctaataatgatagttttggaataaccttgctgaggattttacgtagggaagatattatgatcttcctttcctattttaagaagctgaggttcagagaggtaggtaaattgcttcagatcacatagcccgtaagcagaggagtcaggtttcaaatctagcctactagatcacaactctggagcacttaacctccgtgccacactggccttggcccaagcaccactccctaccactcactttgttggccttgcctctccaaggaacaggtaggcctccttatgtgtaaggatgaaggagagaccattattccatatgtttctatcctgctagtgtcaactcctgcccggtgtccaaggtgcccatgcagaccagatctgacttgtttctctttactccttaacacccagcacatagcctctctccctagggcatgatttctcttactgtcttccatgtgtaaaagtgaccgtattgtatttctttctgttaagggcaagttcttttttgtgtgttttttttcttttgttttgtttttttgagacagggtcttgttctgtcgcccaggctggagtgcagcactggcacgatcatagctcactgcagcctcaacctcctgggcccaagtaatcctcctacttcagcctcccaagtagctgggactacaggtgcatgcgccaccacacccagctatctgttttttatttttaatagagatggggtctcactatgttgcccaggctggtctcaaactcctggggtcaacaatctgcctgccttggcttctcaaagcgttgggattacaggtgtgagctacagcactcagcaaaggctcaactttcatctagatgccattaggccagaatcaataacctccctcaaattacgtgacacatgattaatatgctatcactccaggactttttgcacataaggctaaatgtaattgcttcatctcttcacaaccatgaaggcaacgtcttcatgaaggcaagttaagagaaagagggtggtcacaagatgatgttttctcctgaaacagtggctactcccactggctgaaaatagaaaggctagagcaagacggccaaacagacccctccagcgattgtctccatgcaggaacaccaaactgaacaactgtccccacaaggaaagcacctttaggccggatgcggtggctcacgtcagtaatcccagaactttgggaggctaaattgggcaaatcacttgaagtcaagagttcaagactggcctggccaacatggagaaaccccatctctactaaaaatacaaaaattagctgggcgtggtggtgggggcctataatcccagctacttgggaggctgaggcagaagaattgcttgaacctgggaagcagaggttgcagtgagacgaaatggtgccactgcgctccagcctgggtgacagagtgagactccttatttaaaaaaaaaaaaaaagcatcttcataagaaacaaaaaatcaggtgagtgatcacagtacctggttttcacatcgtatcaagaagaggcactgaagagggtgggaaagacggtcctgcatcgcctatgcccccctccctcacctctggcacaacagcttggagagagaatctgtgcatgtggtggagcgagaggagtgtgggattttgcattggaactcactgctgccctgtcacagcacagcactacactgagcagaattctgctggcacccacagaggacacatttagatcagctctgggccagaggagaatcctcaggtagagtgggacagacctgagtcccagctggttctgccaccagctgaccaaagtggcctggggccctgaatacatatgagtgacagtcaggtcacaaggactatattccttaggcaaaccctggagatgcactggtcatggaggcagtggactttgggtgtgtgtgaccgcgtgtgacaccaactgtggtgaacaagggagtgcctgcatcattcctcccccaactccagacagggcagctcagggagagactcctacttggggaaaggagagggaagagtactcaagttgcaagacaaagtccagaagactttgagtagcagctcagccacaggaaaataaagcaccaggcagaatcctgaggctcctgattccaggcctttgctcctaagctacatttccagacctaccctgcgccagaagggaatccactgctctgatgggtcagatttatcctggcaggattccccacctgctgactaaagtgcccttgggctttgagtaaatatcagtggtagctaagcagttctggccacaggccttgggcaggatccaatactgtactggtctgcaaagcttcaggtgtgacccagtgcactgccatctgtggtggccatgggagtgctcatgtcacccttccccccaactccagacagcccagtggggagagagattcctgactgggggaaagagaagagacaaagtgagagatgttgcctgggtaaccggggaattttcccttatcttacccaaggccaccaaagatacaggagtatccaggagttggcaacagttgcaggggtcataggcttagggcaccccctggtatacatcagctgcagagaccgtaggcttaagtcacagcacttaatcccctttgaatatatagaaagccttctcaaggaggatgggtacaaataagtccagactgtaaagacttggaataaatacctaactcttcaatgtccagacattgatgaccatccacaagcatcaagaacatccaggaaaacattatttcaccaaatggactaaataaggcaccagtgaccaatccaggagtgacagagatatgtgacctttccagacagggaattcaaaatagtagtcttgaagaagctcaaacttcgagataacaccgagaagaaattcagaattctatcagaaatttcaaaaagagattgaaataacaaaaatcaagcagaaaggctgctctgcctatggagtagccattcttttgtttctttacttctctaataaacttgctttcacttcgcaaaagaaaaaaaatcaagcatcacttctagagctgaaaaattaagttgactaaaaaatgcattggagtctctcaacagcagaattggtcaagcagaagaaagaattggtgagcttgaagacaggttatatgaaaatacacagtcagggccaggcaggatggctcatgcctgtaatcctagcactttgggaggccaaggcaggtggatcacctgagatcaggggttcgagaccagcccggccaacatggcgaaaccccatctctactacaaatacaaaaaattagccagtcatggtggcaggtgcctgtaatcccagctacttgggaggctgaggcaggagagttccttgaacctgacaggcagaggttgccaccgtactccagcctgggtaacaggggcaaaactccatctcaaaaaaaaaaaaaaaaaaaaaaaaggagtgatttaggatgtccccagataaatgccctttagcctgtgacgtaaagaatctttagttacaatgcaaacatcccagaaagaataccatattaccattatcaattattagaaattcttaaggaggctatgcgcggtggctcatgcctgtaatcccaacactttgggaggctgaggtgggcagatcacctgaggtcaggagtttgaaatcagtctggccaacatggcgaagccccatctctactaaaaatacaaaaaattagcgggtgtggtggtgggcatccgtaatcccagctactcaggaggctgaggcagaatcgcttgaagctgggaggcggaggttgcagtgagccaagatcgcgccactggactccagcctggacgacaagagcgaaacttcatctcaaaaaaaaaaaaaaaaaaaaaacttaaggaatagttattatctgatatgatggcttattaagaaggaagggaacacatgataggtctgttttgaaaaggaatggggacagaacaaaatattactaggtctgatcaaaagaggcttgttctggcttgtctttgtctgccttggagtcacgggacaggtgtaaggccaaattgtgcacttcccagtcatgttaccttgggcaaataatttaaaatctgtagtttcccaatctgaaaattgagtctgatacctgttctaatttagtgttgattgatatgaagctcaaaatcagaaacatgtatgaaagttctttgcaaactaaaatatatgtgtgaggaattgttattattagtttagaggatggactgttgtccttagaaggcaagtctctgggtcctacagttagatgcactgagcgcttcgggaagaatttagggctatggggtactcagcaattaaaagagagggtgcttagagaaggaagaaaggacttattaatggagtttggaggctccttattattgaaacttacacattacgtgaccagcattatgaggcagcacccacttccaacaaatagccctctagaaccaaaagcagagtggcaggtcctgggtccttttgtacacagcataaaaaattaagtcaatcggccaggcgtggtggatcatgcgtgtaatcccagcactttgggaggctgaggcgtgtggatcatctgaggttaggagttcaagaccagcttgaccaacatggtgaaactccgtctctactaaaaatacaaaaaattagccaggcgcagtggtacatgtctgtaatcccagctacttgggaggctaagacaggagaattgcttgaacccaggagtcggaggttgcagtgagccaagctcgtgccactgcactccagcctgggcaacagagtgagactctgtctcaaaaaaaaaaaaaaaaaaaaaaattaagtcaatcctggcataactgcagaccaggccctggaatgagcaacccaccagcattatctgcatttctaggaacttgggctagaaggggaggaatggggttggaagggttaggctacatgcctctagttaaaacctgatgaacttcctagatccccaactagaaaatgtaggagttggactaaattcctctcctgcctctaatattttatgaatacagaactcaactcaaaatgggtagtatctcagagattccaaatttagttctacttttctgtttgcttatcagtcgcttaccctcaccctctggtctgatacctttatcctgtacaagtggtcaaagtaggttgagtaacgtgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaactttttttgtagagacagggtcttactatgttgtccaggctggtttcaaactcctggaatcaagcgatcttcctgccttggcctccagaaatgctgggactgcgcctggaatagatacgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaatttctcaccatgcactcacacagctatacagctgtctccagagattactctggaaactctgctataaagatgacctggtctaatgccttgatttgttttttgtttgtttgtttttttgagacagggtctcactctcctggagtacagtggcgtgatcatggctcactgcagccttgacctcctgggctcaagcaatcctcccacatagctgggagcataggcacatagcacaccactctcggttaaatttttttttttttttttttttttttgtagagatagagtctcaccatgttgttcaggctggtcttgaactcctggactcaaacgatcctcccaccttggcctcccaaaatgctaggaatacaggcatgagccactgcaccaggcctaatgtcctgattttataaatcccaaaactggggcccagagaggagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctacaaggcagtcctcagagagaagcaaggttctgcatcttaaaccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctgtgagaaattgcatcttatttattgattatttattgaatggtagtttcatggagtttttcgtctttttttttttttttgcgagggagtctcactctgtcgcccaggctggagtgcagtggtgtgatcttggctcactgcaacctctgcctcccaggttcaagcaattctcctgtctcagcctcccattacaggccacaccaccacgccccactaattgttgtacttttagtagagatggggtttcaccatattggccaggctgttctcgaactcctgacctcaagtgatgcacctgccttggcctcccaaagtgctgggatttgcaactgtgagccaccacacccagcctcttggtcattctttgaaaaataaacctcagccaggcgcaatggctgacacctgtaatcccagcaacttgggaggctgaggtggcggatcacctgaggtcaggagttcgagaccagcctgaccaacatggtgaaaccccatctctactaaaaatagaaaatttaaaaagaaaatcagctgggcctggtggcgcatgcctgtaatcccagctacttgggaggctgaggcaggagaatcgcctggacccaggaagcagaggttgcagtgagccaagatcaggccattgcactccagcctgggcagcaagagtgaagtgcagtctcaaaaaataaaaataaaaaaaccctctagatgtatgcggctccatattctcccaccacaagggtttataaatcctgagaaagaggcaaagcagggaacacatgaccacatagctctggcaggcgtcagattaccaggctgataaaacagatggtaaagtagaagctgtccgttgacttttccattcccctttcagctcctccactgctacttaatctcctttgcccacacagttcaatcctattttccctgatctccaaatcctggctagattattagccattaacactagcttttacaaggagactcttcaatcttgtatttctagtagtataatttcacacgtacagaaattctttaagtcatagaagtcttacagatacagaaattctgatcttcaggagtcctgttgtgaaacaaactaatttatcctgacagcaggaaagatttctgggcctaaggctctgtctcgttgacccagctcatgctattcaggtggtccatctcttggttccaggcaagactgctgctgctgaccaacctgaatatggactttagcacttgggctcaagctgcactcagatggttggaccaccataaaagagcgagagggtacgtttttggtatgaaaagtaaagactaggccgggtgcagtggctcacgctcataatcctagcactttgggaggccaaggtgggcagatcacaaggtcaggagattgaaaccatcctagctaacacagtaaaaccccatctctactaaaacatacaaaaaaattagccgggtgtggtggtgggcacctgtagtcccagctacttggaggctgaggcaggagaatggcgtgaacccaggtggtggagctttcagtgagccaagattgggccactgcactccagcctgggtgacagagcaagactccatctcaaaaaaataaataaataaataaaaagaaaagaaaagtaaagactaaaaaaattaaatattataaccctgctaaggcaggaggatcctttgagcccaggagtttgaggctgcagtgagctatgatggcactactgcaacccagcctcagtgacagagggagaccctgtttctaataaaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggccaggcgtggtggctcaggcctgtaatcccagcactttgggaggccgaggagggtagatcacctgaggtcagaagttcaagaccagcctggtcaacatggtggaaccccatctctactaaaaatacaaaaattagctgggtgtcctggtacgcgcctgtagtcccagctacctgggaggctgaggcaggagaatcacttgatcccaggagacggaggtttcagtgagctgagaccgcgccactgcactccagcctggggggacagagcaagactccaaaagttctggaaatggataatggtgatagttgtacaacaatgtaatgtacttaatgtcactgacttgtacacttaaaaatggttaaaatgggcttgttccagcagctcatgcgtgtaattctagcgctttgagaggccaaggcaggatgatcacttgaggccagagttcgagaccagtctgggcaacatagcaagaccctgtctctaaaaaaaaaaaaaaaaaaaaaaggttaaaatgaggccatgcatgcctacaatcccagcactttgggaagatgaggtggtagggtcacttgtttgggaagaggaggtgggaggatcctttgaacccaggagttcaaggctgcaatgaaccatcatggtgccattgcactccagcctgggtgacagagcaagacctagtctctaaaaaataagagttaaggccagacacggtggctcatgcctctagtcccagcactttgggaggctgaagcaggcagattacaaggtcaggagtttgagaccagcctggccaacatggtgaaacctcgtctttactaaaaatacaaaaatcagctggccgtggtggcatgtgactgtaatcccagctactcaagaggctgaggcaggtgaatcactggaacccgggagccagaagttgcagtgagccgagatcagaccactgcactccagcctgggcgacagagcaagactctgtcttgaaaaaaaaaaaagaattaaaaaaagaaacatggccgagtgtagtggctcttgcctataatcccaacactcagggaggccaaggtgggaggattgcttaagcccaggagttcgagaccaggcaacatagggagaccccatctgtacaaataatctaaaaagttagccaggtgtggtggtgcatgcctgtggtcccaggtgctcgggaggctgaggtgggagaactgtctaagcctgggaggttgaggctgcagtgagctatgatcgcaccactgcactccagcctgggtaacacagtgagacaccccgtcttaaaaaacaaacaagcaaataaacaaatactatgcataaaacctcaaggctcaagaaacaacagtttgaaatagttagatgtgtgttttttttaattttcatgtcttatcttttctgcttttttttttttttttaagggatgaggtcttgctctgttgcccaagctggtatcgaattcctcctgggctcaagcaatctcctgcctaggcctcccccctaacagctggaactacaggcatctaccactgcattcagcta

SEQ ID NO: 110 - DNA, 20277 bp, Homo sapiens
ttctacttggtaattctttctgcttccacactctttcaagatatgggtcagagaaaccctggtgaggacggggtaggggattggatctctggctctgttttgggcattgtgtgattttcgaggtctgtgggtgaagctcacacagtacctttaccttggccagctctgggctttgcagatgccagtcccgaatgcctgcttcctctcccaactctgtcctctgcttagagacaaaagaagccttacagacagctgaatgggtccatgacagctacgcctgttcttgggaagtaattttgatcagagctcaggcctttggaaatgtctaaagaagtagtaatcaccattattatcattttaaagctagtaactaagaaaactatagatagattatagataatggtagagataatttataatctatagactgtaggtagataggtagatgattgaaagattgatagatataaataagtagatacatagaggacatatatatgataggtagatggtaggtatagatagatggatggctaatagaaagatgataggtagagagatgatggagatagatggatgatagatgatagatatatagatgatagataaatagatatagatgatatatgataaatagatgatagagatacatggattagatagctagatagataatagagatacatgatagtaagatagataataaataatagatgtgaagaggattggtagatgataggtggatagatggatggatagatgataggtagatggatagatagatgatggatggatggatagatagatatatgatagatagatgaatagatgatatagatagatagatagaaggatggatagatagatgataaagatagatcgattatagtaagatagataatagatgtacagagaattggtagatgatggatggatggatgaatagatggatagatagatgatagatggatggatgtatagatgatagatagggatagatagacaatggatggatggatatatgacagatagatggatagatggatggatggatagatagagatagatgatagtaagatagataataaataatagatgtgcagagaattggtagatcataggtagatggatggatgaatggatggatagatagatgatagataggtagatggataatatagatattatccaatgatagatagatgatggatggatggatagatagatgatagataaatagatgaatggatggatggacggatggatggatggatggatgatgggtagatggatagatatggactgatgaaaggtatcttttgttctacagaattaagttgtaaagtttgctgtctgtaattctcactcccaatggagatgtcaggaattctcgttctttcttcgttcaagggtggggaggaggagtctacaggagcagctgtaacaggcacattttggaatttaccccattggaatgtaaaggtcaaggaggcagccctgtaccacacgtctgggacgcttgtgtttgttatatttagtgcgaattgtgggttggctttgcttggagtgctgcttccgggaaaggcgctgtggtcgcctacatgctgagcattttaatttccatagacagtacactgggctgcacactgcatgggacttctcggcattgctggctgccctcctgactgttgtctttctcctggcaacaggggcttgggtgcccaagaatcaagtggtttaaaagtcattaccaaagttcacatcagtcttgtgcacagagaattaaaactgctgtaaattatatctgctgtgagagctccttcctctcatactgaggcattaggaaattgaatccattctacctaatgaaacaatgtacttttccttatgttgtctctaccgcctcatacatccctgagttgaacttgaagtctttgtaagaaatggtctgtccagaatttaaataacatgtttggctgcttctttatggagcacgattcttttctttcctttctttcttttttcttttttctttttttcagagacagggactcactctgttgcccaggctggagttcagtagtgtgatcatggctctttgcagccttgacctcctgtgctcaagcgatccgcctgcctcagcctctcaagtagctaggactacgggcatgcaccacctcgcctggctaatttttttttttttccagtacagatgaggtcttgctgtgtttcccaggctggtttcaaactcctgggctcaaatgatcccccttcttcgaccctagcactgggattacaggcatgagccactgcacctagcccaaagcacagttcttttgagtgagttgggttacatctttgctgtaactcaggtcatcaagccatcacttccactttttgccttttgttttcacctaagatctaaacactttgggtgagttttcaagagtcaaacacaacataaaataagggatagtagctatgagtttccatggcattgcagcatcaggaaatgggcatagcagttgggttgactttgtcccttgtttaaggttccttcatactcctcctgtgttttgttttgtttagaatgaaaggaagcatgtatgcgaattagaatactgaatattcactgcaagtcgtgattttttttttttttttgagacagggtctcactctgtcatccaggctggagtacagtggtgcaatcacggctcactgcagcctcaaactcccaggctcaagtatcctcccacctcagcctctccgagtagctgtaactgcaggcctgccaccacgcccagctaatttttgtatttttcgtagagacagagtttcaccatggtgcccaggctggtctcgaactcctgaggtcaagcaattcacccacctcagcctcccaaagtgctggaatgacaggtgtgaaccatcacgtctggcccaagccatgaatcttgggagaggagaggaggtgactatggccccgtcacccctgctgtccctcaggagtgtaactctggtgtttctgttgattttcacagtgactgatcaggcttttgtcacactagccaccaatgacatctactgccagggcgccctggtcctggggcagtcactgaggagacacaggctgacgaggaagctggtggtgttgatcactcctcaggtgtccagcctgctcaggtaaggctcagagatgcggcttgtgcccagctgggtcctatagaaggagggtcacctctcccctaagaggtcctaggagttattctgacgactgactgcccttcttcataggcctggatggccggcagtcatgatgggcatctgacgtttgtaaggaaccttcgaatcatgtgaaaatataggcgtgtgatcggcttcacaatactttaaaaaacaatactgggtttggttacagttcattctcccaaccatggaaactgaaaattcaattcttttttgtttgtttgttttttgagacagggtctcgctctgtcgcccaggctggagtacagtggtaccatcttggctcaccgcaacctctccctcccaggctcaagcgatcttccctcctcagccttctaagtagctgggaccacaagtatgtgcccccatgctcggctatttttatttttatgttttgtatttttggtagagacagggtttcgccacgttgcctaggctgatcttgaactcctggactcactcagtccacccaggttggcctcccaaagtgctgggattacaggcatgaaccatggcacccagccaaggagtcttttcttataatttccttttataattctctttgtctttaattctcaaataaagcaaatacataaataaatgcgtctaatgaataaagcataaggcttctcttaaatgtcatacattatgtaagcaataatctttttctttcatcaaccatggaccacttaaaaaaattgattttatacgaatgggacgaggaggcatttaatatggtagatgtagcaggaattgaatgtcatattctttgacaatgaaataataaatccagacattaatagctaaactaaaaagagaacaaataaaaaaccaaccagtgtgtcctcagacgtttgaaactggaagttttaaatgaaataactcaatccgggtacaaatgaaagcttgaattatgtactatttcagaaaatcactgcaatgtgagtgctacctatacaaagcaaagacagcaactacagtggtacaagacagaaaatttaaatcagtgaagaaattatccagttcaaatatatatgtatatacacacacgtatgcatatatatgtgtatatgcacgcgtgtgcgtatatatgtgtatacgcacacgcatgcgtatatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgtatgtgtatatgtacacgtatgcatatatatatacatgtatgtgtatatatttatatatacgtatgtgtatatgtacatgtatgtgtatatatttatatgtacaggtatgcgtatatacacatgtatgtgtttatatttatatacatgtatgtatacctgtatgtatatatgttcaactatatatttttatatacatgtatgtatatatttatatatacatgtattatatatgttcaaatatatttatatacacatgtgtatgtatatttatatacacatgtgtatgtatatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatacacatgtgtatatatacacatgtgtatgtacatatatttatatacgcatgtgtatttacatacatttatatacgcatgtgtatgtacatacatttatatatgcatgtgtatgtacatacatttatttatgcatgtgtatgtacatatatttatgcatgtgtacgtatatttatttatgcatgtgtatgtatatatatgcatgtgtatgtatatatatacatgtgtatgtgtatatatatgttcaaatgtatatgtatatacatataaaatatatatatttgaactggatttcactgatttaaatttaaaatatatatacacacatatttgaactggataatttcaaatatatatatttcatatatatatttgacttggataatttcttcactgatttaaatttaaaaaaatatatacatatatgtatatatatacatatatatacacacacacatatatatacacatatatatatatatatatatttttttttttttttttttttttttttttgagacagagtctcactctgtcgtccaagctggagtgccatggcgcgatcttggctcagtgcaacctccatctcctgggttccagtgattctcctgcctcagccttccaagtagctgggattacaggcatccaacatcacgcccggctaatttttgtatttttagtaaagacaaggtttcaccactttgcccaggctggtctcgaacgcctgacctcaagtgatctgcccgcctccgcctcccaaagtgccaaagtgctgggattacaggtgtgactcaccgtgcccagccccaaatatttttaaaataataatattaaaaaagcaaacagcagtaaaaaattcataaagataaaatgacaaaactaataattgggaacaagaaacaaattcaaggattaggttaacaaatcttcagggaggccaaggtgggaggattgcatgaggccaggagtttgacaagacaggctgggtgacatagcaagaccctatctctacaaaaaataaaaagagttagccaggtgtggtggtgcgcacctatagtcccagctagtcaggaggctgagatgggaggattgtttgagcccagaggttcgaggctgtagtgagttatgatcacaccactgcactccagactgggcaacagagtgagctcctctctctaaaaataaaaataacaaataaaaatgaatcttttattcgagaaaacataaatgtacaaaattgaaattagaaagaagtcatttggaggcagttttaaaagcaaatagtatatagaaccctttacagtagtgacactgggagtattgaagaagtgcttgatccttctagggaaatcggtgagatgttggttgttgtcatcagaagaaatagaaaccttttgtttgacaataactatgagaaaaactgaaaatgttaccaaaggcttatcttgtagaaaggccctggtttgggcaattttaagggaagttctgttaaattgctcatgatgaattaatttccctgctgcataaactgtcacagagcctagcaaaagatgaatatgttcacttattttaagaaactgttataatcttgacacccaaacttgatttacaggtttgattgtgtttacatttggattgagaaagccctcaaatacaggatgttaataaggcaactctagccctgtagtaaagaaataaatagtgcttacactaagaaagcaaagataggttattattttaaaacctattaatatcattcaacacattaatatgttagagaaagtcaatgataagatccttttaaaataaaaactaaacatataacaaaaagaattccaggccggccacggtggctcatgcctgtaatcccaacactttgggaggctgaagcaggtggatcacttgaggtcaggagttcgagaccagcctggccaacatggtgaaccctgtctctactaaaagtacaaaaaaaaaaaaaaaaaaaaattagctgggtgtggtggcaggcacctgtaatcccagctactcggtgaggctgaggcaggagaatcacttgagctcgggaggttaaggttgcaatgagccgagatggcaccactgtgctccagcctgggtgacagagcaggactctgtcaaaataaataaataaataaataaataaataaataaataaataaataaaaatccacatagattataaatatagaggtaaacatttaaaacatagagaaatcttagaagaaagtagatgaaagtttctcagcactgctgctatctgggactggagggttccatgtggtggggtgtcctgtgtactgcagggtgttgagcagcgtccctgggctccgcccaccagatgccggcaggagttggcagttgtgacaactaaaaatatctccacatgttgatgaaggtggatgttttgttcatctgaaagctggaaatgctggtgtaaattaaacaagatggaagaggacaccagaactgctgtgtgtcagagatattatgtgttaaagataaaacaaactgagggccacatttaaaatattataatggagaggttcttattgtccatcacgtacaaagaactctgaaaacactttaggggtttgcacgggctcgtctctagcacgccagaagcaaagatagacagacaaatacaaaaataggtattaaacacgagcaactggctgggtgtggtacctcacgcctgtaatcccagcactttgggagactgaggtggacggatcacttgaggtcaggagttcgagaccagcctgaccaacatggtgaaaccccgtctttactaaaaatacaaaaaacattaaccaggcgtggtggcgcctgtaattccagctactcgggaggctgaggcaggagaatcgcttgaacctgggaggcagaggttgcagtgagcccagatcgcgccacctgcactccagcctggtgacagagcgagactctgtcaaaaaagaagggaaaaaaaaaaaacctgactatattaaggtccaaaaatgcaccagtgagtggaaaggtacacatagcacatccagcaggttccgtgttttattttaaaagccggcgggggcgacggggtagaaaaatgctgttaaagagtgtaattgagttgcttgtaacacaaaggataaatgcttgaggggatggatactgcattttccatcatgtgattattacttattcctgcctgtgtcaaagtagacttaaggttcactcaagaggaactttaaaatattcagaaacaacatggcagaaatcgtgggaaggttcagtgttgcaagtcgggttgaggttttgtgggaccttttattatatgtttcgtagtcatggggagaattgagggatggcgctctgcggtggtcagggcagtggaagacgagcagtgagcaatgaccgtaaatgaccaggggtgtgggtggtgggagatcgcccctcccccaggctgtgtggtacaagcgtgttatggagtgatcttgcagggaaacctgctttaaactaattgtattcatgaaacataattctgcttccaggagtttattttagggaaatgagcagagctgaacaaaaagatgtaaggacataaatggcagtgccatttgtagtgaggtggagtgctgtttctcttgccctccccccagcccggatctttacgcaactgtggtgaagatgccataaattccataaataactgggccaaaagcagagggagatttgctgaaggaagggtactttttcagagaaatagttaccttaaatacagagcagtgaaatcttacaaataaatgtcgagtccaagagaaatgctaagagatagaaaaggtccgagagcttcaatatctgtcaaataggagagaaagaaaaagaaagaaagaaagaagtaactcctattatatttcagctctgagacaaagtttagattgaaagtgttccagatattgagcagagtggatgaagaaagctcaaatgtagacaccaagtggtaaaatttcagagcagcaaaaatgaagaaaaatcctaaatgcctttctgtatcaatctggttgtgacaattgatgtctcaaaattctggtgcaagataactttgaaatgaaagttctgtattcagctttagtaccgtaatttgaaagcaaaacaaagacttttcaaatttgcaaacgttaaaaatgttatccctcaaagatctttgaggaaaaagttagttgattgactcctgcaaaatggaatgtaatccaagaaaggcgagagtagccaagcacagtggctcatgcctgtaaccacagcattttgggaggctgaagtgggaggatcgcttgagttcaggagttcaagaccagcctggacaacatagtggggtctcatctctactaaaaaatttttaaaaattgctgagtgcagtggcacatgcctgtagtcccagttactcaggaggctgaggcgggaggatcactggagcctaggacattgaagctgcagtgagctatgattacaccactgcactccagcctgggtgacagagcaagaccctgtctcaaaataataataataatgataatgataatgataataataaatagaagagagcacacaggaagcagtgctgaataaataaatgtataaaacagagttaagtctgaatgtgttagtgcacagttacgaaaataatctggaattaacatttcacatgggaggtaattgaaagagcagagaagaaagaatgagcatatgttcatgtttttgtttcgtctgggaagaagacataggtaatgactatatttgatagaaaatataagcttaaatacgtgtgctgacagttgaaaggtggttaccaccagaaaactagaaaagatgtgtacaagtttcagagccttaatgggaaatgcgtggattgaagaaaacctgattcatgcaatcagaggtgggtgggaaagaattacactgatgtcaggcctctgagcccaagctaagccgtcatatcccctgtgacctgcatgtacacatccagatggccggttcctgccttaactgatgacattccaccacaaaagaagtgaaaatggcctgttcctgccttaactaatgacattatcttgtgaaattccttctcctggctcatcctggctcaaaagctcccctactgagcacctttcgacccccactcctgcccaccagagaacaacccccctttgactgtaattttccttgacctacccaaatcttataaaacggccccacccctatctcccttcgctgactctcttttcggactcagcccacctgcacctaggtgaaataaacagccttgttgctcacacaaagcctgtttggtggtctcttcacacggacgggagtgaaaactgaagaaatagaaaatctgatatatgtaaaaaagggaaaataatataaaatgaaactgcaggactcaatccaaatataaccgtgatcataataaacatgaatagattaaaattcctttttaaaaagataggctttctgaatgggaaaataaacataaaatccggacatacagtagtgtaggaggcagcttaattaaaaacaaacaaaatgttgaaaataaatggatgcatttgatatgattctgttccactatccaatctaagtaatggtcaattgttttatagattgttcttcagttgtttgttgttgttgttgttgttttgagacagagcctcgctctgtcgcccaggccggagtgcagtggcacgatctcagctcattgcaacctctgcctcccaggttcaagcaattctcatgcctcagcctccagagtagctgggattagtttcccgccaccgcacccggctagtttttgtatttttagtagagacggggtttcaccttgttggccaggctggtctcgaactcctgatgtcaggtgatccacctgcctaggcctcccaaggtgctggaattacaggcatgagcccctgtgcccagccttcagtttggttttgtccagtgttttctcatgattagactgaggttatgcatttttggcaaaaaaatcatcagaattgatgtaagttttcagtgtgtcatgctatggagtgcatgatgtctgtatgtcctgacctggtgatgttaaatttcatcacctggattaagtggtgtctgttggaattctccactgtgaaattattatgtttttcttttagtaatggaaaatatcttggcatagacattatacaaacagcctgtttcttctctaaaaatcagtgagtcttgtctgcaacagttgttactatagtgtttgcctaatcgtggttttctacttccctcattccttctatttcaattacttggaattatcttctaaattaaacctgccctttctttctcacatatttgtttattcaatagttatattaggtcaggcgtggtggctcatgcctgtaatcccagcactttgtgagactgaggcaggcagattgcttgagcccagaagtttgagacaagcttcataaacattgtgaaaccccatttctaccaaaaaatacaaaaaattagccgggcatggtggcatgcacttgtagtcccagttacttgggaggctgaggcaggcggaccacttgagcccaggagttcgaggctgcaatgagctatgattgcaccactgaactctagcctgggtgacagagtgagaccctgtatcaaaaagaaaacttatattagtgtaggctcatgaatatttatttcatattttgggcttgttgttttttgttattgattacattatttcagctttggcaattgggtgcttcccctagctggccccctgtattctttcaatatgcccccatccttttctagcacttgcttaatttttctgtcatcccaatatgttccagactatgatgaagtgggatttaagcaaaaataaataaataaatggaacagagcaaatttcactttgataaaatggacagtctttcaagcttcgagtctcaaacttgtatgcaactaacaatgtaagctttgaatacagaaagtaaaaattgatagagattgttatggacatctgttagtttctaccagctcagcatttacatttctctgcctctgcagcttacagagggaaactgtcttcctaagagctggcccaagtgcatgcatcttaagacagttctgttcaatttgtcacatttttcaagtatgcatgcatttctttttcataatattaatatttattactatatatgaatactagattgaaagcccaagcattcagtttacacacagaaattatgcaattatatatcgcttcacaaaggcagtgaacacattacattctacaaaatctacttcacagaaatttaaaaattctaaatatcaaaaggtacagctgaagaaacaggtataaatttggcagccagtaattttgacagggaagttgcagcttgcatgactttatttttttgtttgttttttgagacagagtcccactctgtcgcccaggctggagggcagtggtgccatctcggctcactgcaacctctgcctcctgggttcaagtgattctcctgcctcagcctcttgagtagcaggaattacaggcgcccaccagcacgcctggctaatttaaattttttgtttgtttgtttttgtttttttgcttgtttgttttgagatagagtctcgctctgttgcccaggttggagtgcagtggtgcgatctcaggtcagtgcaatctccgcctcccgggttcaagcgattctcctgcttcggcctcctgagtagctgggactacaggcgccaccacacctggctaatttttgtatttttagtagagaaggggtttcaccatgctggccaggctgatcttgaactcctgacctcaagtgatccggctgcctcggcctcccaaagtgctgggattgcaggcataagccaccgcgccaggccttgcatgactttaaatatatgaatatgaaaatattgaacttagagtaatcattgtgctttgtgttgattgaaaaatataacaatggctatcaaagaagcatgttcaaagatgcttaattcacttcaaaatgtcatacaaattgtggtggtttctatgcacctctaaagcttccgtcatttagctcaggtacattactaaagtaatatattaattctaccggtacagtggggtttcacaccattggcatttgcattcaagcatgcagaggcttttgggcacaagtggacggtgtgcacagctctaagccatccgtggaaatgtgctctgaacatggagaccgcagtgagggctgtggggattctctttgcattccacgtttgtgagcagcaaaacagcaccctcttgaaggaggaggtggttctgtgctgaatattcacccgctgtcccactatttggcacatgtctgttccagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgagtgaagactctctgcttgataggaaaccctccaagaccacatctctatccttaagcaggctgtcaacttttttttgtgtgtgtgtgacacagtcgctctgtcacccaagctggagtgcaatggcacgatctcggctcactgcaacctccgcctcctgagttcaagtgattctcccacctcagcctcccgagtggctgctattacaggcacccgccttcatgcccggttaatttttgtatttctgtacagactgggtttcgccatgctggccgggctgtcacctcttactggtagattcctgtgaggccatgtgcatttctatttctaacacagatgttcagtctattataatcaggcataacatacccccgagcactgtgctagaccctgctgaagagaacaggggattggaagacatgttcctaccccaggaatgaattataaccacagtattttacacgcacaaaatagaatcatgagggaaaaaacttgtgactgggcacagtggctcatgcctgtaatctcagcactttgggagcttgagatgggtggatcacttgaggccaggagtttgagaccagcctggccaacacggtgaaaccgtttttactaaaaatacaaaaattagccaggcatggtaacaggtgcctgtaatcccagctactcaagaggctgaggtggggggatcgcttgaacccgggaggcggaggccgcagtgagccgagactgaagcactgcactccagcctgggcgacagagcaagactctgtctcaaaaacagaagcattggtaaaagaagcattgcggcgggttctgcgtgttttgcttcaccaggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggtaagtcagggcagcccggacgcttagggtctctgttgcacacactcaactctgcagatgtaacacgaagtcagccgttgaccatacagtcacacctcgctcagcgacagggatgcggtctgagaaatgtgttgttaagtgattttgtcattgtatgaacgtcccagagtgtatctgcacacacctggatgatgtagcctactgtatacctaggctggagggtacagcctattccttctaggctacaaacccatatagcatgggagtgcactgaatgttgtaggcaactgtaacataatgggaggtatctgtgttctaaacatacctaaacatcacaaaggtccagtgaaaatacagtataaaatcttatgggaccaccgtcagatgtatggtctgtctttgaccgaagcacttttatgtgttgcatgactgtacttggcattgaacatgggctggccgtggtggctcatgcctgtaatcccagcactttgggaggccagggcggacagattgcttgaggcgaggagttcaagaccggggtgggcagatggcttgagaccaggagttcaagaccagcctaggcaacgtggcaagaccccatctctacaaaaaatacaaaaataagctggatgtgatgctggcacctgtagtccccaagccctgggaggctgagttgggagcagcagctgagctcaggagctcaagcctacagtgagctatgattgcaccactgcactccagtcaggttgacagagtgagaccctgtctcagagaaaaagaaaagagcatggctgtgttccaataaaactttatttataaaaacatgcacagtgtgtagttgcttgacccatggtagaatatagggagaattaaaaggaggcaacctgaagccgagtatttgttgaaatgggcgtcagtagagaggaaatgtgctggaatttttgtaaagtaaaagaaaatactggagcagtgaagaattgcctctaggtaaaggggaagttaatgaaactggcaaaaatgatgggaaaagcattgtcactaccagggagaattcattaggggaccagtggaatgctttggactccatatgcaattttagcattcattctggggactcctggtggagaattttggagggaatatgcacttatttttatcaatggcttgggttatcagtcttttctgagaaccaagagaatgtgtgcagctggcagacagaagaaatggaattagtaaccctgaaggcaagtgtttatgttgagagcttcaggcacatctcgcattcttggagtgaaccaagccatactttgctaacctgcttttgtgtttgctcattatgtaggggcagaccaaggcttactgaatagtttcttcaggaactggtcgaccacagacatccacaagcacctgccgttcatctataacttgagtagtaacacgatgtacacttacagccctgccttcaagcagtaagttctccaccctggcgaatcctgccagatctgccactaccgatccaccttccctcctggaagacataccagctgtcggcatatttaaaaactctatctatctatctatcatctatctatctatgtatctatctatctatctatctatctatctatctatcatctatctatcatctatctatctatcacctctatctaggtagatctaaatatctatttatctgtatagatagatacctatgtctatgtgtctgtgtatctagatctctatgtctatctatatagatatatatctgtctatatagttatctacctatataggcctagacatctgtttatctatctatctatctatctatctatctatctatctatctatctatccatatctatctatttagatctggatatctatctgtatacatagatctatatatctatatctatatatgtatctatatctagatctagatatctatatacattgatctatctaatctctatatctatgtagatatttatctatctatctagacctagatgtctatctatctagacctagatatctatctatctagacctagatatctgtctatctgtctaatctatcatctatcatatgtatctattcagatagatctggatatctatctataaacatcttatctatctatctatctagatctacatcactatatagatacctatatctatctatctagaactagatatctatgtatctagatatccatctagatttagatcttcatccatatagatatctatatctatctatctagatccagatatctatctatatacatagatctatatatctatatctgtatatctatctagatctatctagatatctatgtatatacatggatctatatatctctctatgtatctagatctagatctctctctatatagatctatgtatctagatctagatctctatataggcatctatccatctatgtagatctagacatctatctatatattaatacatagatgtatctatctatatacgtctttatatatgtatatacacacacagaaacacacacacacatctcgtttcctgcttgcttgttgctgtaaatgatagctagccaaggctctacgacaatgatccccaaagtgtggcccaaggaaccctgaccccacaactctttcaagtgtcttcaaagtcataactactttaaaaaaagaatttgaagatgtgatttttttccctttttgctgccattttctcatgcatctatgctgagagtttacagacactacatggcatgtgataaggtaataccctgaacacagatggagctaggaagaaccagctgtcgcctcttgggaaaatggatggcactcttctcacaatgattttttttaatatagaaatttttttaatgaaaaattatgaaatttatgttactgcataatggtttgattttttttaaagggattgataaatatgctttctaatttctcagttttaatatcgattattctaaatatggagagagagaatccacagggacatggccgagcacagtggctcacgcctgtcattccagccctttgggggccgaggtgggcggatcacttgagctcaggagtttgagaccagcctgcgcaacatgatgaaaccctgtctctacgaaaaaataaaacaaaacattagccgaatgtggtgtcgcacaccgctagtctcagctactcgggaggctgcggagggaggctcacttgaacctgggaagtggagtttgcagtgagccgagatcgtgccactgcactccagcctgggtaacagagcaagcctcagctcaggagaaaaaaaaaagaaagaatccacacggacaaagctctttgggttcctaaaagggtcaagggtgaggggaccagaggctgtgaaattcactgctccagaagatatggctataaatgaaaatagagaatctgagaatcaccttgggaatgaataattctagagtctgcattctctacagaggacacggtgtccctaaggaagagaaattgattcttgggagtgaaatcttgttattttttactgtataatcacagatgtaatgtacagaacatagatatgtcatgtgacttttgtgttcatatttcatgaggaggtgatccacgaaaaaaaagtttaaaaaggctcctggaggatggtgatgatgaacaacaaaaaagttggcaaggggaacatttagaatcctgtaaaagagaaaaaaagccaattgccttgccgcttgcattagccactgtaaaagctatttttttttgcccctgtcgttttaaggatatgatgatttgggctgctgtacttcacgtttttacaaaactgatttatttttcccgttttgggaaaaaatgtcaatggattacgattatgttttttgatatatagaaaataaaataactgcaaaaactgtgatttaaaaaatatatctttatgcaaaataactgcaaatgaaactactactactatgctgatagcagtggagtagtattattgatgatatattgattactatcttgatagtagtggtatgctagtattgctcagatattgattactgcattgatagtactagtatattattattgattatatattgattactatagtagtgatagtattttgttattattgatcacacattgattactgaattgatagtagtagtatgttactattggttatatattgattactatgctagtagtagtatattgttgactatatattgattactacattgatagtggtagattattattgattatatattgagtactatgttgataatagtagcatagtattgattacataacgattactacattgatagtaatatattgttattgatcatatattgattacatgcattgatagtagtagtgtattattattgattatatattgatgactatgttgatagtagtaatcttattatgggtcatatattgattactgcattggaagtagtagtgtattattattgattatatattggttactatgctgatagtagtagtatcatcagtaataataatcaataatggaaacccattgggacaagtccttcagaggctgtctttgaggagccccatggtaggtggatgctttctgggtgtcttttatcacatctgagtggaaatcagaatcccttctgtttccttctcagattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacagtaagtgggggattcccttaaaacccgtagctgaggacgaggagaacatccttgtcaccaaggtctggcgtggtttttttttgaaatgccccttttttgtctaaatactgtatttcatggaaaagaatactgagaagcaagcacctgttaaaaaaatttttaagttttagctcaaaatagagaatgcctaatgactggagatcctgttttgatgtgtaggcctggtgcagaaataggttattgaaattagccatcctcatcagagtaagagacactcatggacaagtggttcacaatgactgattacgacgtcattcgggtcaacactttccacttgaaaccatcatttgagatagcagttggaggaagtgtctgaagaggat

SEQ ID NO: 111 - DNA, 28931 bp, Homo sapiens
acaattctccttaacaaggagcagttagtgtctcaaacatttgggtgtaaagaaaattgttggccccaagtttagagggagacggcaacattacaggtaatgttacccctcagtcctggccaacagcagtggctctcgcctgtaatcccagcactttgggaggccgaggcaggcagatcacctgagatcaggagttcaagaccaccctggccaacatggtgaaaccccgtctctactaaaatacaaaaaattggccgggtatggtggcgggcacctataatcccagctaccctggaggctgaggcaggagaatcacttgaacctgggaggcagaggttgcagtgattcaaagacctaagtctttattttactaagcatgctgtttaggctaaaggcaatgattagtacaattctcctttaacccttggcccgacaggaagaagtggatagattaggtaaataattactttctttttttgagacagagtctcactctgtcgcccaagctggagtgtagtggtgcaatctaggctcgctgcaacctctgcctcccgggttcaagtgattcggcctcatcctcccaaggagctgggattacaagcacgtgccaccacgcccgactaattttttgtatttttggtagagacagggtttcaccatgttggccaggctggtcttgaactcctgacctcaggtgatccgcccgcctcagcctcccaaagtgctgggattaaaggcatgagccaccgtgcctggacaataattactttctaactgggccttgaaaaaggtggtttttggcctcggaaaattaggagttgtgagcaatttatgaaaattttgcattttcctttttcaatgtcactagtcagataaaatattttatattagtattagtcaatttttcttctcttttttttttgagatggaggtgtgctcttgtcgtccagctactccacaggctgaggcaggagaagtgtttgaacccgggaagcgaaggttgcagtgagccaagatcctgccactggatgccagcctgggcgacagagcgagactccatctcaaaaaagaagaaaaaaaaaaggaacgaaaaccacagacttgaaactaaattcttatctgagaaatgctttacctttgtattcaaattagtgatgtagggatccctatcagaaacagagcggacagactattagcaagacagcataagtaaatctttatgctacaaattttggaataaatttatcaaccattccagctccaaacaggtttctaaaacaatgagctaatgagacaagagccatcactgatctacgcaatcgaagcagaggagcagtcagtgtatcaaacatttgggcgtaaagaaaattgttggcctggcgcggtgacgcacgactgtaatctcagcactttgggaggctgaggcgggtggatcacttgaggtcaggagtttgagaccagcctaacgtggcgaaaccctgtctctactaaaaatacaaaactcagctggaggtggtgacgggcgccagtgaacccagctactcgggaggctgaggcaagagaatcgcttgaatctgggaggtggcgcttgcagtgagccgagatcacgccgctgcactccagcctgggcgacagagcgaggctccgtctcaataaaaagaaaaaaaaaaaaaaagaaaattgtttttcccctgcaataattgtgctgaagtagcacaaatggccgaaacattcatgggcaggtttcccagttatttcaagtccgtttgagttagggctcatttcagcaagcacacacatgaatgatccaatacaaactttagcagaacttctgttgagtccagaagactttatcttacttgttttggggaaatagctgaatcttcaaagttatgattgttttatctagtaaaaaaatctagatctggcgctttaatttttttttttttttttttttttgaggtggagttttgctctgtcgcccaggctggagtgcagtggcgcgatctcggctcactgcaacctctgcctcccaggttcaagcgattctcctgcctcagcctcccgagtagctgggattacatgcgcatgccgccacgcctggctaattttttgtacttttagtagagatgggatttcaccgtgttagccaggatagtctcgatctcctgacctcgtgatccgccctccggcatgagccaacgcgccctgcctggtgctttaattttaataagcgcttctgttttaattttacttcggagttctcagtaacggtccatttagtaaactaaaggcctccccatttggggtctcaacgatgcacgcagatgggagataaacttaaggccaccgagacgcttaagcgacacgtgcctggcttctgcagcaagcggccgacctgcccgccggacccgccgggccacccccgcctcggtgtcccgcaggcctcccctcccggctgcatgcaatccctagggcaaaggctactcgcgggtcctcccgctacttaagggggagaagcggccgcagagccagggatcccaacagaaataagaagggggcagggtccgcgctcgctccgccccggtggctcaggagcggtgccccggcgtcctccgtgtcccgctgggcccgggacaagcagcccaggcggggagggagcagccgcccacgtgcccgccgcgcttacccgagagcagagcgggtccagtgcgcagcgtacggacggcgcccacccccagctgccagggcctcggcgggcagggcgcggcgggtgacgggaccgcgcgcagggtgcagagcagggcccgcacgctccgcaccactcgcagcgccatgttcgcaggggtgcgggggtcgcagcgctacgcctcggccacccgcgccgggaggcggggcggggaggggcagttcgcggccggagggagccggctggatggaggcgcggaggcggtgccgcgggggcgggacagagcctgactgggcagagcgtggagggcggagactcccaggcgagggggcgaggcagggtctgattggccagcacgcggagactggggactccagggcctggcgcgacctcggatacggcgacgcgaaagaggggcgtgggcatggggaagaacctgaggcccggaagaggcagcaccgagaggcggagactagcgcggcgggcctgggtatgattgggctgcccgcaggaggggggcggggcctagccccagactgggttcctttccacatgtgtatctcttttactgcctctgtcataagttttcaaaggtggtttcaccacctcacgaaggaattcaagaacaagtcggaaagtcgtgaaagtacagaggtttactgcaaagtacacactgaagaaagggcggactcaaaagagggccacacaatggggcttggggtttccatctttatgggtttctttgagaaatggaatatacacaaaggtttctggaataaggtggagacttgtcagaactgtggtgccacccatttttacaccaaatatgggtgttcccggaattgttgtggtgccggtgggtgtgtgacttagtatgttaatgagtcctaggtgaagcctaggtcaaagccacaccacgttgggtccagttggttttagccaggttgacccacaccctggtttttcagggtcttagcccatagcttgtgcagctatttcaacagtttccttttgttagacagaactgcagcctggaagtttctattctccttcaactgctctgtaacgttcctgtctcaaagagccccagggaccccaaacaggaccggcagaatccagaagcttacttaaaaaggaataaagacttgtccaagggtcataagtggcttcttggtggagactggacccaagccagtcactaatgcagaaatattcaaaacgcagagagctgagacccagtgtgcacaattccttgtttcatcggccagcggtgtgaccaaggccttccgagaaaagccgaagtcatcatcccaatccaagaagtcagaaaaaaattaggttctgggaaaaacctcacctttaacacagattttatggagtggccatgagtcagcaaagaaatactgttctgaaaaacaccttaagctacacacacacctttagtactgttacagaaagggctcccaatccagaccccaagagagggtttttggacctcatgcaagaaagaatttggggagagtctataaagtgaaagcacgtttaatagagaagtaaagaaaaaaaagaatggcttcttcgtagacagagcagcagtatggcttctcgactaagtgtacttatagttatttcttgattgtatgctaaacaaggggtggatcattcaagagttctccagaaaaggggcagggatttcctagaactaacggttcctccgctttttggactatagggtaacttctctggacgttgccattgcatttgtgaactgtcatgacgctggtgggagttgttttttttttaacatgctaatgcattataattagcgtataatgagcagtgagacctaccagaggtcgccatcttggttttggtgagttttggccagctcctttaccgcatcctattttatcagcagggactttgtgacctgtatcttgtgccaaccctagctcatcctgtgactaagtgaggcaggtgaatcacttgaggtcaggagttcgagaccaacctggccaacatggagaaacccccgtctctactacaaatccaaagtttagccaggcatggtggcaggtgcctgtaatcccagctactcaggaggctgaggcacgagaatcacttgagcctgggaggcagaggttgcagtgagtcgagatcacgccactgcactccagcctgggtgacagagcgagactctgcttcagaaaaaaatacaaataaaaagaatgcctaacctcctgggaatgcagcccaccaagtctcagcctcattttacccagcccatattcaaaatggagttgttcttgttcaaacaccggaaacagtaccatagggtgcacaccatggagtgtgtgtgtgtttggggagcccatacgttgttgcactgagcttctgccctgctatgaacttagggttgccaccacatctgtgcagtggcttgcaagggccgtcatgcccactttcttttgagcaaatcattcccatctattgagcctttgctatgtgcctggcactatgcacacatctttttaatcctctccaaacctctttctggcaggtgttacactcatttcatagatgaggctcagaggtgaaggcacttccgaggagtgggatcggggaggcgtttttgtggcttaagtagctcctaggtggcagtagtagaccttggcctctacactgattagaaagcaactcttctttttttctttttttttttcgagacgaagtctagctctgtcgcccaagctggagcgcagtggcgtgatcttggctcactgcaacctctgcctcccgggttcaagcaattctcctgcttcagcctcccgagtggctgggactacaggaccacgtgccaccacgcccgtctaatttttgtatgtttagtagagatggggtttcactatgttggccaagctggtctcgaactcctgaccttgtaatccacccacctcggccttccaaagtgctgggattacaggcatgaaccaccgtgcctggccagcaattgctcttaagctctgctccgcttgctttcgtttgggatgctgactggatcacgctggtctaccctgcactacagatcttggctaccttctctaatgtcaagatgttgttttctattgttgtttcattacaagacagtgcagcatcgtgccacttacaccctaacatatttattctcagcttcactaactcatgtgatgggaagaaaaagatcacacatcaacatcaacatatgggctacaaaaaggcccttccaccaaaaaatatgacatgtgtttttcttttggtaaaaagcattgaagacagtcaaaattttttttctttttctacctagtaatctttgtaacctcctggtttgagattttaaaggtcatctcgttgcccattgagtataagctctggaaaattccaggtggtcatttcttccaggtgttttgagaggggcccattcatctctttgagctgatagacatattttcctcttataacaatacagtagactgggtgcggtggctcatgcctgtaatcccagcactgtgggaggcctaggtaggcagatcacttgaggccaggagttcaagaccagcctggccaacatggtgaaaccccgtctctacaaaaaaatacaaaaattacccaggcatgctcttgtgtgcctgtagtcccagatactgggaagcctgagacacaagaatcatttgatcttgggaggcagaggtttcagtgagctgaaatcatgccactgcattccagcctgggcaacagagcaagaccctgtctcaaacaaacaaacaaacaaacaaaaaaacttttataaaccagtattccccatatttatttgacccagaaacatttttggaggaatgacacctgttctggtttgaattgtggctcctaaagaggtatgtcaaagtcctaagtcccagttcttcagatgtgaccatattgggaaacaggatccctgcagatgtattataattagttcagatgaggtcaccctggactagggtgggcccctaattcaatatggctggtgtgctgagaaaaggagaaggaacacaggctcccagcaagcttcttcccatctgggagtgacacatctagaagccaagggacaccaaggctggctggccaacaccaaaagctggaagaggcaagaaggattcttccctagagccctcagagggagcatggcactgccaacatcttttttctttcttttcttttttttttttgtgagacggagtcatgctctgtcgcccgggctggagtacagtggcaccacctaggctcactgcaacctccgcctcccgggttcaagggattctcctgcctcagcctcctgagtagctgggactacaggcgcccgccaccacacctggttaatttttgtatttttagtagagacagggtttcaccctgttggccaggctggtctcgaactcctggcctcaagtgatccgcacgcctcggcctcccaaagtgctgggattacaggcgtgagccaccatgcccggccactgccaacatcttgattgcacacttccaggctccagagctgggacagaatgcatttctgtcgttttaagccacttcgtttgtgatacattgttctgggaaactaatacagcatccattagcatctctcagacagtttgagaagccctgaactagaatcattcaaaagcaacccccaacggactaaaaagacgaaataattagtctgtgcaggaaattttccaaactccatgtaatatttgttttatttataataagaggaaatacatttgaacaaagaagctctcatagtattggcaattttacatatatctctgttattgtaattttttttacttgctgggcttggtaattcttcaatggacatgaaagctatgacctagagagactatagagtcgctggtaagcgtacgcccgaggccctgggcgtccccactggtagatggtggcgtgtggacgaacagcttagtccttgggcaaagcttgtgctggtcgagagtggcgagtctgggacagagacccaggctgctccctgctgcttccaggctcctctctcttagacttaatgcccaggaaactgagtattttcatcagcagcaaatctacgatctccccttcctccgacagctgcaagagaaagaaccaggcaatgcccatagaaccatcttctttgggggcttttctttctaaggggaagtcatagtttttatttttatttattttattttattttattgtttgagatggagtctcactgtgtcgcccaggctggagtgcagtcgcacaatcttggctcactgcaacttccgcctcccgagttcaagcgattctcccgcctcagcctcccgagtagttgggattacaggcacccgccaccacgctcagctaatttttgtatttttagtagagagagagttttaccatgttggccaggcaggtatcaaactcctggcatctagtgatccacctgcctcggcctcccaaagtgctgggatgattacaggcttgagccatcgcatcatccctggccgaaatcacagttttattgtccagtttggtctcaacctaggttacttcactgttgagagctgttttagggcagaaaggcctccctctgggaatgccaagggtgtgtgctccatcctttatcctcagcgggctccctccacctctctgatgaggatgactgagttttcactgccacatttcaaattcccaagccagcgcagagtaagcctcggctgggcggctgagcctgaagttaaacagcacatgggcccccttctgagatgagtgtctccccttttcctctaggtcagagtgttggtggtggctccttctttcgttctttttttttctgagacagagtctagctctgtcgccgaggctggagtgcagtggctcaatctcggctcactgcagcctccgcctcctggattccagctattctcctgcctcagcctcccgagtagctgggattataggcacacaccaccacgcccagctaatttttgtatctttggtagagacagggtttcaccatgttggcggggctggtctcgaactcctgacctcaggtgattcacccacctcagcctcccaaagtgctaggattagaggcgtgagcctctgggcctggccttgtggttctttattattattccttctgcttgctctgtttacctcctggcctagcctggtatgggaggaagttctgggaatgaaaaaataaatagatgtttctctctggctttcccacacttctcaaccatatacacatatttaagagtgacttaaagcaaagaaagaacaacttctaggaaacaggaatggcagactataggtaccaatgaggcacgttcagtaaactcgtcagaaaatgctctctaccaccccaacagaggctgttaagaacttatgtacaggctgagcacaggggcttattatatttataatcccaggattttgggaggccaaggtgagacgattgcttgatcctaggagttcgagtccatcctggacaacatagtgagaccccatctctacagataattttaaaaatcacagctgaaagtggtggctcacacctgtaatcccagcactttgggaggccaaggtaggcagatcacctgaggtcaggagtttgagaccagcctgaccaacatggtgaaaccccatctctactaaaaatacaaaattagctgggcatggtgggcacatgcctgtaatcccagctacttgggaggctgaagcaggagaattgcatgaactcaggtggcagaggttgcagtgagccgagatcgtgccattgcactccagcctggcaacaagagcaaaactccatctcaaaaaaaaaaagaagagtgtttaaaaatcaggccaggtgtgacggttcacacctataattccagcaatgtgggaggctgaggcaggcaggtcacttgagcccagaaatttgagaccagcccggccaaaatggggaaaccccatctctaccaaaaatacaaaaaaattagccaggtgtggtgcagtcccagctactgggtctaaggtgggaggatggctcgagcccaggaggccgaggttccagtgagctgagattgcaccactgcactccagcctgggtgacagagcaagcccctttctcaaaagcaagcaagcaaacaaacaaacagaagaatttatgtgcaaaggtcctgcacattgctgctggggatctaaaatggtacagctgcttcagaaaacagtgtggcaggtcttcaaacaattaaacagttactgtgtaaaccagaaatttcacttccaggtatatgcccaagagaagcgaaaacacatgtccatatgaaattctgcccacagaatgttcatagcagcatcgtttgttaaagccaaaatacagaaacaacccaaatacccatcagctggggaatggataagcacatcgttgttttacccacacaatgaaatatgactcagccgtaaaaaggaatgacgtggatacacgctacgacatggatgaatcttgaagacatgatactaaatgaaataagccagacataaaaggccacatattgtccgagctcatttatatgaatatgaatttccagaataggcaaatccaaagaaatagaacgtagattagtggttgccaggggctggaggcatggatatgggaggtgattattaataggtagggggcttctttgtggtattgaaaatgttctgagcccaggcacggtggctcacacctgtaatcccagcactttgggaggccgaggctggcagatcacctgagatcaggagttcgagaccaccctggccaacatggaaaaactcatccctactaaaaatacaaaaattatctgggtgtggtggcaggcacctgtaatcccagctactcaggatgctgaggcaaaagaatcatttgaactcgggaggcggaggttgcagtgagccaagatcacgccactgcactccagcctgggtgagagagcaagactctggctcaaaacaaaacaaaacaaaacaaaaaacaaaacaaacaaacaaaaaacagaaaagaaaagaaaaaaagaaaaagaaaatgttctagggctgggtgtggtggctcacacctgtaatcctagcacttcgggaagccaaggtgggtggattgcttgagcctaggagtttgagaacaacctgagccacatagcaaaaccccgtctctattaaaaaaaaaaaaagaaggccgggtgtggtggctaatacctgtaatcccaacactttggaaaaccgaggtgggcaaatgacaaggtcagaacttccagagcagcctggctaacatggtgaaaccccgcttctactaaaaatacaaaaaattagccaggcatggtggcgtgctcctgtagtcccagctgcttaagaggctgaggcaggagaatcacttaaacccgggagggggagggtgcagttagccgagatctgccactgcactccagcctgggcgatggagcgagacgctctctcaaaaaaaaaagaaagaaaaaaaatattctggaattagtgacgatgtttgcacaactctctgaatatactaaaaaacgtttaattgtatgatttaaaatggctaattttatggcacatgaaatatatcttcattgttaaaaaaataatttatttacaatggacaagttcaatcttctgatagaaggaacccactcggagaaagtaactttaattaaaggtggctacttaattgcatctccaaattaaggtacagttggagtacctgggcatcagacctagcaatgctctctgcttccttgctaaaatgaaaacatttccccaacactacaaaattgtttttaaaatatcaaatctttttgcaggacaaaggcattgtggtataatatgaaccatagttgatctttgacctcggttcccatcacagagctcctgaaacccttagaatttactaataataggagtgtcttttttttttttttttttagacagagttttgcttttgttgcccaggctggagtgcaatggcgtgatcttggctcactgcaacctccgcctcctgcattcaagcgattctcctgcctcagcctcccaagtagctgagattacaggcatgtgccaccatgcccagctaatttttttgtatttttagtagagacggggtttctccatgttggtcaggctggtctcgaactcccgacctcaggtgatccgcccgcctcggcctcccaaagtgctgggattacaggcgtgagccaccgcgcccggcaataataggagtgtcttttgctattcatgatgagccccctttcatcacatctgagtttttgctaatgagtgacttagggcaggcccctagatagcttcaggatgaggcaggtcaccagaaaatcctcggatggtcaagtctctgataaaaaaaaaaaaaaaaaaaaagccataatatttacatataacccacacacattctcctgtatactttaagtcatcatctataagtacctttttttttctttttttttgggatggagtttctgctcttgttgcccaggctggagtgcaatggcacgatctcagctcaccgcaacctccgcctcccaggttcaagcaattctcctgcctcagcctcccgagtagctgagattacaggcatgtaccactacgccgggctaattttgtatttttagtagagatggggtttctccatgttgaggctggtctcgaactcctgacctcaggtgatcagcccgcctcagcctcccaaagtgctgggattacaggtttgagccactgcacctggcctataagtaccagtaagtacttataatacttaacacaatgtaaatgctatatataaatagttgttatacagattgagtatccctcatccaaaatgcttgggatgactagtgttttgtgtttcagattttttcagattttggagaatgcataatgaggtatcttgggaatgggacccaagactaaacaggaaatttatttatatttatatacaccttatacacatagcctggaggtaatttcatacaatatgtgtttttaatttttatttatgttttagagatagcatcttgctctgtcgtgcaggctagagagcagtggtgcaatcatggcttactgcatcctgggctcaagctatcctcccaagtagccagaagaagaggcacatgccaccaggcccagctaatttttgtattttttgcacagatagggtctttctatattgcccaggctggtcttgaactcctggcctcaagtgattctcctgtctcagcttcccaaagtgctgggattgcaggcgtgagccactgggcccagcccagtatatatttttttattttaaaattatattaaaaatatgaaacactttgtgaatttgcacgacctccttgcacaggggtcatgctgatcctctctgtacaaagtttgtattaagtatttatgtgtggaattttccatgtttcacctcaggtgagcatgcaaacaattttggattttggagcattctggatttctgatttttggattagggatgcccaatcggtataagatacccagttggtgtctgctggagaattgcttggtgtgtgcagaaaatctccacacatttggtcacagaagtgttctgtgttaagtgagagtttagtgaaataaaaatttgtatttcctttccaaacacagatccgggacacacgttacaagcgtaccagagaccatttagcaacagaagaggggcagcattcttagcattcttgaatcctgtgggcaataatttcctggtttccaggaaaaataactctttacaatgatccttcaacatgatggagtatgtcacctttatgaaatcttttgcaatttagaaaaacaacaataccaaattgctgctcttgtatagaaatggaaaaattcaaagaagagtgtcttaacaaaggtttctttgttagacgtgcagatttttcttttttttcttttgagacaggatcttgctttgtcacccaggctggagtgcagtggcatgatcacagctcactgcaggcttcgtctcctgggctcaggtgatcctcccacctcagcctcctgtgtagctaggactacaggtgtgtgccaccacacccggcttaggcatacagattgaaagaatctttcaactgggacaggaagggtgagctgcataatacgtcaccgttcacacagtcatacctccagaagggcaggaaaagaaaacaaaacaaaaccatacatccaagtcagacagatccaggttgaaatcccacctttcctactttctagctctgtggttctaggtaaatgatttcatctctgtgagccttggtttccttctttgtacgttgtgaataattatacctacttcagagagctgttttgacgattaaataaaacacaacttcggttgtgaagagagcgctgtgtgggtggtgctggtggctgttattaacctgcagtctgtgtgctcatatccctcttcctgcaggcagcccagcacgctgactcttccatgggtgggaggtcgatcacgagtgcccagcttgttgccctccgagccatgacgacgtgggttgaggttttggagtgtagtatgtgttttcaaccttggctgttcattaacctgaaaattacccaaagagatggctgggcgtggtagctcatgtctgtaaccccagcactttgggaggccaagattggtggatcacctgaggtcaggagttcaagaccagcctgaccaacatggtaaaaccccgtctctactaagtacaaaaaattagccaggtgtggtggcgcatgcctgtaatcccagctacttgggaggctgaggcaggagaatcgcttgaacccaggaggtggaggttacagtgagccaagattgtgccattgcactccagcctgggcaacaagagcaaaaactctgtctcaagaaaaaaaaagttacccaaagagatttcaaacataccaaggactggctcattctcccagagattctgtcggtgttggtctctgttggtattagtctctgttggtgttggtctctgttggtgttggtctctgttggtattggtctctggctgggcagccgttgtttccaaaaggccccaggtgattctaaggtgcactcagggtggaggtcactggtgtcgcgaacagagtctcacattgggaatcaggagacacagctctggtcccagccctgcccctcacttgcttgtgattttggggaattaatgtcctctgtctatgcctgagtttcccctcctgttaaatgagggctctgagctacaatgatctctcaagttccctaaagtctaacaccgctccagcctcttcatagttcaatgactgatgaggaataggccaaagcgactcacctgatagtatttttgctcctcactgaaggccaccaggatgacagagataaacaggttcagcaccacaaatgtcataaaaacaatgcaggatccaatgaggaaggagccaagcactgggctatagtccaggacctgtcagaaagaaagccagggtcatccagtgtcctgggtcccagtagccacttcccctactgggaaccctcagagggaaaatggtcctcagagttaggcagagcctagagcctggaaggtcccctctgcctggggctgagagagctgggcaaggagagaacgggcagcccctcactttccacggctgccacctccaaagacggctgccctttctgcccagggtagggggtgtttcctttgggagacccctgtacagccctcccctgagtagccagcacccaatgttcctctgtgagcagggatcccaagggcaagctgtgggctctagcaggggtgtctacctagaggagggggaacatttctgtttgtccagacttgcccggtgcttgccaggccatgggcccaagggatggcacggggcggggtggacagggagtgctttttctaatcttcacagaggctccgtatagatggcagcaaccgtgccctcaccccgttacctcctcgtagttgaagattcccagctgaaggctgaccatcgtctccgccgcatcaaagagggttttgtaggaacggagtttccaaccaaatatcaagtttgactgtcatggaaagaattctcatgaacagggaaggaggctgccaaggcccaaacagcctgctgtttcacagtggagtgggtggtctgtgtcagccactgccctggctgggctggtcaagctactgtacctacaggggtgtgcaagtgggtgtgtgtacacaacaggtttttgtttgttttttttgcgagatggagtcttgctctgtcacccaggctggagtacaatggttcgatctgggctcactgcagcctccgcctcctgggttcaagcgattctcctccctcagcctcacaagtagctgggactacaggcacacaccaccacgtctggctaatttttctatttttcgtagagacagggtttcaccatgttggtcaggctggcctcgaactccggatctcaggtgatccacccaccttggcctcccaaagtgataggattatgggcgtgagccactgcacccggtccacaactggttctatgtggcatgcatgtgtttctctctgtgggtctgtgcatgcgaggccacacgtgtgtctgtgtgagagtgtacatgtgtatgcctgtgggcatcaatatctgcacatatgcacttttgtgtatgtatatgtgtgtatctatgtgtagtgtatttgtgtgcacatgcatgtgtatatgtgtatgtgtgtgtatccatgtatagtgtttatgtgtgtgcatatgtgtgtgtatatttgtttgtgtgtacgtgtatgcgcgtgcatgtgtgcatgtgtgtaggtgtgcacgtgtgtgcatccatgtgcacgtgtgtgtcaagtttctggaagtgctgcctggatgaccttgtccaggacctttattgtgtccatggcctgttgatgatgcctatctctgtgcccaccaggatgagggagtgcccagggtgcctctggggctcaggcagccacctgctaagccaccgcagtgttccccagatgcggtgcaaatacctgacaatgagtctgggcactctgcggctccaaacccttcgctctggggaactgggttgaatggatgatgggcttctgcctgggtgaggacctcccctcactgcattttccctcaccacaacccctcactcccaagactttcccagggctgcagtgtcagagggaggcccagcagcccctggctctgtctctgagttgatgacttttggtcccatgggacactgcaatgtccctgcagcccagacactgcatggaagtctgaagaaattcacattaggatttagaggggagctttcaccaaaatcacagactccaactttccagaacacacccccatcactccctcagtgcaccccacctgtttccaggggtgggagaggaagatcgggtggggctagggatggaaggggtcaagcctgaggtgacagggaggcagagtggggtgagggttggggtggagtggggactaggatgcgatgggctggtggataggatgatcagggaggagaggaaggcaagagactggatggagccagggtgaggatggggaaggccctggggtagggagtgggccaggattgtgctaaaggccagagatgaacggaaggccagggcttgcatgggaacatggtgggcagtagggggtgtatttagaaggacatcaggatgtggtgggggccaggatgtaagaggggctttgtttctcacatgatcataaaaaagaattgaaaatttaatgtttttggctgggcgcggtggctcacgcctgtaatcccagcgctttgggcggccaaggtaggcagattacctgaggtcaggagtttgagaccaacatgatgaaacactgtttttaccaaaaatacaaaaattggccgggtgtcgtggcacatgcctgtagtcccagctactcaggaggctgaaacaggagaatcgcttgaacctgggaggcagaggttgcagtgagccgagattgtgacactgcactccagcctgggcaacagagtgagactctgtctccaaaaacaaaaaaaaagccacacacggtcgctcatgcctgtaatcccagcactttggaaggccgaggtgggtggatcacctgaagtcaggagatcgagaccagcctgaccaacatggtgaaaccttgtctctactacaaatacaaaattagccaggcatggtgctgtgcaccagcaatcccagctactcaggagaatgaggcaagagaatcgcttgaacctgggcggtgaaggttgcagtgagcctagatcgtgccactgcactccaacctgggcagcagaacaagactccgtctcaacaacaaaaaagaaaattcaatgttttcatttatgtttttctacacagggccatgcttgtcaatgtgctcttaaagtgctgagtgaagtggcattggccctcccaagctcatgagtcatgttttggacaacaagcactggcatggcctgtggatgtatctaccttcacatccccacctctgccccaactcaaggacgtggtggccccatccatcccccagcacagcagcagtgctctgtgtgtgtctaggagttagccctgtgccttctgaccagttgggaagccaggataactggcacatccaggaggggtctagagccagaaaggaattcttcccaaacctggatcctttcagcactagagcctatgcctcctcaccctatccacctgagctctccagcctttgccatttgagatgactggtgcatgagctcacagcaaagacaccctgtacttacaagagccaccaccttccttgagttcccagggtctccctaaccctaactgtccactttcccaccaccaattagccttggtttctgcagagaccctccccgaacttttcccaaagcagatacttaccgcgatggagtaagccaggagcatggtaaggatgacaatcataaagcctgaaatgtcgccccaggcacggcgtagggctgccgtgatcatgttcattttgggattcaacctgagcagatgccaaagcttcactgtggacaggagtaccaggaaggcaatgatgtagccaagggcggcatcggctgctgctgtctcactgaagctgatgcctctgtgggaccaaaatgcaaaggctgggtctcagagaccttgagcagttcagccagaactcatctggatgcaagactggatttatcggcatttcgggatgtgggattagttctatcatcatctcataggccatcaggtccagaaacaggtctgggaaagagagccatcccagttcccccaggtaggtggtgatgatgatgatgatgatgagggggaggaggaggaggaggatgctgggaattgtggtgtgagagtgataatgacaatgacagtgatgatgatggtgatgatgctgaagatgatggtgatggtgacaaagatgataatggtagttggacttcatggtgtgcactggtaatcctagctactcaagaggctgaggcgggaggatcacttgagttcaggggtttgaagctgtagtgagctatgatcgtcatcagtgagatggcagcaggaccaatcaccatgtggttttctctgggatgttggactcaagacatttttttttcctgatctgtttttaaaagttttatagtccaggcgtggtggctcacacctgtaatcccagcactttgggaggccaaggcaggcagatcacctgaggtcaggagttcgagaccagcctggccaacatggcgaatccctgtctctagcaaaaatataaaaattggccaggtgtggtggcgcatgcctgtaatcccagctacttaggaggctgaggcaagagaatctcttgaacccaggaggcagaggttgcagtgagccgagatcatgacactgcactctggcctaggtgacaagagcaaaactctgtctcaaaaataaaaaataaataaaaataaataaaagttttatgacgccatatggtatttcttgttaactgaaaaactttgcagccacaaaaaggaacaaaaccacgtcctctgcagcggcgtggatgcggctggaggccactatcctaagcgaattaacacaggaacagaaaatcaaatactgcgtgttctgacttacaagtgggagctaaacattagctagttatggacataaagatggaaaaaacagacactggggactgcaagactggagggaggcaggcaagggttgagaaactatctactggtactgtgctcactacttgggtatcgaggtcattcgcaccccaaacctcagcatcacgcaatatactcatgtaacaaacctgcacatgtaccccctgaacctaaataaaatttgaggccaggcgcagtggctcatgcctgcaatctcagcacattgggaggctgaggcaggaggatcacttgaggccaggagttcgagatcagcatggggaacaatgtgagactcctgtctctataaaaaaaataataaaaattgaaattgcttaaaaaagaaaaacttgtgaggcctgccttctagctattctacagaagaagccttttcaaacaggttcaaggtgacactaccttcccgaagctctgtgatctggagagctttccccgtgctctcctccaaggttggactcactcagggcagctctctacagggccacaccgagggacacaaagcacagactgggtttgccaccttgggtactggccaggcctcagtgagaaccatccttttacccaaatctcctgccttccagaatcttccttccctttgagcagactggagttgctggtacaaactgttgcttccgcctttgactccagcagctcctttctcctgtctctcttaaaagacctaatgctgcctgggcacggtggctagcacttgtaatcccagcacttttggaggccaaggccagtggatcacctgaggtctggagttttcaaccagcctggccaacatggtgaaaccccatctctactaaaaatacaaaaaattagccaggtggggtggcaggcgcctgtagtctcagctactcgggaggctgaggcaggagaatcccttcaatccgggaggcagaggttgcagtgagtggagatcgcgccattacactccagcctgggcaacaacagtgaaactctgtctcaaaacaaacaaaaaagaagacctaacactgtctcatgccatttaattgcttatgtatgtggaaaaaataacaatacataagccctcttttatttttatttttttcttgagatggagtctggctctgtcacccaggctggagtgcagtggcacaatcttggcttactgcaacctcctcctcctgggtacaagcgattctcctgcctcagactcctgagtaactgggactgtaggcgtgcttcaccatgcccagctaatttttgtatttttagcagagacggggtttcatcatgttggccaggctggtcttgaactcctgaccttgtgaaccgcccacctcagcctgccaaagtgccgggattacaggcataagccaccgcacccagcctggcttcagtatttttactgtctccttggagttattcttatatgtagccaaggttgagaaccatgctttaatacggctaactgccttcataaaggagggctggctgggcatggaggctcatgcctgtaatcccaacgctttgggaagccaaggcaggaggaatgcttgagaccaggagttcaaaaccaacttgggcaacagagcaagacctcatctctacagataatttaaaaattacctgagcggccgggcgcagtggctcatgcctgtaatcccagcactttgggaggccaaggtgggcaaatcacgaggtcaggagttcgagaccagcctggccaacatggtaaaaccccatctctactaaaaatacaaaaattagccgggcgtagtggcgtgcgcctgtaatccagctacacaggagactgagggaggagaatcgcttcaacctgggaggcggaggttgcggtgacccaagatggtgccactgcactccagcctgggcgacagagtgagactccatctcaaaaaaaaaagaaaattacctgagcatggtagcgtgagcctgtggtcccagctacacaggaggctgaggtgagaggatcgcatgagccctggagatcaaggctatcgtgagctgtgatcacaccattgcactccagcctgggtgacagagcaagatcccgtctcaaaacataaataaaagaggccataagccctcttttattaggcatgagccaccatgcccagcccgaagccttcaatacttaaaagagaaaagcggtctagagaggaaagagggagggtctggtgacactattgaatccacatgttgccagagaaaaggagcaggtaagggaatagtcaatgatgtatttgtctcatgctcagttaagtgggcactttacataagataaggtgaacctggagctgctgtctgcagagatcaaccttttagctgtaactctctctttacgaacaaaatgaaaggcagtttcttgcatgactcaactttcagcttaatttttctttttccttttggcagagtggattggggtcccaagattttattttcccttcatgcagcttaacctctccaagcctcattacatgtgatttcctcatttgtaaaaaaaaaaaaggatgatgaggctgggcgcggtggctcacgccagtaatctcagcactttgggaagtcgaggggggcgaatcatgaagtcaggagtttgagatcagcctggccaacatggtgaaaccccgtctctattaaaaatacaaaaattaaccgggtgtggtggtgtgtacttgtaatcccagctactggggaggctgaggcaggaggatgacttgaacccaggagggagaggttgcagtgagctgagatcatgcaagagtccgtctcaaaaaacaaaacaaaaaaagggatggtgatatcatctcttagaggtctcaggaggattcaggtgtaggtgagatgagacactgcttgtaatgtggtgtttttatgaaagtgtatgacatttagcaataactcaatacatgttagctatatctataaaacgaatgagtgagtcaagaaacccgatgattccaagcaagggaggggaccctggagccacacaagctaggcttaaattacttgtctgccacattttagctgtgtggccttggggaagtcacgtgacctctctgagcctcagtgtctttgtctgtttttttgagacccagtctccctctgtcacccaggctggagggcagtggcgcaatctcggctcactgcaacttttgcttcccgggttctagcgattctcccgcctcctgagtagctgggactgcaggtgcatgccatcacgcccagctaatttttgtatttttagtagggatggggtttcaccatattggccaggctggtctcgaactcctgacctcaaatgatccacccgccttggcctcccaaagtgttgggattacaggcgtgagccaccgtgtccagcaatttttccatttttagtagagttagggtttcactgtgttggccaggctggtttcaatctcctaacctcaagtgatctgcccacctcggcctcctgaagtgctgagattacaggcatgagccaccacaccctgccctcaatgtctttgttaaatggggcgatgataacactgaccttcatcaatcctgatgatgattccctaggtgaaaacatcctgcctaccacatagtggacacttagtgtatggtagcagaggtgagcttactggggccataatacttgcaaagggcctcccctttgcaaggttttggagagcctaagcaggatgccccatggtcctatgttttgggaagatttgcacaagatgttctattttgtctgagtcctctccaatcgtactcacttgcggctggccccacacctgaatctaggtggcagctagagttatgtctactaggagtgcccctttatcccttgagggtccacagcattccaaaacctccttctgacccctgggcctcaaacggagctgtaggaagaggggccagtgtggggagctggggggctgaggagacagccactgactcctccctgtggttccggcagcgctggaggtccctttcggccaggacagccctcttcacaaacaccgccagggcgctccagctggccaggatgatggccagctccagaaggttccacttgctgcagaaatagccccacgtctctttactcatgcgcttgccctggaaaaggagcgtgaagttgcggccgtgactgcccccgccccacagggctgctccctccccatcccggagggccctctggcaggaggcttccccagctctggcccccatgcacagagtgcccaggcctctccccaaccttgtgcacagacccattgaggcgggataatagggcctggaggcagggaacctaagaactaaatcaaatggaaacacttcagctatgacaggaaatatcctcttcattcacatagggtgtaccccgagtaaatgactttgtaacttcactttaacctcttcatttacataggacatacaccgattaaccaatggaaacctctagaaggtatttaaaccccaggaaattcttttttttttttttttttgagatggagtctccctctgttgctcaggctggagtgcagcgggccccatctcagctcaatgcaacctctgcctcccgggttcaagcaattcttctgcttcagccccctgagtagctgggattacagacgtgtgccaccacacccagctaatttttgtatttttagtagagaaggggtttcattttgttggccaggctagtctcaaactcctgacctcaggtgatctgcccgcctctgcttcccaaagtgctgggattacaagtgtgagccaccgaacccagctggctgtagtttgcaacatggaaagagttcatccttctggagatggacggtagtggcacttgcacaatgatatgagtggacctaatgccactaaacacttaaaagtggttaaaatggtaaattttatgttacgtatatttcccacaattaaaaataaataatttaggctgggcacggtggctcacgcctgtaatcccagcactttgggaggctgtggctggcagatcacaaggtcaggagatccagaccatcctggccaacacggcgaaaccctgtctctattaaaaatacaaaaattagccgggcgtggtggcaggtgcctgcagtcccagctactcaggaggctgaggcaggagaatcgcttgaaccctggaggcggaggttaaagtgagccgacatcgtgccattgcactccaacttggtgacagagaaagaatctgtctaaaaaaaaaaaaaaacaacaataaaataaataaataattttaaaaattgctgagcgtggtgactcatacctctacaacactttgggaggctgaggcgtgacaatcacttgagcccaggagttagagaacagcctgggcaaaatcacgaaaacgggctgggcatggtggctgacgcctgtaatctcagtactttgggagaccaaggcagacaaatcacttgaggtcaggagctcgagaccagcctggccaacatggtgaaaaccctgtctgtactacaaatataaaaataagctgcaaatctcttaaacccaggaggcggaggatgcagtgagcagagaagtcaccactgtactccagcctgggcaacagagcaagactccgtctcaaaaaaaaaaaaaaaagaaagaaaaagacaaagcctcatctctacaaaaagtacaaaaattagctggatgtggtgacacatgcctatagtctcagctactcgggaggctgaggtaggaggatcacttgaccctggggaggttgaggctgcagtaatctgggactgcactactgcactccagccagggcaacagagccagaccctctctctacatagacagacaaatagatagttaggtagttttctttcttttctgcccttgtggagaggttttctggataggcacgagacttagttttaagtaaacttccccaacaggtgtcacaagttcaaaagaacgatcctgcgtgtgttcttcatcttcctccccatcttttccctttcactcaagagaatcttctatttttgtaccagtttcccctcctgccccttcttttttcctcttctttcttcctttctttcctttccttcctttccttccttccttccttttctttcttttttttgccagggacagagtttcgctcttgttgcctagtcctggagtgcagtggcgcaatctcagctcactgcaacctctgcctccagttcaagcgattctcctgcctcagcctcccgagtagctgtaattacaggcatgcgccaccacacccggctaattttatatttttagtagagatgggttttcaccatgttggccaggctagtcttgaactcctgatctcatgatccacctgccttggcctcccaaagtgctgggattacaggcgtgagccaccgcgcccagcaattttttttttttttttttttttggagacagagtcttgctctgtcatccaggctggagtgctgtggcaggatctcagctcactgcaacctctgcctcccaggttcaagtgattctattgcatcagtctcccaagtaggtgggactacaggcgcctgccaccatgcccggctaatttttgtatttttagtagagatgaggttttgcaatgttggccaggctggtctccaactcctgacctcaagtgatctgcccgtcctggcctcccaaaatgctgggattataggcttgagccactgtgcccctcctacccactcttaagaaggaaggacttccatttggctggtggcaggctaagttcacttttacaacaaagggatggagagtggggagatttttaaaactgcccaagcagcattttgcgagagatttgtaggttttggagagcagctttctgaagcagctgcaggcagactgtggaggcagttggaggagggcagtgaaccgtggaggcgggtggtgaacagatctgctgtgaggttcttggacaggtgcatggattgaagttgctgtctgatgactgttggccattgggcttgaactggtgatgctcaagaccaggcgagtgcgctgcttcatgaggctgatgctgtggataggggtcgagtgtgacggtcaggggtcagactccctgtgttcaaattctgaccttggataaatgacttaaagtctctggactttagtttcctactctgaattagagcccataggacctttctcctgttgttgaaagagaaaacacatacgttcttagcacaatgcctgctatgcagtaagcactcaaaaatatcatccttgctttaaacagggtgttggagaagacgatggagggccaagatgccccctttcggcaatctggtttgcatttttgtcaggaggaggggagtagcttccggtgtgttcccatgatcgtccagcctttagcgtcatcaacatctgcacgtttggatgcaacatggcaataaaggtggcaaaggggatgttgcctaactcccagtgaccgtgggtgggaacaaaagatgctaagaggccccacaatctaagttcagaggacttccacacccagctgtagggtcacttccccgtaccatcgccctaccctggctctttggaaggtctcagttcagtagaaacaggacccatgctcctctcccttccccacccatgaaagaccccactttgagttctcaattcctgaggagtaccaaccttgggtccttcccatgccctgatctagcagcctagatcagccctaggaccaatggaaggaccaaaggttgctcccagcaaacacctaaggcaaagccctttcccggccgggtgcggtggctcacgcctgtaatcccagcactttgggaggctgaggcaggcggttcacgaggtcaggagtttgagaccatcctggccaacatggtgaaaccccatctctactaaaaacacaaaaattagcagggcttggtggtgcatgcctgtagtcccagctactcaagatgctgaggcaggagaatcatttgaacccaggaggtgggggctgcagtgagccgagattgcaccactgtattccagcctggtgacagagactccatctcaaaaaaaaaaaggaaaaaatccctttcccatcccacttacaaggaagaggagaggtgttggtgaggcaccaggcacccctgcaccccaaaccctgctcatgagctatgagcatgccccttacctgcaccaccatgtagtagaggaggaagaggaagtagatgagctctgccgctaccacgaaggggtgccagccgtcggtgaaggggtacaggcggaggctctgcagggccgcgtgcgtaaaaaaggtgcctggggagcaaagtgcgttctgctcactctgggccacctggttgctcagagccatggcttctgacaggagccatcaggtcagatgactcaagctcaaccccctgagggctggctgtggccaaggaaaagccaaagttatttcagacccgaaggactgaacgtggacacgtggtagacaccgaagacagcggatgcaacagaaggggcggaggggctgcagtggaaggttctcccctcccctcggcatttgatgttggccttttgggcacagacacctccagataaagcacatccacccatataatgacaattgactcccacttggctcatttaaagccattttgggccgggcccaggggctcacgcctctaatcccagcactttgagaggctgaggtgggcagatcataaggtccggagattgagctcatcctggctaacgtggtaaaaccccgtctctactaaaaatacaaaaagttagccaggtgtggtggcaggcacctgtagtcccagctactcgggaggctgaggcaggagaattgcttgaacccaggaggcagaggttgcagtgagccgagatcacaccattgcactccagcctgggtgacagagaaggactgtgtctcaaaaaaaaaataaaaataaaaaaagatacacagg

SEQ ID NO: 112 - DNA, 33617 bp, Homo sapiens
taaggggatgctaacaacctattgttgctttctttatttctaaacaccctccccattttactccctcagaaactacaaagcacctgctgtatattgtacaggttaaaatgatgtcacatttaaattggatttttaaggctgggcgtggtggtttacgcctatgatcccagcactttgggaggctgaggcagaaggatcacctgagctcaggagttccaggccagcctggccgatgtggcaaaaccttgtctttactaaaaatacaaaaattagctgggcatggtggtgcgtgcctgtagtcccagccactcgagaggctgaggcacgagaatcgcttgaacccgagaggtggagatttcagtgaaccgagatcgcgccgctgcactccagcctgagcgacagagcaaaactccatctcaaaaacaataaataaaatacaaataaaaattgggtttttaactattttgtaacattgcttaaaggtgtggaagacactttggggtgttagaggaccaaggttgccatgattgcagtaatggtaacgaacactcagatgtcattggtgtcaccttcacagtgtcgtgaagtgctcttacattcctcgtttccgtggagggaaatgttagcattcctgttttccaaagtcccacatgtgaccgtgtggacaagtctagctgcttgtctgagggggtgtttgccttagcccctttttcaggcctcttaaggcctttgtaagtactgggccctagctgaaccccagcatccttaaagccctcttgagagagagagagagcaggtttggacaagccctgcctcgaggactatggcatgggtcagcttctggaagggcaactgtcggggacgcactttcccttgaactcagcaccatccaagccctgaatgtggcccagtcaccctgggcagaaaaaagacctcagccactttccccacagctctctctcctgccccttcttccccaggacaggagtccagagcatgtcccctacatgtgagacagcaggtgggtcttgggtgagaaacctctcactgcatatcacacagagggggaggttgtagtaagctgagatggcaccactgcaatctccacgcaagatgcagggagtctggctctggcgcccaggctggagtgcagtggcacagtctcagctcactgcaacctccacctcctgggttcaagtgattcttgtgcctcagcctcccgagtagctgggattacagctgcccaccaccacacccggctaatttttgtatttttcgtagagacggggttttaccatgttggccaggctgatctcgaactcctgacctcaggtgatctgcccactttgtcctcccgaggtgctgggattacagacatcagccaccacacccagcctcgtttctaccttttgactgttatgaatatgctgctataagcattcatgtacaaacttctgttttgtttttagggacaaggtcttgctctgttgccctggctgaagttcagtggtgccaccatagctcactgcagcctcaaactcctggtctcaagcgatcctcccatctctgcctcccaagtttctgggactacaggcgcttgccaccatgcctggctaatttttaagttttatgtagagatgtggtcttgctgtgttaacagcccacgctggtcttgaactcctgacctcaagcactcttccaccttggcctccgaaagcagtcggattacagacgtgagctaccatgcctggcccatgtgtgcaagtttttatatggacctatgttttcatttcttttgggaatatacctaggattagaatcagagatcatctggtatctctataatcttgtgaggaactgccacactgacttctaaaatggctgcacaatttacattcccagcagcagtgtatgagaattacgatttctccttatggttaacagcacttagtatctgactttcgcttctgaccatcctacagagtttgaagtggtatctcattgtagttttgattttcatttccctgatgacgaatgatgttgagcatcttttctttttatgtgcttattggccatttacacatcatctttggagaaatgtctattcagatctttgcccatttttaattgggttatttgtatcattgagttgtaagagttctgtatatattctgcatatactgggtcagatatatgatttgcaaaatgaggttttctcccattttgtgggttgtattttcattttcttgctggtgtcttttgaagcacaaaaggtactttttattatgactttaatctcttcacttgttttaggtttactcggattgtctatttctgcttgagtcagttttaatgattttctaggaatttgtccatttcacctaaattatataatttgtccacaggcaattattcatagtatttctttataatcctttttatttctgtagagttgatagaatgccctctctttcatttctgattctaataatttgagtctgattcttggccaatctagctaaaagtttgtcaattttgttgaccttttcaattaaccagtgtttagtttcattgatttttctgtactatttttttatcctctatttcattaatttcaccatattctttgttattttcttatttctatttgttttaggttcagtttgcttttctttgttccagtgtcttaaggtggaaggttaagttattgattcaagatctttctttgttaatatagtcacttacaacaataagtgttctaagtgtctaatcaccactttagctgcatcccgtaagttctggtgtgttgtgctttcattttaactcatttcaaattagtttctaatttctatttctattgtgatttcttctttgacatatttcttttctttttttttttttttttttttgagatggagtctcgctctgtcacccaggctggagtgcaatggcgcgatcttggctcactgcaagctcagactcctgggttcacgccattctcctgcctcagcctcccaagtagctgggactacacgtgcccgccaccacgcccggctaatttttttttgtatgtttagtagagacggggtttcaccgtgttagccaggatggttttgatctgacctcatcatccgcccacctcggcctcccaaagtgctgggattacaggtgtgagccaccgcgcccggccttctttgacatattccttttgtgatttcttctttgacatatttgtcatttagtagaatgttttttaaatttttacatgtttgtgaattttcaatagtttcttctgttgcctttttttttttttttttttttttttgagatgaagtcttcctctgtcaccaggatggagtgcaatggcatgaccttggctcactacaacctctgctcctgggttcaagcagttctcctgcctcagcctcccgagtagctgggactacaggcacgcaccaccacacccagctaatttttgtatttttagtagagatggggtttcaccatgttggccaggatggtctcgatctcctgacttcatgatctgcctgctgtagcctctcaaagtgctgggattacagatgtgagccaccacgtccggcctgtttttgttttttgtttgtttgtttgttttaagccctgtctatgggagccattggcaatccaagaacttttttattttatttttgaattatagagacgggagctcactatgttgcccaggctggtctggaactcctgagctcaaatgatactcctgcctcaagctcccaaagtgctgaattacaggcatgagccaccatacctggcctcttctgttgctttctaatttaattccattgtggtcagagtatgtattttgcataatttcagtccttttgaaatttgttaaggcttgttttatggctttaccatatggtctaccctggagagtattctatgtgcatttgagaataatatgtattctaccattgttgagtggggtattccgtagatatctgttatgtctagttggtttatactattgttcaaatcttctcttttcttgctggccttttgttttgttaattttatttattttatagtgacagggtctcccttggttgcccaggctgctctggaacccctgggctcaagccatccttccactgcagctacccaaaatgctgggattacaggtgtaagccactgaacccagcctcttgctcttctttttttctttttcttttctttttaatttttttttttttttttgagacagagtctcactctgtcacccaagctggagggcagtagtgcaatcacagctcacttcagcctcaacctcctgggctaggaagatcctcccatctcatcctcccagggacctgggactacaggcatgcaccaccacgcctgtctaattttggtatttttttgtagagatgggagaccgctatgttgcccaggctggtttcgaactcctgggctcaagtgatccacctgcttcagccccccaaaatgctgggattacagatgtgagccactgcacccaggatactgttctttttatctcgggttttgttttttcgagatggagtcttactccatcttgtgtgacttactcagatggagtcacacaggctggagagcagtggcataatcttggcttgctgcaacctctgcctccggggttcaagtgatcctctcacctctgcctcccaagtagctgggattacaggcaaacactaccacgcctggctaatttttatatttttggtagagatggggtttcaccatgttggccaggctggtctcaaactcctgaacttcagatccactggcctcagcctcccaaagtgctgggattacaggtgtgagccaccatgctggaccttccttatcttagttattctattcattactgaaaataggaaattgaagtctcaaactattcttgttaattaactatttctccttttgtaactgagtacccccatttttctaaaagatagtttattttaaaaattattttctcttcctttctccttccccactgctccccacttcctacttagccctttagaaatgcaaagagaggcctggtgagttggctcatgcctgtaatcccagcactctgggaggccgaggtgggtggatcacttgaggtcaggagtttgagatcagcctggccaacatggtgaaaccccattagcagggcgtggtggtgtgcccctgtagtctcagctacttgggaggctgaggtgggagaatcacttgaacccgggaggtgaaggttgcctaggtgacagagtgagactctgtctcaaaaaaaaaaaaaaagaaggcaaagatagtctttgacccctccttcaccagtcactccctacagggcaagttcatgtaactcctggagagttaagaaacagacttagagaccaaagcacgccccttataggactttcacctgggaacttccactctccagggattgcctgagagctcagtctcaccaggaggacatgttgaaagcgtgcccatggccacttttacaacttacttcttcccaggaaggtgccaactcagctgcccagtagataagacatcacgctcaaaaggagacccctgcccttgctggctgtatcccctacgtcttaaaagtgcccactttttctccagaagtgaagcggcacgtttaaagccagggcgctttgtgccccttccccaagctagaacttttttattttatttttgaattacggagacgggatctcactatgttgcccaggctggtctggaactcctgagctcaaatgatactcctgcctcaagctcccaaagtgctgataattcggaataaattcactttctttttggtaccagaccttgctcatggtaactgaaccctgcaatgcagcgagcaaccaacgtgcttttcagttacactttcagttctgtcagtgtttccttcatgtattttataaagggctctgttaagtgcatgtatgtttataattattatatcttccagatagtttggccctctgagtggaaaaaaactcagtttctttcacactgttctcacaacacgcttttttttttttttttttttagatagagactcacttcgttgtccagtctggagtgcagtggtgcgatcttggctcactgcagcctctgcctcccaggttcaagtgattctcctgccccatcctcctgagtagctgggattacaggcacgcaacatcaggaactgctaagtttttttgtatttttagtagaaacagggtttcaccgtgttggccagactgttatcgaactcctggcctcatgttctgcctgacttggtctcccaaagtgctgggattataggcatgagccaccgcgccaagctcgcaacacacttctgacaccagatgtgtgaggatttctccctacagcaagcaataatttctgcaggcagcctgcttccccttttgccctccagagccaggctccacaggagcccgagagatcctttaaaatgtaaatacagaccgggtgctgtggcactttgggaggatgacgcgggcagattgcttgagctcaggaattcgagaccagcctgagcaacgtggtgaaaccccatctctaccaaacaaaaacaaaaacaaaaacaaaaaaaattagctgggcgtggtgatgcacacctgcggtctcagctacttgggaggttgaggcaggagaatcacttgagcccaggaggtggaggttacagtgagttgagatcgcgccactgcactccagcctgagccacagagtgagactccatcttagaaacaaaaagtaaatgcaaccctgtctctcctgctcctgatcctccagtggctcctacccagggatgggctgtgcttcctccctggctgacatctatcatagaagaaagggcgtgagatgcttcatgacgagtaactcctggtttctggatatattcaaatacagagttgcctccttctcatccaggccacttggagatgagagcactgttgactttagtagcatctcctggtccccttgtaggttccagtctaggccttgggagagccaagaggacctcttgaacaacggctatcatcagaaagcttctgcacttcacttaccttctcccccagccatacccggcttcacattttctcctcctcttttgcagtcaatgcagaccctgcaggacttgctcactgatcttcatgcactccaggtcaccatcacagccctcagaaaagaagtggacatgctgaagaacatgcttgacaaggtaggccctcccccagcatcctccatgccagctgcgttgctcaggcctctgggggttggagcaatgaggaaaatctaggaagcttactgttaggccaagagtgcagctgtgagggtgtggtcatgtggaccctccaattggccagtgccaccgacttctctgtgacccctccatgctttcttttcttttcttttttttttttaagacagagtctcactctgttgcccaggatggagtgcaatggcatgatcttggctcacggcaacctctgcctcccgggttcaagtgattctcctgcctgagcttcccgagtagctgggattacaggcacgcaccaccacatctgggtaatttttgtatttttagtagagacaggggttcatcttgttggccaggctggtctcgaacttctgacctcgtgatccacccacctcagcctcccaaagtgctgggattacaggtgtaagccaccatacctggccgacccctccatgctttctaccccagtgtgttaaaacgttagttgtaagtgacagaaatcacgttcatcctggattaggcaaaataagggatttattgtctcatttactaaaaggtccagggacggccagatctaggtactcatgcaatacttatatttctttttttttttgagatggagtctcgctctgttgcccaggctggagtgtagtggctcgatcttgactcactgcaacctccacctcccgggttcacgccattctcctgtctcagcctcccgagtagctgggactacaggcgcccgcccccatgcccggctaattttttttgtatttttagtagagatggggtttcaccatgttagccaggatggtctcaatctcctgacctcttgatccgcccgcctcagcctcccaaagtgccaggattacaggcgtgagccaccacatccggcaatactgacgtttctcagtgaaactttcctcccagttggcttcattctcaggcaggtgctcctcaagtcttggcaacagcagacttatattccaccaacctagcaaaaagaaaacctcttccccttctggaaagctctgtccacatggaaagtggaataatcataatagtgcaggcatacatacaagctccttctgtacttctgtagccaaaaaccatcagccaagtattttctaacaccctaccatgcatggaaggacatggagtccccgagacatgaggcagctgtccccgtcacaactgatgagtcacagctggggtctgaagccagctctccacacccccaggtttaacaacttcccccaaatagtgtaattttctgtatcatcccggcttcacagatcagggcctgtatttgatcatcatggcaactgtgggagctttaggcatgggctggatggctcccatctaagcagaaagaacgctgttaaaagctgcatcatgagctactcaaaagggccccttagacaaagctgttggagaaaccatgccttctcggcggggcctggtgtctcacgcctgtaatcccagcactttgggaagccaaagcaggcggatcacctgaggtcaggagttcgagaccagcctggccaacatggtaaaacccccgtctccactaaaaatacaaaaattagctgggtgtggttgcaggcacccgtaaccccagctactcaggaggctgaggcacgagaatcacttgaacccaggaggtggagattgtagtgagccaagattgcgccactgcactccagcctgggtgacagagcaagactccgtctcaaaaaaaaaaaaaaaaaaaaggtggggtcggtggggcggcatggtggttcacgcctgtaatctcagcattttgggaggctgaggtgggcagatcacaaggtcaggagatcgagaccatcctcgctaacacggtgaaaccccatctctactaaaaatacaaaaaattagctggatgtggtggcaggtacctgtagtcccagttactcaggaggctgaggcaggagaatggtgtgaacctgggaagtggagcttgcagtgagccgagatcacaccactgcactccagcctgggcaacagagtgagactctgtctcaaaaaaaaaaaaaaaagaaaaaagaaaagaaaaacaatgccttattggcctgtctcttggaggtgtttttgttgttgttgttttgttttgtattctttttgagacggagtctctctctgtcacccaggctggagtgcagtggcacgatctcagctcactgcaacctctgcctcccgggttcaagtgattttcctgcctcagcctcctgagtagctgggattacaggtgcaagccaccacgcctagctaatttttgtgtttttagtggaggtgggggcttcaccacattggtcaggctggtcccgaactcctgaactcatgatccacccgcctcagcatcccaaagtgctgggattacaggcatgagccactgtgcccggccctcttggagattcttaatgtgcttttgctcattcaaggctctgggaagtcctgccgtacagaaacctgttgaaatgttttttatttatttatttatttacttatttttgagacaaagtctcactctgttgcccaggctggagtgcagtggcgccatctcagctcactgcaacctctgcctcctggattcaagtgattctcctgcctcagcttcctgatagctgggattacaggcgcatgccatcaggcccagctaatttttgtatttttagtagagacggtgtttcaccatgttggccaggctgctgtcgaactcctgacctcaagttatccacccaccttgacctctcaaagtgctggggttacaggcatgagacactgtgcccggcctgacatgctttcaagcccagcatttcccaaacttgtttgcccatggaaccctttcccactccttgggaaacactggatttggaacccgttcttccttctcaagctcttagtcacctagagccacgggaaaaggcaggggtgggacagaacctggacccccagtccacagactcagttcctttgacaggtacacccagaaagaatggacatctttgctgaagacttcaaaatacagaactggaagatggttgcactgcagcgggaagtggtgagggccaccatccctgtcttcccccactccccctgggaccccccaacctcccgggtcctgggtgctgagggtagggaggtgcaaggaggagaacacagcctggaaaggtttctttgcaggtgtgggggacactgccccctccaggctcacagccctcattttctacccccaccttgcaggcttctctccagaataagtttaaaaccatccccaaaaccgaggacatggtgctctggagtggccttcatgatgccatgttcacctcagtgagtgaggaaggaaggggaggttagcaggaagctggggagcaggcgggtggctgactgagagtgggaggcggggctggaagccagcagagcccctctgccccctcttctgcaggaaattggttcatcaccactggacctgtggcagtctgtagagcagctcccagaggctgccctggcccagaccaccaagtaccttgaagctactcgtgccatccaggtctccgagcccgtccaaaacccccagctactgcagactgtctggcattatgaggtcccagagctcctcccggagggctcatctgcccaagcagtttcactcagcagagcccaggagccagcgcagcctccggccctcacgcctgagtctgcacctgggtgcacaactgaatttgcacctgggcctgcacctgggactgaacctgtgccaggactggagctggggctggagctggagcctgtgcctgccctggggcctgtcccagggcccagtgtgacacctgggtccttgccagcaccttggcctgtgcttggacctgtgcctgccccaggtgcccagcctccaccactgggagactggcctgcactcccaagacgctggcctcttccccaaggctggcccagggtgggctcttggcctctgtgggacttaggtgtcctgcggccaactcagccccaaccctccagggccccaccaccagccactgagtttggctcattgtggcctcgaccactccagccatatcagtctcgccagggagaagccctccagctcgcagctgtccaagtaaagggggaggaaaatgatgtccccagcctaaggggccttcgggagagggcccgcaaggatggggcccccaaggatagaactcgcaaggatggggtccccaaagatagaggtggcaaggatgtggaccccaaggatagagctcacaaggatgatgtccccaaagatagaggtggcaaggatgtggaccccaaggatagagctcacaaggatgatgtccccaaagatagaggtggcaaagatggggaccccaaggatagagttggcaaggatggggcccccaaggaagcacagcctaaggctccccagtctgcccttcaccggctgaaaaccaccgctgccatcgccgccgctgccgccgcagcctacgccgctgccacatcctccgctgcccaggcagccaaagttgctgccaagtttgtcaaggatgccccagccaccaaaatggccgccattgcaacagacacggctgcagctgggcccctaggggtctttgcagatgtcctgggtgcagggccttcccggggagccacagaatcccagatcttgggcgatgattccgaaatctacgaaatcctctctccctcctactctgctgccagcatcggtcccgatccagccctgtcccaggccatggtggctaccaagcaggccatgagccctgaagacaagaagagggctgtcaagtattccatgagccacatagcccagatacctgtcaaacacgactctctgaaggaagaatttgcccagctgtcctgtaacctgaaccagcgcttgagttatctaggtaggcctggtctggccctgggaagggcacaagggagtggggctctccctgcagcctttgagaagtgtgtcctgtccttcactgggctccaccaacaaaatctgcattccaccattagccattctttcctttggcttaagcatttggctcttaacgagtctattcttttctgttgaatgtacaatgaggtcttatcttagggcagggaggctgttagggtctaaagttggcacgaggaaaatggcatgccaaaattactctcaaaaactcttgtggccaggcgtggtggctcccacctgtaatcccagcactttgggaggctgaggtgggcggatcacctgagaccgcaagttcaagatgagcctgaccaacatggagaaaccccgtctctactaaaaatacaaaatttgctgggcgtggtggtgtatgcctgtaatcccagctactcgggaggctgtggcaggagaatcgcttgaacccaggaggcagaggttgcggtgagccaagatcatgccattgcgctccagcctgggcaacaagaacgaaactctgtctcaaaaacaacaacaacaaaaaaaactcctttgtgatagcccataaaacagtattgtattggctaagcatggtgactcatgcctgtaatcttagcactttgggaggccaaggcaggaagactgcttgaactggaagttcgagaccaccctgggtaacatcaagacctcatctctaaaaaaatttttaaacactagctgtgtgcggtggctcacgcctataatcctagcactttgggaggccaaggcaggcagatacggagaccatcctggctgacacggtgaaaccccgtctctactaaaaatacaaaaaaattagctgggcatggtggcgggcgcctgtagtcccagctactcaggaggctgaggcaggagaatggcgtgaacccaggaggcgaagcttgcagtgagccgagatcgtgccactgcattccagcctgggcgacagagctagactccgtctcaaaaaaaaaaaattttaaacattggccgtgtgcggtggctcacgcctgtaatcccagtcccttgggaggatgaggcaggtggatcacttgaagtcaggagttcgagaccagcctggccaacatagcgaaactccgtctcgactaaaaatacaaaagttagccaggcttgatagtgcgcgcctgtaatcccagctacctcggaggctgagacaggagaaacactttgaacccgggaggcagaggttgcagtgagcagagattgtgccactcccgcctgggcgatagcgagactcctcctcaaaacaaaaaaaaaagcctgagtggtggcgcaggcctgtagtcccaactactcaggaggctgaggtgggaagattgcttgagcctagcagttcaagactgcactgggttatgatcgtgccactgcactccagcctgggcaacagagtgagaccttgtctccatacaaacaaaatttaaaaaaaaatttttttaattattgttattattttttgagatggagtttcacttttgtcgccggttggagtgcaatggcgtgatcacagctcactgcagcctccgcctcctgggttcgagagattctcctgcctcagccttccaagtagctgggactagaggcatgtgccaccaagcctggctgattttcgtatttttagtagagatggggtttttccattttggccaggctggtctcaaactcctgatcccaggtgatccacctgcctcggcctcccacagtgttgggagtacaggcgtgagccactgcacctgataaaaaaaattttttttaattaatttaaaaactaataggccgggtgcggtagctcatgcctgtactcccagcactttgggaggctgaggaaggcggatcacgaggtcaagagatcgagaccaacctggccaacatggtgaaaccctgtctctactaaaaatacaaaaattagctgggcgtggtggcgtgtgcctgtaatcccaggtactcgggaggctgaggcaggagaattgcttaaacccaggaggcggaagttgtagtgagccgagatcgcgccactgcactccagcctggtgacagagcgagattccatctcaaaaaataaattaattaaaaaataatgaagaaataaataaaaaggtaccacaagctgcgaggcccagtgcatttccactgggcagtgctgcctgagatgctccataagagaagcagctagagcccaacagaaacatcttcctccatccgagccctcagcagccaccctgtcctctgctttcagccaatatgggaggtccttccagcctcgggacaacagtggacatattgcagaaaaagattggcagcctccagaaatctaggctcaaggttagtgtctccggcgaagggcttttgaggcagtgatggcttgaggtgagctggctgaagactccttgactctgcccccctcccaggtgcagctgtgttctgcagcaaaacaggctgggggaaagcgagctggctgcgaaggcagctgctgcctctcaaagctgattcactggtgcggtgggggggcccagcaggtgtggggctacacggttctgtgtctcaggtggctgttcagagggcaggtgaagccggtgcggtggctcatacctgtaatcccaacgctttacaaggctgaggcaggcagatcacttgagctcaggagttcaagaccagcctgggcaacatagtgagatcccttctctgcaaaaaaatacaaaaattatccaggtgtggtggtttgtccctacagtcccaactactcgggaggctgaggtgggaggatcacttgagcctgggaggtggaggctgcaatgagccaagatcacgccgctgcactctagcctgggtgacagagcaaggccctgtctcaaaaaaaaaaaaaaaaaaaaaaaaaaatggcaggtggaaggcaccctggtctgataccttatttttttttttttttgagacggaatcttgctctgtcatccaggctggagtgcagtggcgtgacctcagctcgctgcaacctctgcctcctgggttcaagcaattctcctgcctcagcctccctagtagctgggattacaggggcccgccaccacacctggctaatttttgtattttttgtagagactggtttcgccgtgttgggcaggctggtctcgagctcctgacctcagttgatctacccatcttggcctcccaaagtgctgggattacaggcatgagccaccacgcccagcctggtctggtacattcttcttggcctcaaccctccctcaggccccttcccggccatggtaacttcagaagcagaggcctggggtgtctgtgtctcccccttttaggaggaagaacttgagagaatttggggcaaccaaatagagatgatgaaggatcgctacatcactttggacaaggcggtggagaacctgcagattcgcatggatgagttcaaggttaggaggactgggtaggctggagaagggctggcaaagggagaattcctcacctagaccttctggcccttcccgaaggttctgcatgaggtggggatgcacttgaggctgggaaccagtggggctttactggcattttactgtgtgtaaattacacttcaatgaaaagcaaacgaatcccaccacccccccccacccatataaacagaagggccgggacaatgttcgtctttttgaccactgcgtcacctgcccctggaagggcaggggtagtgaaggctccatcacatttgctgaatgactcagtgaatgattaagagaacttcttgtgccaactgttacattcttaacatttccctgagccaagaggtagaaatatttactgacattttgggctgggtgataaaaataaaaaaataataataaaaagaaatatttaggctgggtgcggtggctcacatatgtaatcccagcgctttgggaatctgaggtgggaggatcacttaagacaaagagtttgagacaagccagggtaacacagggagaccccatctctacacaaataaaaaatttagctgggactgggcgcggtggttcacgcctataatcccagcactttgggaggccgaggtgtggtggatcacttgaggtcaggagtttgagaccagcctggccaacatggtgaaaccccgtctcttctagaaaaatacaaaattaggctgggtgcagaggctcacgcctgtaatcccagcactttaggaggctgaggtgggcggatcatctgagatcgggagttcgagaccagcctgaccaacatggagaaaccctgtctctactaaaaatacaaaattagctgggcgtggtggcgcatgcctgtaatcccagctactcaggaggctgaggcaggagaatcccttgaaccggggaggcagtggttgcggtgagccccgatcgtgccattgcactccagcttgggtaacaagagcaaaactctgtctaaaaatatatatgtatacatatatatatatatatatatatatatatatatatatatatataattagccaggcgtagtggcacacacctgtaatcccagctacctgggaggatgaggcaggagaatcgcttgaacccgggaggtggaggttgcactgagctgagattgcgccattgcattccagcctgggcaacaagagcgaaactctgtctcaaaaaaaaataaaaagggccaggcgcggtggctcacgcctgtaatcccagcactttgggaggctgaggcgagtggatcacgagttcaggagattgagaccatcctagctaacgtggtgaaaccccatctctactaaaaatacaaaaaattagccgggcgtggtggctggcgcctgtagtcccagctactcaggaggctgaggcaggagaatggcatgaacctgggaggcagagcttgcagtaagccgagatcccaccactgcactccagcctgggcgacagagcaagactccgtctcaaaaaacaaaaacaaaaacaaaaaaacctagctggatgtggtggctcatacctgtgatcctagtactttgggtgcagaggcttaaacctgtaatgagggaggattgcttgaggccaggagttcaagacttggccaacagaagaaaactgtctctacaaaaaaaaaattataaaattagccaagcgtggtagcacatgcctgtagtcccagctacctgggaggctgaggtgggaggattgcttcagcatgggaggttgaggctgcagtgagctgtgactgcatcactgactccagcctgggtgacacagaaagaccatctcaaaaaaagaaagcaaagaaacaagcaaaaagcaaaaaactcactaacggccaggcgcggtggttcacacctgtaatcccagcactttgggaggctgaggcaggcggatcacctgaggtcaggagttcgagaccagcctggccaacatagtgaaaccccgtctctactaaaaatacaaaaattagccgggcatggtggcggatgcctgtaatcccagctactcgggtggctgaggcaggagaatcacttaaacccgggaggcggaggttgcagtgagcgaagattgcgccattgcactccagcctgggcgacaagagcaagactcagtctcaaaaaataaataaataaataaataaataaataaataaataaataataacccaccaaggttgtttccgtgaaggcttccaagtcggggggctgttgctgggatgcactggggtgtgttgggggaaaagggaccaaggaaacccatggcgtatggctgaccccaaggctggcacactgtaatcaggctgggacccatttgaggcaactttgaatggaaaataactcattaaaggggaaccaattcacagcctatgaagtgggggtggacaggagggttggctgtctctggagatgctgggccgagtgtgggtggactgcatgcaggggtacgtgctcagactgtgcaccactggccaggaaccaggtctcctgccaacactcctcttcagagagacccaggccaccatgtcctggggtcatcttggtgccctttctccatggagctggagccagttccattcagcatgtccatcgtgcacccagcactacgccagaccctgcatgggggtgagcaggggctgcagtgtctgcctgcgtgtccgtagttgtcacttattagaaagactctgaagctgatgaagccctgccacgtgtgccaaaacagagcacatcccttgtcccaggaccgttgtcccagcttcctggctcttgtgctatgaagatttcattgctggccaggctcggtggctcacgcctgtaatcccagcactttgggaggctgaggcaggcggatcacctgaggtcaggagttcaagaccaacctgaccaacatgatgaaagccgatcgctactaaaaacacaaaaaaatcagctgggcgtggttgcgggtgcctgtaatcccagctactcgggaggctgaggcaggagaatcgcttgaacccgggaggcagaggttgcagtgagccgagattgtgtcattgcactccagcctgggcaacaagagcaaaactccatcttgggaaaaatctcagcactttgggaggccaaggcaggaggatcccttgaggccaggacttcaggacgagcctggacaatacggcaaggccccatcgctaaaaaaataaaaataaaaatattagccagatgtggcagcgtacgcctatagtcccagctaccagggaggctgaggcaggagaatcacttgaacccaggaggtggaggttgcagtgagctgaggtcatgccactgcactccagcctgggtgacagagtgagactctgtctcaaaaactaaagtaaactaaaatacagtcttaggattttgaaccacacaaatggtttgtattaccaatagttaaagaagaaaaataaaaaataatgtagaacaagtgtgggaataggcaaatcaataggccaagaagactgggcatggtggctcacacttgtaattccagcactttgggaggccgacatgggcggatcacttgaggtcaggagtttgaaaccagtctggccaacatggtgaaaccgtgtctctactaaaaatacaaaaaaattagccaggcgtggtggcgcatgcctgtaatcctagttacttgggaggctgaggcaggagaattgcttcagctcaggaggcggaggctgcagtgagccaagatcgcaccactgcactccagcctgggcgagagagcaagactgtatctcaaaaaaaaaaaaaaaaaaaaaaaataggccaagaagaccagatctaagatttacaagaatttagcatatgaccactacaggaaggatggattactccacaaccagtgttaggaaaaccatttcaaggaataacagtaagtcttaagtccgatagcaatcctctagatgacacaaggcagtagcacggtgacaaatgcaggatgggagcaagatctcatgactgtgtctctgtcttgctctccaccatgtgacttacatgtaagacttaggtttcccagtgtcgttttgggtcttgctctgtcccccaggctggagtgtagtggcctaatcatggctcagtgcagccttgaactcccaggctcaagtgatcctcccacctcggcctcctgagtagctgggactacaggcgtgtgccaccatgcctggctaatttttttttttgagatacagtctcgctctgtcgcccagcctggagtgcagtggcgcaatcttggctcattgtaacctccgcctcccgggttcaagcaattcttctgcctcagcctcctgagcagttgggactacaggcgtgtgccaccatgcctagttaatttttgtggtttttttggtttgttttttgtttttgttcgaggcagaatttcactctgttgcccaggctggagtgcaatggcgcaatcttggcttactgcaacatctgcctcccgggttcaagtgattctccttcctcagcctcccgagtagctggggtaacaggcgtttgccaccacactcggctaattttttattttgagtagagacagggtttcaccacattggccaggctggtcttgaactcctgacctcaggtgatttgcctgcctcggcctcccaaagtgctgggattacaggcgtgagccaccgtgcccagccaatttttttgtatttttagtagagatggggtttcaccatgttggctaggctggtctcgaactcctgaccccaagtgatccacccacctcagcctcccaaagtgctgggattacaggcattagccactgcgcccagccaaaataataagattataaaacatgaatatagcctggcatggtggcttgcacctatagtcccagctactggggaagcagaggtgggaggatcactggagtctgggaggtggaggttgcagtgagctgagctcgcaccactgcattccagcctgggtgacagactgagaccctgtctcaaaaaataaaaataaaaagcataaataaggccaggtttgatggctcttgtaatcccagcactttgggaggctgatgggggaggatcctttgagcctaggagttccagatcagcctgaggcaacatagtgagacccctgtctctacaaaaaaaaaaaaaaaaaaaaatccaggtaggtggtgtcacctgcagtcccagctcctctggaagctgaggcaggaggcttgcttgagcctggaaggctgagactgcagtgagctgtgatcaagccactttactccagcctgagtgacagagcaagagcctgcctcaaaaaattaaaataaaaaaattaaaattaaaataaagaggaggtaacagagactcagcaaagaaacgagcccaagcctgctgggctgggagggggcctggagtggctgtggttcagagcccaggctttggaacagacgtgcctaggtttgaatcctgattctgccacctgctggttggatcagttccctgcggttgctgcggcaaatcactcttggggttctggaggcgggaattctgaaatcaaggtgtcataggctgtgttccacctgaaagctcagaggggcctcctcgcctctcccagcttctggtggttcaaggtgtcccttggctttggagcaacttggatggaggccggggtcattattctaagtgaagcaactcaggagtggaaagcaaagactgcatgttctcacttgtaaatgagctaagccataggtgtgaaaagacagaccgagcaggataatggacacaggagactcaggataatagagagagggaaggatagaaaactacatattggagccaggcgcggtggctcacacctgtaatcccagcactttgggaggctgaggcaggcgaatcatttgaggtcaggagttcgagaccatcgtaaccaacatggtgaaaccccatatctactaaaaatacaaaacttagccaggcgtggtgttgggtgtcagtgaccccaactactcgggaggctgaggtgggagaatctcttgaacccgggaggcggaggttgcagtgagccgaaatggcgccactgcactccagcctgggcgacagagcagattctgtaaaaaacaaaacaaaacaaaacatgttaaagatacccattcacttctgttgacaccccagtggccacactaagctataagagaggctgtgaaatggagtcttgattctgggcagctgggttccagctaaaagtccagagttctgttcgtaagcgtgagcgggacacccgacaggaagagagaagtagaagcctgtttgcagctttgcaggaactatggcccgaccctctggggaaatggaggctcttcccaagctgaccagctgctgctcctattacaatggggatgtagtaattggagagagggtggaattcatgggggcagttggttctttgtggagttgtggggataggacgtgaggtttttccctaacgcttgagcacagtgtgtgtggctgtgataagtgctcagttcatagtagactggagttcctgctgggaccccaggacagatcagaagtagtaaacatgccttaaacatccagggagcgaaatcgtccacattggtttgtgctttccttccttgggtctaactccccgtggaggaaagttcctatgataccatctctgaggggacagcttgtcccaagtcgcacgttccttcccttttcatctgggcacctggagcccttgagcctgagtcttgtaacgcccatgcccacctgcctgctgtccacacggcctgctatccctccccagcatatggtaatggtagaggtgggaggttgacattttatcctcaaggctctccaggatggcagacatgcctgtgcttctgttcttagactctccaggctcaaatcaaaagactggaaatgaacaaggtgaataagagcacgatggaggaggagctgagagaggtgagtgagcagaggttcctctgccttccctgctcccctacccagggaaacggcaccatccaggcaaagcccaccaaagagtcttccagaatttccctccccctttgttcatattgaaaccaggagttggctgggcgcagtggctcatgcctgtaatcccagcactttgggaggccaaggcgggtggatcacctgaggtcaggaattcgagaccagcctgcctggcctacatgatgaaactccgtctctagtcaaaatacaaaaagtagccaggcgtggtggcaggtaactgtaatctcagctatttgagaggctgaggcaggagaatcacttgaacctgggaggcagaggttgcagtgaaccaagatcatgccattgcactccagcctgggcaacaagagcaaaaactctgtctcaaaaaaaaaaaaaaaaaaagaaagaaagaaaaagaaagaaaagaaaggaaaacaggaggcacatcaactcccattttcagcaattgaggattattaacactctacttgaaaatcacacatcagctgtgcacagggtggctcatacctgtaatcccagcactttgggaggccgagaagataggatcacttgaggccaagagtttgagaacagcctgggaaacataggaagatcacatctctacaaaaaaataaaaaaatgaactgggcatgatggaacatgcctgtagtcccagccactcaggaggctgaggtggaaggatcccttgagcccaagaggtggaggctgcagtgagctatgattgtgccactgcaatccagcctgggcaaccttgaacaagatcctgtctcaaaaaaacacataataataaaatacatcaacttccctgttataggaaaaccttggctttgatctcgagatcgtgtttgaatccacgtagaccccagggttgcatttaagccaaggctaaaagtccagagtcccaaactagaagcatcagacccaaggggtgtgatgtctcccagctttgccttcctccatcccagcagccatgcctccctgaactccctgtctccctagaaagctgacaggagtgccctggcaggcaaggcaagccgcgttgacctggagactgtggccttggagctgaacgagatgattcagggcatactcttcaaggtcacgatccatgaggacagctggaagaaggctatggaggagctcagcaaggacgtgaacaccaaggtgaatgcccccatgttgattttcactttattcctaacaaattaacccagaacttagcaactgcaaacaacaaacgttttcagtttaggaggagcaagaatttgggagtgacccagcaacttagctgggtggctcagggtttcctgtgaaattgcagtcaagatgtcatccagggctggtctcatctgaaggctcgaatgaggctggatgagccaattcaaagagattccctcacatggctgttggtaacactcttcagttcctcatcccatggactctgcctttgggccacttgagagtcctcatgacattgcagctgacatctcccagatcaaatgatccaagaggggaaggaagaagcagcaatgtcttttttttttttttttttttttttcatacagggcctcactctgggcacctgccccatacatagtcaataaatgaattgatccccatttcacagaggagaacactgagcctcagagaggttattatacttccctcaggaaacgctgctgctcatggtggagcttgagactcaaacccagagctgcctgattctaaacctaatttaacctctttgggccagtccagccacctcagttgcaagaaccatgtagcactgttgttggaccaactgttccagtctactatgaggaaggggctgtgactcctctagacacttccccggggtctgacacatcactggcagtcagtaaacgatgaatgaataaatgaatgactgtcacagtccctcagagactctcctcctccaccccacatccctgcacttacgcagccaggagagtggcatagttagcctccagggcggtcgccaaccatacctcttggtattcacacagttgtttagccccctcccacattgaatgggaccagcttgtgtaacctacaggatattagagagatgatggagggtgaccaccttccatcataaaagacattgcagccagttgtggtggctcacgcctgttatcccagtactttgggaggccaaagcaggcagatcacttgagcccaggagttcaagaccagcctgggcaacatggtgaaactctgtccccctaccaaaaaaaaaaaaaagccaggtgtggtggcacatacctgcatttccaactactcaggaggctgaggtgagagaatacctgagcctgggaggttgagactgcagtgaaccaaaatcgtgccactgcactccagcctgggcagcaggagcaccctggcaggcactcagagtgaaaccctatctcacaaaaaaaaaaaaaaatgggcgcagaacaaccaaaagcaacacatgaagagattttacttgtttcctggtttaattgaaccacatctacaaatgggctggagatgacatccaattcaggaatagttgctaattgtattaaacatgataatagtgttgtggttatataataaaatgttatcacactcaaatatttattagtgaaatgtcaccatttctgtaacttaaaaaaaatactccatcggctaggcacggtggctcacgcctgtaatcccagcacttcgggaggctgaggcgggcagatcacgaggtcagaagattgagaccatcctgaccaacacggtgaaaccccatctctactaaaaaatacaacaaaaattagccaggcctggtggcgggcgcctgtagtcccagctacttgggaggctgaggcaggagaatggcctgaacccgggaggcagagcttgtagtaagccgagatagcgccactgcactccagcctgggcgacagagcaagactccgtctcaaaaaaatactccctcgggtggcacagtggctcacacctataatcccagcactttgggaggttgagatgggaggatcacttgagcccaggggtttgagaccaatcctggcaacatagagagactccatctctactttaaaaaactatttttggccaggcgcggtggctcacacctgtaatcccagcactttgagaggcagagatgggtggatcacttgagatgaggagttcgagaccagcctgaccaacatggtgaaacactgtctctactaaaaatacaaaactagccggatgtggtagtgggggcctgtaatcccagctactcgggagactgaggcaaggagaatcgcttgaacccgggaggtggaggttgcagtgagccaagatcgcaccattgcactccagcctgggcaacagaagtgaaactctgtctcaaaaataaataaataaataaataaaataaaagtaaataaataaggccaggtgcggtggctcacacctgtaatcccagcactttgggaggctgaggcgggcagatcatgaagtcaggagtttgagaccagcctggccaatatggtgaaaccccgtctgtactaaaaatacaaagattaggctgggcgtggtggctcacgtctgtaatcccagcactttgggaggctgaggtgggcggatcacctgaggtcaggagtttgagaccagcctggctaacatggtgaaaccccatgtctactaaaagtaaaaaaaaaaaaaaaaaaaattagtcgggtttgggggcacacgcctgtaatcccagctacttgggaggctgaggcaggagaattgcttgaacctgggaggcggaggttgcagtgagctgagatcacaccactgtactccagccagggcaacaagagcgaaactccctctcaaaaaaaagccaggtgtggtaacacgcacctgtagtcccagctacttgggaggctgaggcagaagaattgcttgaacccgggaggcggaggttgcagtgagcagagattgcaccactgcgctccagcctgggcaacagagcgagactctgtctcaaaaataaataaataaaattaaaaataaataaataaatacgattgattatgatggtcacacaactctgtaaatatactaaacgccataaacctgcccactttacatacagaccgtcaataaacatgtgttgagtgtgtgaatgtcaggtgcagtgggaccattgccagaaaggtgtctcagaccgcccagcctgcagctgagcttggtttgatttggtcttttgcagacagtagctgatggtgttttttgcttctgctgctaggaagctcaccttgcagctcccctctaccaatagcatctagtaggggttgagcctcatcgaagctgtgtcattttccctttcctggactccctcactattttagttgaattttgttacaccgtgtaacttcccaggttgctgcaaccctcttctggaaggaggcagggtgtgaattcatagagtattctttcttatcttccccttggctgttggcagttagtccacagtgatctggatcccttgaagaaagaaatggaagaggtctggaaaatcgtccggaagctgctgattgagggcttaagactggatcctgacagtgctgctggctttaggaggtgagtgcccgcccgagcccctcctggtaggggtcctgctgcccaggctgtggggaacacaccctggaagctctgggaggaaagattccagacctttggatgaggggatgggggcttggctgtggctgaaagcactgaggaggagggaagctctggcctgagctggcagaggtgatccagccctattcctgccaatggggaaaccaaggctcagagagggaaggggactgggcagatccaggacccctgacccccacccagacagtgccccaggcagagggacccaatatttatggggctcctgtcctcagaccacccctcacacagctttaaaaaccatccgttgtgtttggggcggcagagaaaccacaagagtggttggagactgcagggcctgtggggctgagctgggccgggcactggcaggagggatgcagccctggggctctggctggctgcagcctcccacacatggcctgggcccagcaggggcagcggctgatgatcatgtgcctttcaggaagctgttcaagcgcgtgaagtgcatctcctgtgaccggcctgtggagatgatgactggcccgtgagtaccaccgcccagggtgccccggccctaagggcttgtggggcccatggaggtcatctccgtgcacctccatgtgcaccgttccatgcacgctgtgtgtctacacatccatatacagcattctctccagccatcaagtccatacacgcccacatgcaccattctctatgcaccaggtatctacacatccacatccactgttctgtaccgtcaagtccatacacatccatgtacactgttctgtatgtgccatgtgtatccacattcatatacagggttccccagccttcaagatacacatgtccacatacactgttctacagccatcaaaaatatacaaatatgcggccttgtatgatagcgcctgcctatagtcccagctactcaggaggctgagatgggaggatggcttgagcccaggagttcgaggctgtagtgagctaggattgtgccactgctctccagcctgggtgacagtgagacctcatatcaaaaaaaaaggccatgttggcaaggctggtctcaaactcctgacctcaggtgatccgcccacctcagcctcccaaagtgctgggatcataggtgtatgccaccgcgcctagcctggtttttacttttggaaatagaacaattgttttttgtgtcttactgtgatgatcagaggtcctgagatgcctttcgggggggccccttctacttctatgctgtggacgcttctggcattcgagggtggtgacctgagtctgcacctccttcctcctgctgggaaggcttcctggaggggtgggagacgagccctctgctggcctagcacgcctcccacagcccctgctgtgcccttgtcctccaacagacagctgatcaccatccgcaaagcccacctgctgtcccggctgcggccagccagcgccaacagctgcgagtacttgcagcggcaacagatgaggtgagcaggatgggcgccccgcagggaggccgccccgcatggaggccactctggagcctgggaaccctgttcctgcagagacacatcctccaggcccagggacctaagattgtcctggacatggccagcccttcgcaagacaggcactccgagaggtggctggggcggcagacaggcccacgagatgatggcggagggaggaactgacatatttactgcacatctattgtgggccaggaactgttagacggtttcttatttaaatctcacaaccccctgtgagctagggttcctatgcccatgtccctgtttcttggcggagggaatcggtgatgatggggaaccctcagggagccgctgctgtgcccggcaggcactgtgccaagcgctggggctcacctggccttgttgagtcctcacagctgccctctaagatgtatcctggtaccatcccatgtcacagttgaagaaactgaggctcagagaactgcagtgacctgcccaaggtcactgctagcaagtccagggctgatgtccaaaccctcaggtttccaccgcacccagctggctccctgggtgccagccccacccctcaacctcctgacatcccacagctctatggatctccccagcctccaaccctgctgtggggacgtctggccaggtgggggaagaaccggtgaatcgtcaccacagccgtgggaaggggagggacgtgggggcctgtgctgactctgccaccctccctccctggctccttgagatcaagagattagaaggacacgctcttcaggccaggggtccaaagggaaatggctgggtctggggaaatgcaggtctcaatttgattcctctgccccactgtgtgtgtctgtatccatccgccaggccccaggcctgcctggctgtgccagctaaacacaagctgaaagaaatgctggtcttccctcgatgctggccaggcccttggggcccgtcctgggctctggggtacagggtctccaggtcgctgctgacccactgccctgctgcagggaacagcagtggctgcagctccaggacctcggtatccaggaggattgtcagcaggactggggtgatggcccccaaaacgccaccagcctcaagtgcaagtcctgcaacctgttgacgctctatccctacggggatccccacgtgatcgactatgacagcgtgagtctggccggggcctccttctcagagggtggacgtcagcgcaccccagccccaggtgtgggaccaggcactgagcagtgggcaaccccagcagaggctgcactctgtctcctgggcttctgcgtgtaccaaagttcgggggcagatcgggtcgggggctccctaacccgggacctgggccatccaacaggccgaggtggacatcctgggcgtggatgggatcctgtacaaaggccgcgtgaacagccagcgtggggctcagcccttggccgtcgcaaaggagctggcaggtgaggggcgtagggctccctggggcacccttgcctggggccctggttctgctgggcagggtgagagggtgcaggtggggcccagagccagcactatccctgaccggggagtcctcacacagtcagtcacaaaaattgggtcacagcaggcccccaggagactcagtctttgcaatgggggagggagaccgcgggagcgaggatctgctgttcccgagatcaacagctgaccagagagagggccgtggccacaggaccatggcctgtgacgaaggacgatgagctaggaaaggtgctgggctggtgccaagggacgccagtccacggaggacggactggacagctgccctgaagcccttgaagagggactaggacttagctggatgaaggggtcgggtgagaggagagtggtcgtgtggcaggaacggtgggtgcaaaggccctgtggtgggtggaagccactcacaggcaggagctcaggacgccgagtctccctgaagggtggagactggggtggggcagtggggtgacaaggaggagacttgggccagaccccagaagctgtgtgttaatatcacaggcaagggttgggccagcgggagacccagaattgtgcacatctggaatcagtcaatgtggttgctgcagtgctgaggcccggctctggccggctcctgctgggaccccaagactctggagtccatcactgggttcgaaggacaaaaagaggagccttctctgcacaccccttgaaggctcttcccccttggggatggggagttctaaattttgcccctgggtgggagctacacgccgccccataaggagcagtcccggagccacaagatggccggggcctgaactccacctgcagaaattctggttttttgttgttgttgttgttgttgtttgtttgtttttgaggcggagtcttgctctgtcgcccaggctggagtgcagtggtgcgatctcggttcactgcaacctccaactcccgggttcaagcgattctcctgcctcagcctcccgagtagctgggataacaggcacgcaccaccacgcccggctaaatttttgtattttttagtagagacggggtttcaccatgtttggcctcaagtgatccacctgcctcagcctcccaaagtgcaaggattacaggcatgagcctctgcgcctggcccaccggcagaaattctttcttgccaacgctgtgcctccattgactcgaagaccagacatggaagaagggaagggggactgtttcatcaatgtgctgggcaaaggaggaggcaccctgattcgtctcctggggttgccgagacaaattaccacaagcagggtggcttaaagcagctgaagttccttcattccccggcccatgtagcacgccgtcccattggccgggcacggtggctcacgcctgtaatcccagcactttgggagaccgaggcgggcggatcacaaggtcaggagttcaagactagcctgaacaacatggtgaaacctcgtctgtactgaaaatacaaaaattagccagccatggtgacacacgccgttaatcccagctactcaggaggctggggcgggagaatcacttgaacccaggaggcagaggttgcagtgaaacaagatcacgccactgcactctagcctggacaacagagcgagacttcgtctcaaaaaaaaaaaaaaaaaacagctgaagttccagctgggcaacaacaaattagctgggcatggtggcgtgcgcctgtagtcccagcttctcaggaggctgaggcaggaggatcgcttgagcccgggaatttgaggctgtagtgagccatgatctcaccactgcactccagcctgggcgacagagccaggccctgtctcaaaaacaaacaaacaaacaaacaaaaacagaacagaacaaaaccaaacaacaacaacaacaaaaacaaaatacagccagagttgatcctcccgctgtcctggaggctggaaatcctaaatcaaggagtcagcagggctgcactccctccaaaggcttgaggagggtccctccctgtctcttcagcttctggggccgatggcactccctggcacttctctgtccccatgtgagcttctcttctgtgtgtcctctcctctgtcccccataaggacatttgtctttggatttgtgcccgacctaacccaggatgatctcatctcaagatccttaagctaattatacctgcaaagaccctttctccaaataaggtcacattcacagcttctaggagatgtatctttttggggagcacattcaacacaccctgtttccaggcgggccagacaccgtctcaaaccctgcattctcctgggcgggatgtggcttctcctcgagaggactggccgttccagcccctgccccctgcctggtatctgctgggagggctcaggctgggcgtcagggatcaccaggcaggatcacaacggtggctaatatttaatgaaccccgacttcgtgccaggccctgccccacctccttcaccctccaacaacctgccaaggagtttcacaaatgaccagctgagtgagggctgcttgccgggcggccagggcagatggagtccacatctgatgcacccagtcctgtccccactcattcactggcctccccaagggctgtcatctagagggaggggctttcccccttggctcattcattcccaagacccacacagcaagccaggacttgaatcatgatggcgtcaactgcttcatcttttttttttttttgagacggagtttcgctcttgttgccaaggctggagtgcagtggggcgatctcagctcactgccatctcaacctcctgggctcaagaaatcctccctcttcagccttccaagtgactggaactacaggcgtgcgccaccacgcctggataatttttgtatttttagtacagatggggttttgccatgttggccaggctggtctcaaacatctggcctcaagtgacccacctgtctcagcctcccaaagtgctgggattacaggtgtgagccactgcgcccggcctcatgtaacttattgactactatatattacattgaaattgtgacggatttatagcatcttaaagctgaaaagtggtaagtcaaaccatcataaatcagggaccttctgtattagaaatcaattggaaacctgtctgtggccagatcttgatca

SEQ ID NO: 113 - DNA, 34010 bp, Homo sapiens
ctataaatgagatagaagcaatctaagaaacatgtagtcatcttcttctctcaggttgtctggttctctgtcctgcagctagtcagtttttgagtcagtgacacactggttccttattcagagtaaggcaggaccaaacctcggtgctatgaggttcctgccttcctcactccaccaaggatacatttctgggagcacctggttggtaactacaccagcagtctgatggcaaagtctgctggagaaggttgagaaccaatccctttaagagcagtggttcccagctgggaatgactttgttcctcttggagacatctggcagtgtctgagacatctttggttttcacagctaggagtttgtgctctggtgggtatgagccagggatgctgcttgcatcccataatgaacagggcagctcccacaacaaaaattatccaacccagaatgtcagcagtgcaaattgagaaaccttactttgcagagctctcagagagcaggccggtggtggagaacatgaagttgatgggagagtgcattctgaaatcgggagtgtgagtccacctgggagtccctaaaggggagtcagggattatcaaaggtgcacttgaggccctggccagtatacctgtagtaaacgggaagcagcagttctggcttcttcttttcctgtgggggcaggatgacactttgatcctcaaactctgctgtctcttctgcctccagctgtttcaggagctccaggtcactggcagaggtaagctcatcccgaatgtgactccagtcgtactgctggcgcaggaagctctgccacttgttgggggatgccccaggccttcgaggacgcttgctctggatccatcgggctgtgcgctcgttcagcttttccagcacagtggcctcccacgctctggcctccttctcaggaggcagaagccaggcttctctttcctccaggttcacatctagagaaggtggccgacccagcatatctggatgcatgcagggatgatggatgagagggcggggtgcttcccggacggtgctggctggctttgatttcttcagcttcttttcgggattggcagagctttctgtcttcacagccagggaggtgtctcctgttaagggacttgaggaacccaggaacttgaagctaacaggtttctgaggccgggccttcctgatctggggagtatggatgatgtcattggtattgtagaggtggtcaaagctgtactggctataaggaatgctgggcaggcctcgctgccacaccacctcctgagagaaggtaaggtttgcagcagccattttcaaatattggctcttgcggtgtagacggtactgtgagctgaagaagaccataggcacactggagacagaggcacactcctccttgcctttcaattttgagtagtttaaaatcatgccccatcccagtcgtgggggcagtgactgatagaagcaatgggggagaaaggtctttcccttctgggtcctggtcataccgcgtcccagcaaatgcttccttccacactgcctggcctagaggaaaggcctggagatgagacctggcacctgttaagggaatgggaggaactgatgagaactctagagcagcagaaattggtagcccatagcagttcagaaagagaataacttgaaaaacagatggaaagggggtggggaagagccatgtgagttagaagaacaaaagaagaaaatggtgcaacatcctaaatatttcatgtatcagacccgtgtttttggttcttatacttgttcccaaagctcagaccctcatctccgtgtgagggatgactgcttttcagcagtatcccatgcttccagtttgtctttaaatgttgctttctttcattcaaaaggcttatagtgtaaagttcagactattcagcatggcattcagggttctccatgagtttggcctcagtttatgactttgtcctggcatgtaacctctgcttgagccagtccagtctcctggctgttctctgagtatcctctctccacataatgaagcttccttctgtgtcctctacatgaaatggcctttcgtacttgacacaaattctatccaatttccaggcccagctcaatttgtgctgctccataactctttcttgacctatccaggccaccaggtcatacccaagtttataaattcctcctggtctgtaccacttactttaactgttaatcctatgatacctcgcattgttaaatatttgagactctaattccattgcccagtgaccatgtctcccatttcttctgtctttcagagtcatccagcacacctattgctacatagtttttattgttaaaatatttaatagctgtaggccgggcgcagtggctcacgcctgtaatcccagcactttgggaggccgaggtgggtgggtcacctgaggtctggagtttgagaccagcctggccaacatggtgaaatcccatctctactaaaaatacaaaaaattagccaggcgcggtggcatgtgcctgtaatcccagctacttgggagattgaggcaggagaattgcttgaacccagggtgggggagattgcagtgagccaagatcatgccattgcacaccagcctgggcaacaagagcaaaactccgtctcaaaaaaaaaaaaaaaaaatatatatatatatatatatatatattatagctgtaacgtattttatcaaataggtaaatggttttgactcttcatgaattattggatgggttgtttccagattttagctagcatggcaaacactgtagataacaaatgcttagatttaatgttagtttagttttgttttgttttccttttgaagcattcccttggcctaataatgatagttttggaataaccttgctgaggattttacgtagggaagatattatgatcttcctttcctattttaagaagctgaggttcagagaggtaggtaaattgcttcagatcacatagcccgtaagcagaggagtcaggtttcaaatctagcctactagatcacaactctggagcacttaacctccgtgccacactggccttggcccaagcaccactccctaccactcactttgttggccttgcctctccaaggaacaggtaggcctccttatgtgtaaggatgaaggagagaccattattccatatgtttctatcctgctagtgtcaactcctgcccggtgtccaaggtgcccatgcagaccagatctgacttgtttctctttactccttaacacccagcacatagcctctctccctagggcatgatttctcttactgtcttccatgtgtaaaagtgaccgtattgtatttctttctgttaagggcaagttcttttttgtgtgttttttttcttttgttttgtttttttgagacagggtcttgttctgtcgcccaggctggagtgcagcactggcacgatcatagctcactgcagcctcaacctcctgggcccaagtaatcctcctacttcagcctcccaagtagctgggactacaggtgcatgcgccaccacacccagctatctgttttttatttttaatagagatggggtctcactatgttgcccaggctggtctcaaactcctggggtcaacaatctgcctgccttggcttctcaaagcgttgggattacaggtgtgagctacagcactcagcaaaggctcaactttcatctagatgccattaggccagaatcaataacctccctcaaattacgtgacacatgattaatatgctatcactccaggactttttgcacataaggctaaatgtaattgcttcatctcttcacaaccatgaaggcaacgtcttcatgaaggcaagttaagagaaagagggtggtcacaagatgatgttttctcctgaaacagtggctactcccactggctgaaaatagaaaggctagagcaagacggccaaacagacccctccagcgattgtctccatgcaggaacaccaaactgaacaactgtccccacaaggaaagcacctttaggccggatgcggtggctcacgtcagtaatcccagaactttgggaggctaaattgggcaaatcacttgaagtcaagagttcaagactggcctggccaacatggagaaaccccatctctactaaaaatacaaaaattagctgggcgtggtggtgggggcctataatcccagctacttgggaggctgaggcagaagaattgcttgaacctgggaagcagaggttgcagtgagacgaaatggtgccactgcgctccagcctgggtgacagagtgagactccttatttaaaaaaaaaaaaaaagcatcttcataagaaacaaaaaatcaggtgagtgatcacagtacctggttttcacatcgtatcaagaagaggcactgaagagggtgggaaagacggtcctgcatcgcctatgcccccctccctcacctctggcacaacagcttggagagagaatctgtgcatgtggtggagcgagaggagtgtgggattttgcattggaactcactgctgccctgtcacagcacagcactacactgagcagaattctgctggcacccacagaggacacatttagatcagctctgggccagaggagaatcctcaggtagagtgggacagacctgagtcccagctggttctgccaccagctgaccaaagtggcctggggccctgaatacatatgagtgacagtcaggtcacaaggactatattccttaggcaaaccctggagatgcactggtcatggaggcagtggactttgggtgtgtgtgaccgcgtgtgacaccaactgtggtgaacaagggagtgcctgcatcattcctcccccaactccagacagggcagctcagggagagactcctacttggggaaaggagagggaagagtactcaagttgcaagacaaagtccagaagactttgagtagcagctcagccacaggaaaataaagcaccaggcagaatcctgaggctcctgattccaggcctttgctcctaagctacatttccagacctaccctgcgccagaagggaatccactgctctgatgggtcagatttatcctggcaggattccccacctgctgactaaagtgcccttgggctttgagtaaatatcagtggtagctaagcagttctggccacaggccttgggcaggatccaatactgtactggtctgcaaagcttcaggtgtgacccagtgcactgccatctgtggtggccatgggagtgctcatgtcacccttccccccaactccagacagcccagtggggagagagattcctgactgggggaaagagaagagacaaagtgagagatgttgcctgggtaaccggggaattttcccttatcttacccaaggccaccaaagatacaggagtatccaggagttggcaacagttgcaggggtcataggcttagggcaccccctggtatacatcagctgcagagaccgtaggcttaagtcacagcacttaatcccctttgaatatatagaaagccttctcaaggaggatgggtacaaataagtccagactgtaaagacttggaataaatacctaactcttcaatgtccagacattgatgaccatccacaagcatcaagaacatccaggaaaacattatttcaccaaatggactaaataaggcaccagtgaccaatccaggagtgacagagatatgtgacctttccagacagggaattcaaaatagtagtcttgaagaagctcaaacttcgagataacaccgagaagaaattcagaattctatcagaaatttcaaaaagagattgaaataacaaaaatcaagcagaaaggctgctctgcctatggagtagccattcttttgtttctttacttctctaataaacttgctttcacttcgcaaaagaaaaaaaatcaagcatcacttctagagctgaaaaattaagttgactaaaaaatgcattggagtctctcaacagcagaattggtcaagcagaagaaagaattggtgagcttgaagacaggttatatgaaaatacacagtcagggccaggcaggatggctcatgcctgtaatcctagcactttgggaggccaaggcaggtggatcacctgagatcaggggttcgagaccagcccggccaacatggcgaaaccccatctctactacaaatacaaaaaattagccagtcatggtggcaggtgcctgtaatcccagctacttgggaggctgaggcaggagagttccttgaacctgacaggcagaggttgccaccgtactccagcctgggtaacaggggcaaaactccatctcaaaaaaaaaaaaaaaaaaaaaaaaggagtgatttaggatgtccccagataaatgccctttagcctgtgacgtaaagaatctttagttacaatgcaaacatcccagaaagaataccatattaccattatcaattattagaaattcttaaggaggctatgcgcggtggctcatgcctgtaatcccaacactttgggaggctgaggtgggcagatcacctgaggtcaggagtttgaaatcagtctggccaacatggcgaagccccatctctactaaaaatacaaaaaattagcgggtgtggtggtgggcatccgtaatcccagctactcaggaggctgaggcagaatcgcttgaagctgggaggcggaggttgcagtgagccaagatcgcgccactggactccagcctggacgacaagagcgaaacttcatctcaaaaaaaaaaaaaaaaaaaaaacttaaggaatagttattatctgatatgatggcttattaagaaggaagggaacacatgataggtctgttttgaaaaggaatggggacagaacaaaatattactaggtctgatcaaaagaggcttgttctggcttgtctttgtctgccttggagtcacgggacaggtgtaaggccaaattgtgcacttcccagtcatgttaccttgggcaaataatttaaaatctgtagtttcccaatctgaaaattgagtctgatacctgttctaatttagtgttgattgatatgaagctcaaaatcagaaacatgtatgaaagttctttgcaaactaaaatatatgtgtgaggaattgttattattagtttagaggatggactgttgtccttagaaggcaagtctctgggtcctacagttagatgcactgagcgcttcgggaagaatttagggctatggggtactcagcaattaaaagagagggtgcttagagaaggaagaaaggacttattaatggagtttggaggctccttattattgaaacttacacattacgtgaccagcattatgaggcagcacccacttccaacaaatagccctctagaaccaaaagcagagtggcaggtcctgggtccttttgtacacagcataaaaaattaagtcaatcggccaggcgtggtggatcatgcgtgtaatcccagcactttgggaggctgaggcgtgtggatcatctgaggttaggagttcaagaccagcttgaccaacatggtgaaactccgtctctactaaaaatacaaaaaattagccaggcgcagtggtacatgtctgtaatcccagctacttgggaggctaagacaggagaattgcttgaacccaggagtcggaggttgcagtgagccaagctcgtgccactgcactccagcctgggcaacagagtgagactctgtctcaaaaaaaaaaaaaaaaaaaaaaattaagtcaatcctggcataactgcagaccaggccctggaatgagcaacccaccagcattatctgcatttctaggaacttgggctagaaggggaggaatggggttggaagggttaggctacatgcctctagttaaaacctgatgaacttcctagatccccaactagaaaatgtaggagttggactaaattcctctcctgcctctaatattttatgaatacagaactcaactcaaaatgggtagtatctcagagattccaaatttagttctacttttctgtttgcttatcagtcgcttaccctcaccctctggtctgatacctttatcctgtacaagtggtcaaagtaggttgagtaacgtgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaactttttttgtagagacagggtcttactatgttgtccaggctggtttcaaactcctggaatcaagcgatcttcctgccttggcctccagaaatgctgggactgcgcctggaatagatacgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaatttctcaccatgcactcacacagctatacagctgtctccagagattactctggaaactctgctataaagatgacctggtctaatgccttgatttgttttttgtttgtttgtttttttgagacagggtctcactctcctggagtacagtggcgtgatcatggctcactgcagccttgacctcctgggctcaagcaatcctcccacatagctgggagcataggcacatagcacaccactctcggttaaatttttttttttttttttttttttttgtagagatagagtctcaccatgttgttcaggctggtcttgaactcctggactcaaacgatcctcccaccttggcctcccaaaatgctaggaatacaggcatgagccactgcaccaggcctaatgtcctgattttataaatcccaaaactggggcccagagaggagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctacaaggcagtcctcagagagaagcaaggttctgcatcttaaaccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctgtgagaaattgcatcttatttattgattatttattgaatggtagtttcatggagtttttcgtctttttttttttttttgcgagggagtctcactctgtcgcccaggctggagtgcagtggtgtgatcttggctcactgcaacctctgcctcccaggttcaagcaattctcctgtctcagcctcccattacaggccacaccaccacgccccactaattgttgtacttttagtagagatggggtttcaccatattggccaggctgttctcgaactcctgacctcaagtgatgcacctgccttggcctcccaaagtgctgggatttgcaactgtgagccaccacacccagcctcttggtcattctttgaaaaataaacctcagccaggcgcaatggctgacacctgtaatcccagcaacttgggaggctgaggtggcggatcacctgaggtcaggagttcgagaccagcctgaccaacatggtgaaaccccatctctactaaaaatagaaaatttaaaaagaaaatcagctgggcctggtggcgcatgcctgtaatcccagctacttgggaggctgaggcaggagaatcgcctggacccaggaagcagaggttgcagtgagccaagatcaggccattgcactccagcctgggcagcaagagtgaagtgcagtctcaaaaaataaaaataaaaaaaccctctagatgtatgcggctccatattctcccaccacaagggtttataaatcctgagaaagaggcaaagcagggaacacatgaccacatagctctggcaggcgtcagattaccaggctgataaaacagatggtaaagtagaagctgtccgttgacttttccattcccctttcagctcctccactgctacttaatctcctttgcccacacagttcaatcctattttccctgatctccaaatcctggctagattattagccattaacactagcttttacaaggagactcttcaatcttgtatttctagtagtataatttcacacgtacagaaattctttaagtcatagaagtcttacagatacagaaattctgatcttcaggagtcctgttgtgaaacaaactaatttatcctgacagcaggaaagatttctgggcctaaggctctgtctcgttgacccagctcatgctattcaggtggtccatctcttggttccaggcaagactgctgctgctgaccaacctgaatatggactttagcacttgggctcaagctgcactcagatggttggaccaccataaaagagcgagagggtacgtttttggtatgaaaagtaaagactaggccgggtgcagtggctcacgctcataatcctagcactttgggaggccaaggtgggcagatcacaaggtcaggagattgaaaccatcctagctaacacagtaaaaccccatctctactaaaacatacaaaaaaattagccgggtgtggtggtgggcacctgtagtcccagctacttggaggctgaggcaggagaatggcgtgaacccaggtggtggagctttcagtgagccaagattgggccactgcactccagcctgggtgacagagcaagactccatctcaaaaaaataaataaataaataaaaagaaaagaaaagtaaagactaaaaaaattaaatattataaccctgctaaggcaggaggatcctttgagcccaggagtttgaggctgcagtgagctatgatggcactactgcaacccagcctcagtgacagagggagaccctgtttctaataaaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggccaggcgtggtggctcaggcctgtaatcccagcactttgggaggccgaggagggtagatcacctgaggtcagaagttcaagaccagcctggtcaacatggtggaaccccatctctactaaaaatacaaaaattagctgggtgtcctggtacgcgcctgtagtcccagctacctgggaggctgaggcaggagaatcacttgatcccaggagacggaggtttcagtgagctgagaccgcgccactgcactccagcctggggggacagagcaagactccaaaagttctggaaatggataatggtgatagttgtacaacaatgtaatgtacttaatgtcactgacttgtacacttaaaaatggttaaaatgggcttgttccagcagctcatgcgtgtaattctagcgctttgagaggccaaggcaggatgatcacttgaggccagagttcgagaccagtctgggcaacatagcaagaccctgtctctaaaaaaaaaaaaaaaaaaaaaaggttaaaatgaggccatgcatgcctacaatcccagcactttgggaagatgaggtggtagggtcacttgtttgggaagaggaggtgggaggatcctttgaacccaggagttcaaggctgcaatgaaccatcatggtgccattgcactccagcctgggtgacagagcaagacctagtctctaaaaaataagagttaaggccagacacggtggctcatgcctctagtcccagcactttgggaggctgaagcaggcagattacaaggtcaggagtttgagaccagcctggccaacatggtgaaacctcgtctttactaaaaatacaaaaatcagctggccgtggtggcatgtgactgtaatcccagctactcaagaggctgaggcaggtgaatcactggaacccgggagccagaagttgcagtgagccgagatcagaccactgcactccagcctgggcgacagagcaagactctgtcttgaaaaaaaaaaaagaattaaaaaaagaaacatggccgagtgtagtggctcttgcctataatcccaacactcagggaggccaaggtgggaggattgcttaagcccaggagttcgagaccaggcaacatagggagaccccatctgtacaaataatctaaaaagttagccaggtgtggtggtgcatgcctgtggtcccaggtgctcgggaggctgaggtgggagaactgtctaagcctgggaggttgaggctgcagtgagctatgatcgcaccactgcactccagcctgggtaacacagtgagacaccccgtcttaaaaaacaaacaagcaaataaacaaatactatgcataaaacctcaaggctcaagaaacaacagtttgaaatagttagatgtgtgttttttttaattttcatgtcttatcttttctgcttttttttttttttttaagggatgaggtcttgctctgttgcccaagctggtatcgaattcctcctgggctcaagcaatctcctgcctaggcctcccccctaacagctggaactacaggcatctaccactgcattcagctactgggggagtgtttgactagtctttttaaaaaatatgttaatatcttggtaaaaagtatatttatactgttctctaacctgctttttttcatcagtttcatggaagaatgctcatcatatattcttctgctttataactaaactgctttcatttatgacatcacaattaaactggtaaaaccaaatttatattgctaacttgtttctaattttttctctattaaaatgatatgattagcatccttgtagccaaatatttacacatatttatgaagttatacttaaaacaaattcctagacgtggaactgtgagtcaaagagaagggatcttttaaatatttttgcatagattgccatgaaaaggtcataccagtttatatatccaccaatatgagtttcttttccaaatcttcttcaacatcctgtgagagacagttaaacatagttgttcagagcccagccttgagaatcagatttcaaacatatgaaccctctccctttttcttttctttttcttctttcttttttttttttttttttttttttttttttttttttttgcccaggctggagtgcagtggcgccatcttggctcactgcaagcactgcctccagggttcacgccattctcctgccccagcctcccgagtagctgggactacaggcgcctgccaccacgcccggcgaattttttgtatttttggtttttttttagtagagacggagtttcactgtgttagccaggatggtgtcgatctgctgacctcgtgatccacccgcctcggcctcccaaagtgctgggattacaggcgcgagccaccgcgcctggcccctttttcttgttagagacagggtcttatccaggttggtctgaaactcctggccttaagaaaccctgccacctcagcctccaagtaaactgggattataggcgtgagccacctcacccaacttccacttcccagctgtatgatcttcagaaaatcagttaaattctctgggccttaatttactactacggttcttgtaagtattaacaattagctactattatttaccttctttagttcctgagacttctatgcacagaatatacttgatgtgtgccacagaacctatacaaaggtaattacaactaacagggagttgtatgataatgacatgggacatgggacatgagagcatttggaaagagataaaaaggcttaccttgaggacagccttattaggagcagaggcaaacacaggttttgtgagtttgaagcttacgcatttataggtttctctaattaccaagataggaaattatgaaatcaggtacaagggcttgggaggggcctaaagcttaagtttgatgaaaaaaaaaaaccacctctggttggaaccaatagcctatgaaaaagtagaaaaaagcccaatgcatggggagcgccggtagtcccttgaggtgtttgagaggctgaggcaggaagatggctttagcccaggagtttgaggcttgtaagtgcgcagtgatggtaaaccgccgctgtactccagactggcaacgtagtgagaccctgtctctttaaaaaaaaaaaaaaaaaaaaaaaaagatgagaggtaacacttgcctgactgggacaaaaatgagaaaccagtataagaaaataataactattggccgggcgcggtggctcatcgcctgtaaatcccagcactttgggaggccgaggcgggcggatcacaaagtcaggagttcgagaaattaataactattacctcatttggctatttttacacctgtaaggaataaagctcagaggtcacacagctagtaagaagccagcacccttcgatgtgggagtgatgtggaggataggcatatacagagaacacgaaagcaaaacaccatggtgcagattttgaaagaaaagccctaagattagtaatgagtgtgaattattcaacaaagtgatcaaaaccaactccagtcctgcattcctcttcgccatcaggagtttggagcctggagactgctagctgcctggttgttgttgtttttttttttttctgagacggactttcgctctgtcgcccaggctgtagtgcagtggcatgatcttggccaactgcaagctccaccccccgggatcacgccattctcctgcctcagcctcccgagtagccgggacgaaccagtcctggcccagcccattccgcgagccagcaagcttctgaaaagcaaacctaggaagttgctttccaacataaagtggaggtttcaacacaggagactttaagcaagttccagtgtgtctatatttggtctggctgatcggctggactctggccttccccgctcacattagcagacagctctgccctagtgggcgtttagcctgcgacggcagcccgagaggaagagttgggcagagttgcaggggtctccacagctgaggcagtttggccggattatttgggttcctgctcggatggcggcgacgctgatcctggagcccgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacacccttggcgagctggacctggagcgcgcgcccgcgctgggcggcagcttcgcggggcttgagcccatggggctgctctgggccttggagcccgagaaacccttggtgcggctggtgaagcgcgacgtgcgaacgcccttggccgtggagctggaggtgctggatggccacgaccccgaccccgggcggctgctgtgccgggtgcggcacgagcgctacttcctcccgcccggggtgcggcgcgagccggtgcgcgcgggccgggtgcgaggcacgctcttcctgccgccaggtgactcacctccgctaattgttcccctctgcccatccctgttcctgcgctttccactgtgtgtgtgtgtgtgtccccttcgccccgccccgctcttttcgcttgtgtgtgtgtccctcctcccgccccaccaccaccaccccgggctatgttgcccaggtaggtcttgaactcctggacccaagctatcctcccgcctctgcctccccaagagctaggattgcagggtgagccactgcgcccggccctttgaggggagttacacttatttttttatttttattttttttcgtccctgcgcttttcatacggagaaaggatgtagcttccaacattccggaggttagtgtaaggagacaggaatggaatggaaagttggttggggaattgcccctgccgctccaaaactgagaggtccctcaaacctagtgctcagttaaaagacattgtaagggctgggcgcgctggctcacgcctgtaatcccagcactttgagaagccgaggcgggcggatcacgacgtcaggagatcaaggccatcctggctaacacggtgaaaactcgtctctactaaaaatacaaaaaattagccgggcgtggtagcgggcgcctgtcgtcccagctactcgggacgctgaggcagaagaatggcatgaacccaggaggcggagtttgcagtgagccaagatcgtgccacgcactccagcctgggcaatagagtgagactccgtctcaaaaaaaaaaaaaaaaaaaggcattgtaaggaaagagaaaagacacataatattaaaaacaaacaaaacaaaacaaaaaaaacaggccggacgcggtggctaacacctgtaatcctagcactttgggaggccgaggcaggcggatcaagagttcgagaccagcctggccaacatggtgaaaccccgtctctactaaaaatacaaaaattagccaggtgaggtggtgcacacctgtagtcccacctactcgggagtctgaggcaggagaatcgctggaaccctggaggcagaggttgcagtgagccgagatcacgccattgtactccagcctgggggacaagagtgaaactccatctaaaacaaaaacaaaaacaaaaaacaaacaacaacaacaaaaaattttcaagtagtttcaatgttcttatttatgtatggaccaggaagtcacttttttttttaataaaaagaattccaactggttttctcactgtatttccatggcagctaggaggtgccaggtggctgggcctgtgacagtgcagaggttttggtgcctgcccgcccaccattgctccagctgcagctgctgccccctgcagggcctgttcgttcctgctgcctagctccctgctggctggctatgatctccgtcctgttaccattccaggagagcagccacctccctgtgcatggcaggaccaggtactgattgtggcctctcctcttggcctcgaatggtatccttgtcatcagtgagcaagtccccaaagaccacggtcttgtccattgtcaggataattcactccacaagctgggactccaggtgctgctctacccagcggtgcttctcacccacacagtggtcatactttggcaggggctggtgcagtgtgaagacctcggtgttttgcatgtgcttcatctcttgcaaggccctctggggttgggcttcaagactagggaaaagcctagggcttcacacccatgggccactttatccaccaggtccggcagcagggtgaggtactgcttccagaccaggaagctgcggtgctgctgcagtgtcacatgcagctccctgagaagcggcggctgaagccccacaggatgccgtctggaagctgccagcacgcggtccctgtccatcagcacacgcgtgggctgtgctcatcgctgccggggcactggggtttctcgggatcctaggggtatggggcccagaaatgttctttaaaagtttctcatttttgcaacttttctttcaattcacacagtatgttaaggtttatgtaaattagcatttacaataggaaagcctcttcctgtcaaatggaaatttgaggttactggatacttttatattacataaagagcaatcagccagtgtagaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagtcaacatattcatctgctctgggcaacaatttgtcttaacttacaaagttaaatatgttattctacttgtacatgtgcaccaggaggcatattccttataagaggaaagccattgcagatgagcagtctggattaatttaaaaaaagagcaaagtcaactggaaacagtccaaatgtccatcaacaatagaacagattaataaattgaggtatatttccagcagtcaaagtgattgaactacagctagaagaatcaacatctatcaagatatacaaaagaaaagaaaaaaataaaaaagaatcaacatggatgaatctccaaaccactgttgagtgaaacagtcaaacactaggagaacacattcagtatcattccatttagatacagttcaaaaaataggcaaaataaaatattgtttaaggtacataatctaagtggtaatactatgaagaaaaccaagagtgatacacagaaagtccaggatactggaaagagaggaaagggcacaggggtctgtgggacgttgatggtttgcgggtatcagcactgaactatgtcttaaaagtgttgcctgtaaggtgtttgcattctttttttttttttttttttgagacagtgtctcgctctttcgcccaggctggagtagtggcacaatcttggctcactgcaacctccaactcccgggttcaagcgattctcctccctcagcctcccgagtagctgggattacaggtggccgccaccacacccagctaatttttgtatttttagtacagatggggtttcaccatgttggccaggctggtctcgaactcctgacctcaggtgatccacccgtctcagcctcccaaagtgctgggattacaggcgtgagccaccagacccagcctgcattattattctttaattttgtgtgaaacacaaaacctttaatgtaaatgataaaaatattcagtaagtggagtcattcagaatgagtagccttttgagtctgtctccattgaataagtgcattctgttgagtgcactggagaggaatttgtgctcttctatgtagcagtctttctttttgtttcttggtggtgcaccattaaatggattcattcaccagttaaaggacatttgggttgtttccagtctttggctacaatgaataaagtcactataaacacttgccagaagtttctggacgaacacaggttttcatttctcgtgggtagatacctaggagtgggattgctgggtcacatgtgtggtaagtatatgtttaacttggtaagaaaccatccaactgtttcaggaatagcttagttttgcattttgttttgtttcttcccaagaacctgggccctttcctggcattgtggacatgttcggaactggaggtggcctgctggagtatcgggctagtctgctggctgggaagggttttgctgtgatggctctggcttactataactatgaagacctccccaagaccatggagacgctccatctggagtactttgaagaagctgtgaactacttgctcagtcatcctgaggtgagttcttctctcagatttatgggctatgatgtatcaggtctcttcttaaatggtctgggttttcacagaagttagctcattcatgacagccattccctaccccaacacacactaccttttttagtcacttcttatagacagtttctttctttcttcttcttcttctttctttttttgagatggagtctcactctgttgccaggctggagtccagtggtgcgatcttggctcactgcaacctccacctcccaagttcaagtgattcttgtgccccagcctcccaagtagctgggattacaggcacctgccaacatgcctggataatttttgtattttcagtagagacggggtttcacaatatttgtcaggctggtcttgaattcctgacctcaaatgatccacctgccttggcctccccaggtgctggattacaggcatgagccactatgcctagcctaatttttgtattttttttttttagtagagatggggtttcgccatgttggccaggctggtctcaaactcctgacctcaagtgatctgcccacctcggcctcccagagtgctggaattacaggcatgagccaccacacctggcctcttatagacagtttctattcaattctatattactatatttcctgctagtaaagatatttgtagttggtattatgcaattttaaattccagtatgttttttctttctttttttttttttttttttaagacggagtcttgccgtgtcaacgaggctggagtgcagtggcatgatctcggcttactgcaacctccacctcccaggttcaagcgattctcctgcctcggcctcctgagtagctgggactacaggcgcatgccacttctgcctggctaatttttgtatttttagtagagacagggtttcaccatattggccaggctggtctcgaactcctgacctcaaatgatccacccgcctcagcctcccaaactgttgggattacaggcgtcagccaccacgcccggccatgagatgacgtacttgttgatgacgactcagtttagttatgacagtgggaatgggtggctcaggtgggagacagaaaaagatcatgggagataatgagattaaggaactgagaaaccagagtaattgatagatcttccacatggttatcaccaagagtggtgatggacaaattgtggaaaggaagagatagaggggaggtaaattcccaaagctgcaaatctgggtaaatggtagaacccagattcagactcaggttcaactaacttccagggtgggcacaactcaccatattccactgtttgtggagccattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattctttctcataacttcttaaagtttcttcccctcattattaaaatgaatttaccagtaagaatgagtttttaagatttttataaactgtatactttatcagtttgggaagggagtaactgtaggaaacacaagaagtggaaaaagtctcctcttcctatctcaacacacaactgataaggctttagttctgaaaggaaaagtgagtaacatcaattaacagtgtctggtacgtaaatggagttcaataattatttgctgaatgagtataagtgagccaggcgtggtggctcacacctgtaatcctagcactttgggaggccaaggtgcgcggattacttgaggtcaggagtttgagaccagcctggccaacatggtgaaaccccatctctactaaaaatacaaaaaattagccgggcgtggtggcgcatgcctgtagtcccagctactcaggaggctgacgcaggagaattgcttgaacccgggaggcagaggttgcaatgagctgagattgcactactgccctccagcctgggtaacacagcaagactatgcctcaaaaataaataaattaattaaataaataaatgattacctactgtggaagaaaagcacataatataaaaagtatatcagatttgagtttctcctttaagaatggaagttaacatcttgcctataaactgattactagttagatataaaactactaaaacttttcaaaaccaatacatatttagttctttgatatcttctccttggattaataaggattctcctagtgcaaataaattttatgttcctgtttatacatatggacctttaggatttaattgtttcaaaagctgataaaacattattgagatgaattacataagcgattttaacaatgacaaatgtgaaattcaataacaatttaggcttggcatggtggctcacacttgtaatgccagcactttgggaggccaacgctggtggattgcttgaacccaggagttcaagacaagcctgggcaacatggcaaaaccccgtctctacaaacaaataccagacattgtggcggatgcctgtagtcccagctactggggaggctgaggtgggagaactgcttgagccctggaggcagaggttgcagtgagccgagattgtgctactgcgctctagcctgggtgacagcaggatactgtctcaaaaaaaaaataaagaaaaagaaagacaatatttatatcacttgatataaatagttacacaataaacttgattttttcttaaaccttagttgtatttaaaagaaaaaaaaaaccttaatttattattattttctttccttttttttttttggaggcagggtctcattctgttgcccaggctggagtgcagtggcacagtcacggctcactgcagcctcaacctcgtaggtttaagctattctcccacctcggcctccctagcagctgagaccacacaggcacacaccaccatgcctggctaatttttaattttttgtacagatggggtctcccaatgttgcccaggctagtcctgaattactgagctcaaacaatcctcctgcctcagcctcccaaagtgctgaaattacaggtgtgagccaccgctgccagcttccggcaccttttttctaaaggaattcatggttttgtagcagtagaatataaccagatctacagtagagagatgataccctgagatgaagctacctcctgtgttactctgcaacccaggaatgcagctggtgccatgtctccaaacttccacaagaatgccagtgctgggcatggagccccatttagagtacacatgacctgaggctctgaaaactcttagagatgatgcaatctgggacagttgctcatagctggcctggccaagtcccaccccaagatgccaggccacaacacaaaatttcaagtcatattgttttatcttttcccttgcaattatatagtatatgactctcttagaaaagtgcaatagttaaaacttgttttagtagatgctagatcccaaacttgagtctgctgaagcccttttgagaccttagggaccctattctccattcttagaaattcaggctggtgaatattagattcaaaagcaccacagatgagccggtggttgtagaagtacatgcctgtaatcccagctacttggaggctgaggcagtagtagtattgcttaagcccaggagttcaagccagcctgggtaacatagtgggacaccatcttataaaaacaatttttttttgagacagtctcgctctgttgcccaggctagagtacaatggcttgatctcggctcactgcaacctccgcctcctgggttcacgtgattctcctgcctcagcctcccaagtagctgggattacaggcgcccaccaccacacccagctaaattttgtatttttagtagagatggggttttgccatgttggtcagctggtctcgaactcctgacctcaggtgatacacccggcttggcctcccaaagtgccaggattataggcgtgagccaccgcacttggcaaaaaaatgttttaataacatgaaaaattttaaaaagcaccacaagggttcagattacctatcagcctcttgacatttcgtattttttttttttttttgagacgagatctaactctcacccaggctagagtgcagtggcagtaacatgatctcagctcactacagtcttgatctccaaggctcaagtgatcctcccacctcagccccctgagtagctgggactgcagacacatgtcaccatggacagctaatttttgtatttttgcagagacaaggtttcaccatgttgtccaggctggtctcaaaactcctgggctcaagcagtctgtccatcttggcctaccaaactgcttggattataggcatgagcaaccgggcccagcctagttagtctttattagttatttgaaagacatttttcttttcactttcaacccatgcacactgtgaacactgtgaaatacacagaaaagttcattaaactaacatgctccataatgattcacttatttatttgaaaacagaggttgggtgcagtggcttatgcctgtaatcccagcactttgggaggccgaggcgggcagatcacctgaggtcaggagttctagaccagcctgaccaatatgatgaaaccctgtctctactaaaaatacaaaaattagccaggtgtggtggcatgtgcctgtaatcccagctacttgggaggctgagacaggagaatagcttgaacaaggaggcggaggttacagtgagccaagatcacgccactgtactccagcctaggcaacaagagcaaaactccgtctcaaaaaaagaaaaaagacccggtgcggtggcttacgcctgtaatcccagccctttgagaggccgaggtgagtggatcatgaggtcaggagcttgagaccagccaggccaacatggtaaaacgccatctctactgaaaatacaagtattagccgggcgtggtgctgggcgcctgtaatcccagctactccggaggctgtggcaggagaatcacttgaaaccggaaggcggaggttgcagagagccaagatcgtgccactgcacgccagcctgggcaaaagggcaaaacgctgtctcaaaaacaaaatagagatggggtctccctatgttgcccatgctggtcttaaactcctgggctcaggcaatcttcccaccttggcatctcccaaagtgctgggattacaggcaatcaccactgcacctggccatcatgaataattttaaagggaaccacaacataaccaatacccaagtccaatcggcatggtttttaaaagcatatttaaagtgtataacatggaccaggcacagtagctcacgcctgtaatcccatcactttgggaggccaaggtgggtggatcacttgaagtcaggagttcgagagcagcctagccaacatggtaaaactccatctctaccaaaaaatataaaaatttgccaggggtggtggtgtgcacctgtactcccaactacttggcaggctgaggtgggtgaatcgcttgaacctgggagtcggaggttgcagtgagccaagattgtgttactgcactccagcctggacaacagagtgagaccctgtctcaaaaaataaaataaaaataaagtgtacaaagagatggttgtggcgggttgtttttgtttttgttttaagagacaggctctggccaggctggagtgcagtggtgccatcatagctcattgtagcctcaaactcctgggggcccaacccatcctcccacttcagcctcctgagtagctgagactataggcacttgccaccatgcccagctaatttttaattttttgcagaaacagggtcttattatgttgcccaggctggtctcgaactcctggcctcaggtgagcctcctgtaatcagtagaagggtccagctgccagccacttgtaaaaagaagccaatataataagagtgaggtgtgataaagagagtgagttttattatccatgctagcaaggggagaagtgagtgtagttatttgcaaatatttccactcttcaatttgtggagggaatccaggagcttttgaagagagagtttggagtgcagaagaggcagcggaactaggagttgtcgggtggcgtgacctgctccactggcttgttttgaagtattgtttcatctggtgaaggagccagtgccatcattgtggctagaggtgtctggtccatatccagatccagtccctgaagctgaaggaaatatatgaccaggtaatggtgtgtacttaacaagcatctaggtaaatacatgtgcataaggcacggaagcacagaatgggaaaagaaagggcgtggaggttcagcacattctgagggtgtatttcaagatgaaaggaaactcatatgcagatggtctcagagttctatcttgagactcactgggggaggagaaaggggaaaggaaaaaaagtcttaaggtttgaggctaagctgctaacctgcttagttacactcccaccttggcctctcaaagtgctgggattataggcatgaaccactgtgccaacccaacatggtgttttgatatgtgtatattaacacactgtgaaaggattcacaggtaattaaccaggtaattccaggtaattaacctatccatcgcctcacatctttctctctctctctcttttttttttttctggtggtgaggacacttgtcttagtctgttcaactgcagtaacaaaatgtcttataccgggtaatttataaacaacagaaatgtattgctcacagttttggaggctaggaaatccaagatcaaggcaccagcagatctggtgtctgctgagggcctgttcctcatagatagcaccatcttgtgtcctacctagtggaaagagcaaggcagctctcttcaacctgttttataagggcaccaatcccattaatgagggttccaccctcatgacagtcacttcccaaatgcctcgtgatgtgtgtgtgtgtctgtgtgtgtgtgtatctcaggggcgtcaggcctcaatttcctcatctatacaatgggtataacaacaatcccatcttgttgggaggaattaacaatcatgcatcgagccctgggcctcaggcttcaatgtattagttattagagctaatcattatttaatgttttaaacacccccaggaagtagagaacattcctgtcacattctgcagaaaaagaaattgaggcaaggggcaaagccatttgccaaggtcatagatcctgcaagccaatggcaaggcaggatctgaacctggggcttcagatcctggggctttacctgattaaataccaagagagagtgctgagatttttttggtggtggacagtccctgaggcaagccatttttagagcatctgggccacttggggaattgaatctttaccagggcttcccacctcctgttgccccttctctgaaggtgacccccctcccacagtagcaccccaaccactcagaacccccaagccaccttctttgcacatgctgaagctaatattgccctccactccaccccaacatcagggaccctggcccaagcccttccctgggagcccttcctcctctcatgaggcctccttcccagcccctcagaacagcctcctttatgagagtggccaagatcccactgaaaccttccctatcaactttataaaattaatcaggggagaagggaggggcgaaatggaaatcagcccagcttgcagcacacacagcattggtcatgaggtcagctgctctctgacccacttgctcagagttgtttgctgcctgttgctccagagtctcatagaccctgtcacaaggtcatagttccccttcactgctcatagataacaactggaacattataaaacattaacttttccatttgagatattctttcaggtcctgcatagcaatgaaactgaggcaggataggtagctaagggagtgaccgtgttctcgggatgcagcgaccatggcacccatacagtcaacacagtgagcctcagcattcgcattgtcattgcgctcattcaagcaaagctgtcttcattagggaatttcccccatagacagcatgagcattttgattttacctgtcctcaaactgacattttgctcattataatagtagaagacagccctacatggagatgtaatatgctaatgagacatgtgacatatgaacaagcatgtacagctactgtgcatgtgcacacagaagaccacccggaacatgcttattagcaacacctcttcccaccaccttatgaataatcatgtaagactcccataaagggagtctccctactgccagtctctgctgtctcacccttatgagcagcctgccttgaaccctctctctcacagtatacagtccattctgcatgtaaatttcaaaatattcttcttcctttgcaataaattactctatgctgcacttctttgctgtgtgtctcttgtttaaattcttttaaaccaagaagacaagaaccgaggtgtcacatcagccgccaaagaaactgctgatgccagcctgaatgaaagaccccacaggaactcactcactaaagaatgcagtttttgctgggcgcggtggcatggctatagtcccagcactttgggagacagaggcgggccgatacgaggtcaggagttcgagaccagcctggccaacatagtgaaacaccgtctgtactaaaaatacaaaaattagccgagtgtggtggcatgtgcctgtagtcccagctacttggaggttgagaggctgaggcaggagaatcacttgaacctgggaggcacaggttacagtgagctgagatcgtgccattgcactccagcctgagtgacagtgtgagactccgtctcaaaaaaaaaaaaaagaatgcagtttccacctcctgaaaatttaatcccctttaccccaactagtcaatgagcccaattttctagccctttaccctccatgatccctttaaaaaccctgttacaggtagttagacatgagcagggaaggagagggcttttctccctcacccactaggaatgtcaggtggtggttgacagttatcacgttgcctctctaaactgaaaattcgcagttggtgccagagggccagagtgagacaagctcctgatgatccacaggtgttaacattaaagtgttaattgaatgcaggtgccagggagaagcaacttcctgggcacgtgcattaagagacaaaatggcaggccaggcgcggtggctcacgcctgtaatcccaacactttgggaggctgaggtggatgggtcacctgaggtcaggagttcgagaccagcctgaccaacatggtgaaacaccgtctctactaaaaatacacaaattagccgggtgtggtggtgcgcacctgtagtcccagctactcaggaggctgaggcaggagaatcgcttgaaccccaggaggccgaggttgcagtgagctgagaccacgccattacactccagcctgggcaacaagagtaaatctccgtcttaaaaaaaaaaaaaaaacagacaaaatggctatgtatgacctctccaggacactccactggaaaagggaagaaagcctcagatgggcacgtatacaacttcctacacacactgtgcatgctcacttccgaaaggtaaagagagcacagagcatgagggcagctcaccctcagagaagaatcatgagaaagaggcgagcctataaagtcctaggatcacagttaaacagggctcttgaccttcaggtgcccggtcaggtctcttccaagtgaactttcctttctttcatgtcctaaagactttttaaataaacttccactctgctctgaactcacctccgtctctttttctgccttatgcccctcagtcaaattctttcttctgaggaggcaagaactgaagttgctgtagacctgtacagattcgccaccagtaactcagacaccttccactggtaacaaccccagcccagaattcttcaaggagatggatttgagggtctcctcccatctccttgctaggtgccctgtgatcatgaagctctttctgtgctgcaaaccctgctgtctcagtgtaattggtctgtaacagcagagtgggcattctgcagcctcttccttgcccggggcctgttgggagcccccagcactgcctgtaccatcataaacccaccctggcccctttcccaggctccaagctcagaggaggcagaggcttcattctaaactacagcatcccctccctaatcctcatttgccttctccttctgagcttgggccccattttttgagaccctaccagcccccattcccacaatcccctgtgccgacacaaatcaacctccccatgtcccaaccactgtcaaccccaacttagaccagtgcatcccacagctattctagcaccccataaacactccagtgtcccccacttcctgatcccacaacaccttgggccctccagataacccgctgctccagcctggcagtttgtcaaccccctcacccagacccccaacacctcatgcctgtcttatgccatgagtctgaggcccctgacccctacacctcttgggtgccacccaggcctgtctgtgtgggcagctcccccaccagctcccttccatcccccatgggtcctatccagggtttccccgacccaagcacacactattcggcattcctgactcccactgttcctggctcacggcctggccaccttgtctcgctcatctgccatagcccctgcctggcccagcaggacaggcctaggtcagggcaaggacaggtcagcaccagggctggtgccccaccccgaaggacacaagcctcctgctcaggacactttctggggtcctgtgcctccccttcttctcccccaggtgccaagtccccactttttaatactatcgcattgaggctgggcatggtggctcacacctgtaatcccagcactttgggaggctgaggtgggcggattacctgggctcaggagttcaagaccagcctgggcaacatggtgagaccccatctctactaaaaatccaaaaaataattagctgggcttggtagcactcgcctgtaatcccagctacgggggaggctgaggcaggagaatcacttggaacccagaaggtagaggtccagtgagccgggatcgcgccactgcactccagcctaggcaactgaacaggactagatctccaaaaaaaattaaaataaaaaagtattatcacattgggtattaggtttgttaaataaaaattattgctgtggaggatacacttgaagggaatgaaaaaaagtataggagactattgttttgctttttttttgttttgtttttgagatagagtcttgctctgtcccccaggctggagtgcagcagcgcaatcttggcacactgcaacctctgcctcccaggttcaagcaattcttgtgcctcagcctccctagtagctgggattacaggcatgcactagcatgccccgctaaggccattgttttggactaggctctagcactaggccccaatagacaagactaaaaaccaaaatggcgtcacctgtgctaaagtttcacccaacctaaactgaagtgttacctggccttctgagaaatcaggagagaaataacagccaatttcccaaacatgccagttttgatctttaattatcatgacaatgaggttcccctctgctttaatctgtacacaaaagaattagccagctgggcatggtggcttactcatgtaatcacggcacttcgggagcccaaggcaggcagatcactagagaccaggagttggagaccagcctgcccaacatggtaaaaccctgtttctatgaaaaataaaaaaaattagcaggcatggtggtgggggcctgtaatcccagctactcaggagacagaggcaggagaagcgcttgaaccagagaggcagtggttgcagtgagccgagatattggattaggcagtcaaaaaaaccaagcaagcataaaaggtcaataagttgtaatcttgatagtaaaagtggaaaacttattataaatggaaagaaagttttgatttccttttttgtttgatgggcagtatgccatattatacccaaagttcgtttaaaaaatatttccatcaactatttttatttgaaataaatatttgaggtaagttaccaaggcagcttttttcctcaaaagtaacctgttcctctttggaatagcacattttaggggcatggttaatacctgagatttttactcagtaaatcctgatggttactatgtgtaaaatatctttaagtaggattgaaggcctctgtggggaataaaatattaccaaagtctataaaaataaattttacatgttctcctttatgacagagagcagcactggttctgctacttttaaaatgaataattgatttcttgataggtgtttgatatttcttccctcactgctgattcttagatagaaaccattctttatatttgatagactgttttcagaaaacccttatcaacaagtgtacaatacttatctgaaactatacgtttagaatggagcagtttaatactagatctcagaaatttgaaaaatagcaaagaagactggatttggaaagcatggtctacaattgcttgtcaaattctgaagctatgaagaataaatgtttcaactttggattatgaaaccccatttatgattttttaaataaacttgaaataaaaatgattaaactaaaaaaaaagaatgtagagggagagatcaatgtaaaaatttatttaaagaaatagtaacagagaactttctaaaactagagaaagatatgaatatacaggtataagaaggtcataaaacaccaagccaactcagcctcaataagactacctcaaggcatataataatcaaactctcaaaggtcaaggctaaaaaaggatcctaaaagcagcaagagaaaagaaggacatattaataacatcataaaggagctccaatatggctggtagcagacttctcagcagaaactttacaagcagagagtggggtgacaaagtgctgaagcaaaaaaacttccaatctagaatattatattcagcaaaaacagccttcaaacatgaaagagaaataaggatattcttagttaaaaaaaaaaaagtgagagattttgacatcagacctgtcttataagattcttgttaagaggagttcctcactggttgagtatgaatggtcaaatgaaaagaacattaatattctcctgccttgcatattcttctaaaacattttacattcctaacacatcagtgtgtccacatcttgcttctaaggcagggggcaatttgatcc

SEQ ID NO: 114 - DNA, 38313 bp, Homo sapiens
ttgaccaaattcccatatgtgactaaggctctgttccttcttcaagatccagtttagtgctacctgctccgtccacttctgaccacccaaccagatgaatctggtcccagtccctccctccttggaagcctttgcatttctcattaagcacttgtattgctgccatttgttgcttacttaataattaacttatcatagttaattagactagaaattaacagttcaactaccctgataaactattttgtctttctattgcctctatgaacctgattataataaatcattgtattgttggagtcactgttattcccagagctgtcaggtttcagagcagcgtgtcagtgccaccccatgcctgcatccgggaagatcactcctccactggaccagcccagcctggaaaggggccagtgaggcggaaggtggacaatccagggccaatacattctgggagtctcagaggaagagaaaaatcgattcagactcatttaacataggctcctggaaaggatatcatctcccccaatctctcatcaataacccaacatcagatcagtgccctggacttatcatatgaagcagaatgaaagtagacagataggtcatccttggttagatgtccagaaatccgaggatggtggtcctagctcttcagagaggacacgttctttaacctaaccttttaacaaattctctacagaagatatcaggtcccaacatttcaagtagcttcgtagatataggtaatcaaaggactaattatgaaagtgtagatgggtagaggggagcaacaaggatggcacaggaacccatagccctgaggaggagggagagttgttggaacctgaaaggacctgggcagagcaggctgcccttagagcaggcctggggccaaggcacaatcaataccaagcctgcctcacgctctcttccctccactcctcaacttgctgctggctttcagaaaagttaagaacttgccatttctacccctttgccattgttgttgtcttaccataaggcggggagcaatatagtatccagttttctagatatggaagtggaaatcaggtgtatatacccagtatattagtacctattagtattcttattggtattactttctagatgttatgtaactgtagctttggattttctatttaattcaaaagacatataagagttttttttttgctaattccatgttggatttattgtcactacttattaagttataattttaatgtattgtgattagagattgtactgtgttctatttgtgttttaaggatacatagagattttctttgtggctaaatataagtaatccatgggtgttttaaagaaggtagagtttccaaatagagtatgacattccagtcactgtcagattccacacaacatttcagtcagccacagaacatataaatgatagcagtcccatgagattaaaatagtatatttttcctacaccttttctttatgtagatattttagatacacaaatacttaccactgtgttaaaattacctacaatagtcagtagagtaacatgctgtacaggtttgtagcctaggagcaataggctataccttatagcctagatgtgtagtaggctgtaccatctaggtttgagtaagcatacgctgtgatgttcacacaacaatgaaatcacctaacaatgcatttcttaatatacatctattaaatcattttattaattaaattatattcttcctgaatattgattttcttaatctgtcgagaacttcaaagagtatattttaagttaattgaatatagcttttgttaattgaatggttttatatatatatatatatatatattttttttttttttttttttttttttttttgagaaggaatctgcctctgtcacccaggttggagggcagtggcgtgatctcgacttactgcaacctctgcctcctggattcaaacgattctcctgccacagcctcctgagtatcttggactataggtgtgcaccaccacacccggctaagttttgtatttttagtagagatggggtttcaccatgttggccaggatggtctcaaactcctgacctcaagcgttccacccacctcggcttcccaaagtgctgagattacaggcatgagccacagcacccggcctggttatatatatttttattttcggcacataaatattaatgacatgaatattaatgacacttttttcactgtgaatcataccataaatcatataaagtaacttttattttacattttgaatatgttttgccttttattctacttcatccaatacagttttattaaatgtggatttgtaccattgctctttgtccatccttttacttttggcttttctgagtcacttcactcaagtggaagtagcacctacttgaatttaacttttttcccccacccaatttgaaggtctttttttgaagtgagttcaacttaagttcattgttgtaacaaatatgtttggtttaaattttatcatttccctttttgtttttttttccttttctggtaaacttattaagttaatgtttgttaaactaaattccatttcaaacggtgggaaggagtaaaaaacacctaacataaagtttaccatcttaagcattcttaagtgtacaggtcagtaatgttaaatatattcacattgttgtgagacagatctccagaacatttgaatattgcaaacctgaaactctatacccattgaataacaacttcccttgtcctcctcccccagcttctggtaaccaccattctactttctgtctctgtgaatttgtcgataccaagtttggaagataagaaatatcttttaattcctgattttgtgtgataagagaaataaaatatctaccctttagtgactgactcatttcacttagcataagatccttaagattcatccatgttgtagcatgtgacaggatttcctccctttttaagtcaggataattttccgtgggttgtgtgtgccacatttatgtatccattcctcagtggatgggcatctgtgttgcttccacatttgcctattgtgagttgtgctgctgtgagcatgggtatgctgttagctttttaagtccctgcttactgtgcttttggagacatactcagaagagggattactgaatcaaatggtagttctaagtttcacctttggaggaatctcaatactgatttccagagcagttgtgccattttacattgccaccaacagcacacatgagacccattttatctacatcctcaccaatacttgttattttcttttttttttataatgaccgtcctagtgggtgtgaggtgatatttcattgttgttttgatttgcattgctctgatgattggcgatatagagcatcttttcacatgcttgttggccatttgtatatcaactttggagaaatgtctattcaattcctttgcccatttttggtcaggttattgattttgttgtcattgttgaattctgagagttatttgtgtattctgtatatcagaatcatgagttgcaaatattttctcccaatccgtaggttgtcttttactctgttgaatgcatcccctgaggcacaacttaagcctggtggtcccatttgtctatttttgcttttgttgcctgtgcttttggtgtcatattcaagaaagcactgccatattcaatgtcacaaagcctttcctctatgttttcttccaagactttgatagttttaggccttacacataggtctttaatccattttgagttaatttttttacataagactagagtccaacttcattcttttgcatgtgaatgtccaggtttccaagcatcatttgtgaaaaatctgttcttttcccattgagtggtcttggcacccttgtcaaaaatcattttggccagggacagtggctcacacctgtaatcccagcaatttgggaggccgaggtgggtggatcacctgaggtaaggagttcaagaccagcctggccaacatggtgaaaccctgtctctactaaaaatacaaaaaattagctgggtgtggtggcgcacatctgtagtcctagctactcaggaggctgagacaggagaatcacttgaacccaggaggcagaggttgcagagagccaagatcgtgccactgcactccagcctgggcgacagagcaagaccttgcctcaaaaaaaaaaaaaaaatcatttgaccatatgtgagagtttatttgtaggcactttatcatatttcgttggtctattcgtctgtctttatgctactatcacactattttgattattgcacctttggtaatatgtttgggttttcggttgttgttgattattttggtttgtttgttttttgtagagatggggtctcactgtgtttcccagtctgatatcaaatttctgggctcaagtgatcccccagtcttggtctccagaagtcctgagattacaggtctgagacgccgtgcccagccagtaatatgttttaaaatcaggaaatgtgagtcctccaacattgttgttctctttcaaaattgttttggctgttcaggatgtcttatgatttttactgatttcttgccatttccaatcttttttgttcattactatgtaatatatgcttcttattttattttatttttggagattgagtctcgctctgttacccaggctggagtacaggggcatgatcttggctcactgcaacctccacctcccgggttcaagctattctcttgcctcagcctcctgagtagctgggattacaggcatgtgccaccatgcccggctaatttttgtatttttagtagagatggggtttcaccatggtggtcaggctggtcttgaactcctgacctcgtgatctgcctgcctcagcctcccaaagtgctgggattacaggcgtgagccaccatgcccggccataatatatgtttctttgagctgtttttctgataacttagcggccatgtaatctaattaactaatatccttcaaccactttctcaatctatcactctcagacacgaaacagtatctgttgactctatcatatgaaaaattaagaaagtgactgcacttctccccacctgtgcccccacatacagacattcccccaactaaccaataatggttatattttgtggattttgtgtcagctcattgtagtagtattactacattgactagctttacttattcgtggattcttgtaggtttttaagattttatactatgcagccataaaaaatgatgagttcatgtcctttttagggacatggatgaaattggaaatcatcattctcagtaaactatcgcaagaacaagaaaccaaacaccgcatattctcactcataggtgggaattgaacaatgagatcacatggacacaggaaggggaatatcacactctggggactgttgtggggtggggggaggggggaggggtagcattgggagatatacctaatgctagatgacgagttagtgggtgcagcgcaccagcatggcacatgtatacatatgtaactaacctgcacaatgtgcacatgtaccctaaaacttaaagtataattaaaaaaaaattgaacaaaataaaaaaaaaagattttaagtctagttacttttctagggtatgtctcaatgtaggtcaagctctgtttttttattaattgagataaaattcacattccatacaattcttttttagtatataattcagcatgtttttgtatattcagaaagttatacatccttcacccctaattcctgaacatttttgtctccccaaaaagaaaccgtgtgcccattagcagttacctcccattacccttgttcttgcacccccgcctcgccctggcaaccactaatctactttctgtctctatgggtttgcctatatgagacattccacataaatggaattgtaaaatatgtggctttttgtatctagcttctttgacttaacatgatatttttaaggttgtagcgtatatcagtacttcattttttggtttgcagaataaaatccgttacgtggatttacaacattttatttatatattcatgaatggatggatacttgggttgtttgtacttttttactttcacaaataatgctgttataaattgttatagattgtgtacacgtttttgtgtggacataattttttcagttctcttggatatatacgtaggagtagaacagctgggtcatatggtaactctctgtttaacctttgagtaactccccaactgttttccaaagtggctgtgccgcgttatatttccaccaggatcatattagggtttcagtatttccacgtcctcgtcaataattgttattttctgatttttgattataaccatcctaatgagtgtgaagtgtcatctcattgtggttttgatttgcatttctctaatgactaataatgagaagcacctttttaagtgcctattagccatttgaatatcttctttgcagaaatttctattcagatcctatgctcatgtttaaattggcttatttttgttcttttattattgggttcgacgtgttctccatatattctgaacagcagtcccttattcactatgtaatttgaaaacatgtctcccattctttgggatgcttttcactttcgatggtatcatttgcagtacaaaatttttagttttgacaaagtccaatttatctacttttgtcatttgtgtttttcatgttgtgtttaaaactattgcctaacccaacatcacacacaaaaaaagtttacttctttgcttttttctaagagtattataattttagctcttaaattagggtctatgatcattttttagctaatttttgtatgtaatgtgaggcaggggatacagtttcattttttgcatatggatatccagttgaccccgcaccatttgttgcagagactattctttcttccattaaattgtctggggtcctttgccaaaaattaattgaccataaatgtaagagtttatttctagactcttaattctatttcattgatccatatgtctctgcaaatgccaccaccacaccgtcttgttgtggtgttcttgtggtaaattttgatgtgtgagtcctccaactttgtttttcttttataaaattgctttagctatttatgggttctgtgaactttaagatcagcttgccagtctctgaaaaaaaataaaaggcagcatgaatcttggtagggatgtcattgaatctatagttggaattggggagtactgacatcttaaaaatattaagacttctaatctatgaacatgggatctattcccatttagttaagtcttctttcatttctttcaacaatgtttatagtttttacttctttgcagttcggcacatctgtcattaaatgtatttctatatattttcttctttctaatgccattgtaaatgaatttgttttcctaatttcatttctaggttgtttactgctagtgtatagaaatacaactgatttttcttacattgatcatagattgtacaagcttgctgaacttgtttatcagctctaataatttgtgtgtgtatatgtgtgccttaggattttctatatagaataccatgtcatcttcaaatagagatggtttttctttctaatcttatgctattttttctttttctttgctgattgcctttgtttgaacctccagaactatgttgaatagaagtggcaagaatggatgtccttgtcttgttcctaatcttaaaagggaaagcttgacagtcattaagcataatatgagggatgagttatttgtagatgccctttaacaggttgaggaagttcccttccattcctagtttgttgagtgtttttaccatgaaagggttttttattttgccagaagccttttctatttctattgagctgattatatgttttccctttattctattaatatggtgcattatattgatttattcatatgataaaccaaccttgcattcctgagataaatcccacttggttttgatgtgtaatcccgtttctgtcttcttggattcagtgagctagtatttttgtagtattttacatctgtagtcacaagggatattggtctgcagttctgtgatatcttcgtctgcctttgatatcaggataatactggcctacatagaaggaatcaagaagtgatccttctgattatgttttttgtatgagattgtgaataattggtgttacctcttctttaaatatttggcagaacttatcagtgaagcttggtccaagctttacttttggagaagttttctgattattaactcagtcttttctcattataagcctactgagattttttatttcttcttgaatcgattttgatcatttctttatctagaaatttgtctacttaatctaggttgtctaatatcttggtatatgattgttcatagtatcccctcatccattcttaattttagtgatttgagtcttcggtttttccttggtgaatctagctaaagatttcagtttttgttgatgttttcaaagaccaaacttggtttctttaattttctcttgcattttcctaatctctgttttatttatttccattctaacatttagcatttccctccttctacttatttttgttttagttacatagaactttagttacgtagagctcatctttttctaattcctttttaaaataatttcaatttttattatagattaaaggacacatgtgcacatttattacatgggtatattgcttgacactgaggtttggggtataaataatcccatcacccaggtggtgagcatagtacccaatcggtggtttttcagcccattccctcctcctttcctcccatctagaagtcctcactttgtattattctcatctttatgtatattcagtgttcagctcccgcttgtaagtgagaacatgcagtatttggttttctgttcttgcattaattggcttaggataatggcctccagctccatccatgctgctgcaaagggcatgattttattttatttttatgtctgcacggtatttcgtggtgtatatacactacattttctttatccatccactgttggtggccacctaggttgatttcatgtctttgctattatgaatagtgcgggaaagagcatgtgagtacatgagattttttgacagaatgaattcttttccttcgaatatatacccagtagtgggatcgctgggttgaacagtggttctttttcagttctttgagaaatctcccaactgctttatacaatggctgaaccagtttgcattcctaccaacagtgtataagcattcccttttctctgcagccttgactgcatctgttattttttgactttttaataatcagaattctgactggtgtgagatgttatctcattgtggttttgatttgtatttctctgatgaatggtgatgttgagcattttttcatgtttgtcagctgcttgtacatctgcttttgagaagtgtcttcctgttctttgctccccctacttttttttttttttttttttttttgagaaagggtctcactctgtcacctaggcggtagtgcagtggcacgatcttggctcactgcaacctccgcctcccaggttcaagcaattcttgtgcctcagcctcctgagtagctgggattacagctaatttttaaatttttagtagagatgggatttcgccatattggccagctaattttttaaatttttagtagagatggggtttcgccatattggccaggctggtcttgaactcctggcctcaattgatcttcccaccttggcctcccaaagtgctgagattacaggtgtgagccaccgtgcccagcccctttgcccatttttacaaatggaattatttgatttttgctttttaaatttttacatttccttacagattctggacattagagatttgttggatgcataatttcctaatattttctcccattctgtgagttgtctcttgattgatcatttattttactgtacagaagctctttggtttaattaggtaccaatcatcaatttttttattttgttacaattgctattcaggacttagccataaactattttccaaagccaatattgagaagggtatttcctaggttttctgctaggatttttgtagtttgaggtcctccatttaaatctttaatgtaccttgatttttttaaatatagtgagaggtaagggtccagtttcttctgcatatggctagccagttatcccagcaccatttattgaatacagagttctttcttcattgcttatttttgccaattttttgaaggtcagatggttgtaggtgtgcaggtttatttctgagttctctactctgttccattggtctatttgtctgtttttgtaccggtaccatgctgttttggttactgtagccttacagtggagttttaagttgggtaatgtgatgcctttggctttggtgtttttgcttgggattgctttgactatttgggttcttgtttggttccaaatgaattttagaatacatttttctaattctgtgaaaaatgatatgctattttgatagggatagcattgaatctgtaaattgctttgggaagtgtggccattttaacaataatattgattcttctcatccataagcatggaatttttttccatttatttgtcatctctgatttcattcagcaatgttttatagttctccttgtagagatctttcacctccttgattaggtatttcattttttgtggttattgtaaatgggattgtgttcttcatttggttctcagctagaacgttactgatgtagagaaatgctactgattttgtatcctgaaactttaataatttgttcatcaggtccaggaggcttttggtggagtctttagggtattctatgtaactcatatcatcagcaaagagagatagtttgacatcttgttttcctatttggatgcctttcacttctttctcttccataattgctctggctcagactttcagtactagaagtggtgagaatgggcatccttgtcttgttccagttctcaaggggaatacttccaacttctgcctattcagtatgatgttggctctatgttagtcatagaaagctcttattattttgaggtgtgttccttcaatgccttgtctgttaagggtttttatcatgaaggggtgttggatttcatggaagatgttttgtgcatctaccaggctgctctggggtccaaggcctatggaggtcccttgtggacttgagtgttgcctccttatacactctgggcaggcagctccctgtatcagtctatatgcctgggggtcaggaggaatctcccatcccaggattgcacaggtccccgcaggaagtgtagatcccccaggggctctcactcactatggaaaccatttagttgcccatagtaatgtggttgaattctctttaactgccttatacatgtttataagttgctgtttgaatccccttcccaggacatgactggtaattgtgtgtggtttgtattaattttgttccttggagcttggagaagccagagagggagtaggtgattctaggactctgtgcaacctcctgaagtgacatttttctctgcgattgttttaaaactcacaaactgatggctgctttagcaattgcagggtaagggaaatacctagttctatgggacgtgcccttgaggttttgcttttgtacttctttaaggtggctgttggctgctttggtggcttcctagtgtacagtaatattgctgggcctgattttttttctagcaaatcttcataatgcagctaagctattcagatctaagagataattttctagacatttttctgatttctttctggctagaaggagtatatgattaatcttcattcaagctggggcagaaatgctgttttcttttttaaacagggttgcatgtctctagttgagaagtttatctcttaccttagtcaccttttctgtcaaaagtgggctatccgtagggtattttgaatgtaatgactcacctttcaccctctgtatgtatgatcctttgtggagaaagaactgtgtattagctctaaatttgtgatatgagttgagccccttctctggattctgaagattcttttcatgttttgtttgtttgtatatttcagtcatggaagaggagattcattatacctgtctatttcctaaaatccatcacctgttttctcagtgtttctctctctcctatttactcagcttctctgtatctataggctgcttcctcttcactggaaccatgctttagtcattcctcacatggactggggaggacaagtgtgacaggatggcttctgttgatgtttctactgccttacatctttctctttattaccaaatatgtaatcttttattaagtataaagataaaaggatagttaaatataaagagttcaacaacatagaaaataaaaaggccttgtaattcatccgtaattctccccatcctgaaatagtcctgattaacattttatatataatcttccagttttatattttatgattcacataccttgttttattttaaaaaatggaattataccaggtgatttgaaagtcttattttcaacttttgtttgttttgaaactgttcatttaatatatcataatagacatctttctgtgtgaaatacagatttatgtagtcttttttattgctttatgagttccattgtatacttatactgtttaattagttccctaataacagatatttaaatcatttaaaatatttcttttttattattattatactttaagttctagggtacatgtgtacaacgtgcaggtttgttacatatgtatacatgtgccatgttggtgtgctgcatccattaactggtcatttacattaggtatatctccgaatgctatccttcccccctccccccaccccacaacaggccccactgtgtgatgttccccatcctgtgtccaagtgttctcattgttcaattcccacctatgagtgacataggtgtttgtttttctatccttgcgatagtttgctcagaatgatggtttccagcttcatccatgtctctacaaaggacgtgaactcatccttttttatcactgcatagtattccatggtctatatgtgccacattttcttaatccagtctgtcattgatggacatttgggttggttccaggtctttgctattgtgagtagtgccacaataaatatacgtgtgcatgtgtcttgatagtagcatgatttataatcctttgggtatatacccagtaatgggatggctgggtcaaatggtatttctagttctagatccttgaggaatcaccacactgtcttccacaatggttgaactaatttacagtcccaacaacagtgtaaaagtgttcctatttctccatatcctctccagcacctgttgtttcctgactttttaatgatcaccattctaactgttgcgagatggtatctcattgtggttttgatttgcatttctctgatgggcagtgatgatgagcattttttcatgtgtctgttggctgcataaatgtcttcttttgggaagtgtctgttcatatccattgcctagttttgatggggttgtttgatttatttcttgtaaatttgtttacgttcgttgtagattctggatattagccctttgtcagatgggtagattgtaaaaattttctcccattctgtaggttgcctgttcactctgatggtggtttcttttgctctgcagaagctctttggtttaattagatcccatttgtctattttgtcttttgttgttattgcttttggtgttttagtcatgaagtccttgcccatgcccatgtcctgaatggtattgcctaggttttcttctagagtttttatggtggtaagtctgacatttaagtctttaatccatcttgaattaatttttgtataagctgtaaggaagggatccagtttcagctttctatatatgtctagccagttttcccagtaccatttattaaatagggaatcctttccccatttcttgtttttatcaggtttgtcaaaggtcagatggttgtagatgtgtggcattatttctgagggctctgttctgttccattggtctatatctctgttttggttaccagtaccatgctattttggttactgtagccttgtagtatagtttgaagtcaggtagcgtgatgcctccagctttgttcttttggcttaggattgtcttggcaatgcgggctcttttttgattccatatgaactttaaagtaggtttttccaattctacgaagaaagtcgttggtagcttgatggggatggtattgaatctataaattaccttgggcagtatggccattttcacaatattgattcttcctatccatgagcatggaatgttcttccatttgtttgtgtcctcttctatttcattgagcagtggtttgtagttccccttgaagaggtccttcacatcccttgtaagttggattcctaggtattttattctctttgaagcaattgtgaatgggagttcgctcatgatttggctctctgtttgtctgttattggtgtataggaacgcttgtgatttttgcacattgattttgtatcctgagactttgctgaagttgcttatcagcttaaggagatttggggctgaggcaatggagttttctaaatttacaatcatgtcatctgcaaacagggacaatttgacttcctcttttcctaattgaataccctttatttctttctcctgcctgattgccctggccagaacttccaacactgtgttgaataggagtggtgagagggcatctctgtcttgtgccagttttcaaagggaatgcttccagtttttgcccattcagtatgatattggctgtgtgtttgccataaacagctcttattattttgagatatgtcccatcaatacctagtttattgggagtttttaacatgaagggctgttgaattttgttgaaggccttttctgcatatattgagataatcatgtggtttttgtctttggttctgtgtatatgatggattacatttattgatttgcatatgttgaaccagccttgcatcccagggatgaagccaatgtgatcatggtggataagctttttgatgtgctgctggattcagttttccagtattttattgaggatttttgcatcaatgttcatcagggatattggtctaaaattctctttttttgttgtgtctctgccaggcctaggtatcaggatgatgctggccttgtaaaatgagttagggaggattccctctttttctgttgattggaatagtttcagaaggaatggtaccagctcctctttgtacctctgatagaattcaactgtgaatctgtctggtcctggactttttttggttgataggctattaattattgcctcattttcagagcctgttattggtctattcaaggattcaacttcttcctggtttagtcttgggagggtgtatgtgtccaggaatttatccatctcttctagattttctagtttatttacatagaggtgtttatagtattctccgatggtagtttgtatttctgtgggatcggtggtgatatgccctttatcattttttattgcatctatttgattcttctctcttttcttctttattagtcttgctagcggtctatcaattttgctgatcttttcaaaaaaccagctcctggattcattgatttttggaagggttttttgtgtctctatctccttcagttctgctctgatcttagttatttcttgccttctgctagcttttgaatgtatttgctgttgcttctctagtttttttaactgtgacattaggatgtcaattttagatctttcctgctttctcttgtgggcatttagtgctataaatttccctctacacactactttaaatgtgtcccagagattctggtatgttgtgtctttgttctcattggtttcaaagaacatctttatttctgccttcatttcgttatgtacccagtagtctttcagaagcaggttgttcagtttccatgtagttgagcggttttgagtgagcttcttaatcctgagttctaattgggttgcactgtggtctgagagacagtttgttatcatttctgttcttttacatttgctaaggagtgctttacttccacctatgtggtcaattttggaataagtgcgatgtggtgctgagaagactgtatattctgttgatttggggtggagagttctatagatgtctattaggtctgcttggtgcagagctgagttcaattcctggatatccttgttaactttctgtctcgttgatctgtctaatgttgacagtggggtgttaaattctccaattattattgtgtggaagtctaagtctctttgtaggtctctaaggacttgctttatgaatctgggtgctcctgtattgggtgcatatgtatttaggatagttagctcttcttgtttaattgattcttttaccatcatgtaatggccttctttgtctcttttgatctttgttggtttaaagtttgttttatcagagactaggattgcaacccctgcctttttttgttttccatttgcttggtagctcttcctccatgcctttattttgagcctatatgtgtctgtgcacatgagatgggtctcctgaatacagcatactgatgggtcttgactctttatccaatttgccagtctgtgtctttcaattggagcatttaggccatttacatttaaggctaatattgttatgtgtgaatttgatcctgtcattatgatattagctggttattttgctcgctagttgatggagtttcttcctagcattgatgttctttacaatttggcatacgtttgcagtggctggtaccggttgttcctttccatatttagtgcttccttcaggagctcttgtgagacaggcctggtggtgagaaaatctctcagcatttgtttgtctgtaaaggattttatttctccttcacttatgaagcttagtttggctggatatgaaattctaggttgaaaattcttttctttaagaatgttgaatattggcccccactcctttctggcttgtagagtttctgctgagagatcagttgttagtctgatgggcttccctttgtgggtaacctgacctttctgtctggctgcccttaagattttttccttcatttcagctttggtgaatctgacaattatgtgtcttggagttgcttttctcgaggagtatctttgtggcattctctgtatttcctgaatttgaatgttggcctgccttgctaggctggggaagttctcctgggtaatatcctgcagagtgttttccaacttggttccattctcctcatcactttcaggtacaccaatcagacatagatttggtcttttcacatagtcccatatttcttggaggctttgttcatttctttttactcttttttctctaaacttctcacttcatttcattcatttgatcttcaatcactgattctctttcttccacttgattgaatcagctactgaagcttgggcatctctcacatagttcacgtgccatggtttttagctccatcaggtcatttaaggtcttctctatgctgtttattctagttagccattcatctaatcttttttcaaggtttttagcttctttgcaatgggttcgaacatcctccttttgctcagagaagtttgttattaccaatcatctgatgcttacttctgtcaactcgtcaaagtcattctccatccagctttgttccattgctggaaagcagctttgttgctttggaggggaagaggtgctctgatttttagaattttcagctgttctgctctggtttctccccatgtttgtggttttatctacctttggtctttgacgatggtgatgtacagatggggttttggtgcggaggtcctttctgtttgttagttttccttctaacagtcaggaccctcagctgcaggtctgttggagtttgctggagctccactcctgaccctgttcacctgcgtatcaccagcggaggctgcagtacagcaaatattgcagtacagcaaatgttgcagcctgatccttcctctggaagctttgtctcagaggggcacccagctgtatgaggtgtcaagttgtcccctaatgggagatgtctcccagttagggtactcgggtgtcagggacccacttgaagaggcagtctgtccgttctcagatggcaaactccatgctgggagaaccactactcccttcaaagctgtcagacagggatgtttaagactgcagaagtttctgctgccttttgttcagctatgccctgccctagaggtggagtctacagaggcaggcaggccttgttgagctgtggtgggctccacccaattcatgctttccggctgctttgtttacctactcaagcctcagcactggcggacacccctcccccagcctcgctgccaccttgcagtttgatctcagactactgtgctagcagtgagtgaggctctgtgggcatgggaccctccaagccaggcgtggggtataatctcctggtgtgccgtttgcttagactgttggaaaggtacagtgttagggtatgagtgtcctgattttccaagtaccatctgtcacggcttcccttggctagtaaagggaattcccctaccacttgcacttcccggatgaggtgatgccccaccctgcttcggctcacactccatgggctgcacccactgtccaacaagccccattgagatgaacctcgtacctcggttggaaatgcagaaatgacctatcttctgcatccctcatgctgtgagctgtagactggagctattcctattcagctatcttggaaccctccggtggttttgaagttcatcactttttttagctatctccaggcctccttatctcacatgaaaattatatgcaagtgtcacttcagaatttccttctgaagatgcatcagactaatgtttggctagcattctcttcagagtttttccaggcccagtgaaaatagccaggctttttttgtcttaccaccttacaacaaacagcttaagtcctatccaactactacattctcccaacacagatacaaggcagcatgttcacattatctcaagcttcctccaaatacatctcaacagttagaattggattagaaagaggacttgttggcttgcttatcctgtgggtaactgtgacattgactgcaggtaataataacaagatctcttttatttttctaggtggcaaaccatgtgatttcttctgactctatttcctcttctgccagtagtttcctgagctcgaactctactttttgcaacaagcagaatgtacacatgttaaacaagggcacacaagcaggtaattacttgaatctgaactttttcattgaaatacattgaaatggctcttaaacatataagatactcaacctcaatcatagtaaaggacatgaagttaaaactatatccaactgccaattttcatcttatcagattggcgtaaattcaagtgtgatggcaagtttgtgggcaagagtgtagggaagtgtgttcccttgtatattccagtgggagtagaagttggtttactgtgaaagacaatttgacaggtcctgtcaaaattactttcactcagcatttttacctttgaaatgtctgctatagatatactatgaatatgtggattttaacctatagatatacttgcatatgtgcaaaatagtgtacaaaattaaccactgaaacattgttttttatagcagaagattaaaatgaatttaggtattcctcaatagctgaatgattacataaattattgtatatctggataatgaatgaaattctacatagaatgaggaagctctctctttactaacgtggaaagatctccaaggcatataactgattttaagaaaaggtacagaacagtgtatggcatactacaatatgagtttttttaaataaaagaaataaaggagggaagagaattgcttaaatgtgcaaaatgaattctctggaaccatatggggttgtgaacagagtaaatggagaccagaagtgggaaggaggatttttagctattgcctttctatacttttggtttcataaaataaaaataaataaactttcttgatttgtttcttcccctcaaatcctgtctttacttctgtcaacctcttccatacctgggtgactaccaaaaggactctaagtatttattgtctttctgccttgggatccaggtggaaattctttaccctttgaacccatattcattcttctttccctctcatacctaaaatgacttacaaataaaaccctttcttttttcttctccctctttttccctcctactctcccctgtccttccttcttttcctctctcttcccatcactccatcccacacaaagggattgtatttttgaaacattaaaaaggttcacatactcacttgaataaacctgtcaactcagcctcaaggttactcccagagacacctgtgatccttcccctcaggtaacttggagattgtgaacggtgccgaaaaacacactcgagccaactccaagttccagcgaggctaaattggaagaggacagtgatgtgacttcttggtcagaagaaaaacatgaagagaaaatgctctttaccagttatcctgaggacagaaagttaaaaaagaacaagaagaattcccatgaaggtcagtttctcattccagatcttgtagtagagaaactagtgaatttcaagtcccctgcaatgctgactctgtgtttccaagtgattctatgtgacccccacctacccccagtcaccaccttgtcagattttcgaagtccagcatggcagttacacagtcatccctgcagtgaaaccaaactcaagggcaccctgtggccgctgacagctgagacccctgagagcctgtattatatgcatctccttgatgaaagccaggtggggctgtaaaaagtgaaaattctgttttacttctaaaaactatttcctgtaggagtttcctggtttgttcctgtggaaaatgtggagtctagataaaaagaaggaaaacatgctcaagactcatgaccctggcatctcccggttggaaccagtaaccaagaccaagccgtggagggagccactgtgggagcggaactggcaggggcagcacctggacagtcggggctacctggcaggcccaggcagagaggatggcagaaacccactgaagctgtttgtgagagcaaccctgcaggtgcagtgacgtttacttaactttagccctacatgtagggagaagaagggtaaggcgcagagaagctggctctgtgacttggcgagctgaggtgtaggcctgagacgctcttttccagcacctccgcagttcacctgttttcacacgtgaggactgagtttctcatcatctgtcaaaggctgccttactcttagccatagatggtgcatcactgtcaggatctggagacaagggcacaggagggaggatttgtggctctgctcattgggtttgtgggtccctgtgtgtggagggcccagaggcctgatgcttgtgcagcctcatgcatgttcctccatgtccgcagctcctgtttctgctccatgtcggatttaaaggaaaccaagtctcttctgatgtgtccctctggggataaaggaaaagttattaatgatgtatttgtttgaatagatctttaaaatagcagcatgggcagagctgtattgcgttgatgtttcagagagttgtaatcgccatagtcttagttcctggcctatgctgaaggcatgtctttgatccctgtgggttccaagctgcagctctccgccatagagaggtgtcagaggtttcttcaactctaggtattttctcggcatttgaatcaggcttccccagacctcttgggtacgtggtgtgtttccagccatatggagagtagattgcatcattaatctgaggctgggtattttctctctctctctcttttttttttttttttttaaggaatcgcttcagtttcacagacctgacttcatctcccacattggggagcggataaagcgtctgaagttaatagtccaggagagaaagctgcagagcatgttaaagagcgagcgggatgcgctattcgacattgacagggaacggcagggccaccagaatcgcatgcgcccactacccaagagaggtacgccctgcccgttcactttcctgtgagtggaatagagaaggcaaggtctgctgctgtgctgcagagccctgctaaaggccagcccaggccagttacctgggcagacagcaaccttttgcttgccaagactcaaaccttcttagctaacagaacctccccaccttagccgtcagcacattcatgatccaagtaagcccagttactctagccctgtcactgcatcttaaaccagctctgtctgtgagcaagttagttccaaaagtatattgatttttcctgaaaagatggggctgattccaggcttgcctacctcttaggatggtaataatgataataataaacacatagtccttacatcttgcccaggcactgttcacattagcgcttacagcactctcagtaggtactattaatatatctactttatagtgagaaaactgaatcaaagggagattaactacctctcccaaggtgacatactcaggtgtgctgctctggagtctgcattcttaacaattatggtaagcagatcttgataaaataatgaaagctgtgaaaactacaaagtactatctaattctttcatcaagccttacctggaaactggccagttttttaattcaaagcctagtctttgctacagagtgttaggtccttagggccttaggctgctgtcctgttaccctagtctaaccctggcttgccttggtcattgctccccactcagtcttgccagctcagggtaggggcaccaagtcctagcagctccctctcccagctcttgcaccacaccctctgggttaagtcactgtccactgaaaaccctttcttctcttccttagtcttcctggctgtccagaagaacaagcctatcagcaagaaggaaatgattcagaggtccaaacggtaagaccaagaaaacaagagtttgtgtacaagtgttaaccaggccaccaagtggtcaggagctctggcttgcacccagaataaaggcattatgctcaaatttaaacattatgagaaagttgtgagagtcatttctcacttatggcactgaaaaaaaaagtagcacatcatggtatgaatgactcatatgcaaaagatgaaaaacttctcattaatttgcatatcttaggctcctctttattaacctaaatgtaaataaagaatattttaggccaggtgcggtggctcacgcctgtaatcccagcactttgggaggtcaaggtggataaatcacttgaggtcaggagttcgagaccagcctggccaacatggtgaaaccccgtctctactaaaaatacaaaaagtagccgggcgtggtggtgcacgcctgtaatcccaaccactcagaaagctgagccgggaggatcctttgaacctgggaggcagaggttgcagtgagcttagatggcactactacactccagtctgggtgacagagcgagactccatctcaaaaaaaaaagattattttaaaataaaattaaatatgtatttgggttattataccttttatcttagcaatcccatttcttggaattgatcccatagggtgagaaagaacagtgttctccagaacatattaagttaaacttttttaaaaaattaaattttcgaagtatgtcaacactgtttccatttgtggtctttaaaagtaagtatttgtgcctatgtagacgtgtatacttttatatgcatagaatatttctggaagacagaaaaacctgataatactgattgcctttggaaaggagaactgatgtaggatgtagtagattttttgactttttgaatgttgtgtcatgaggaacgaacattagttactcataaattaattcatttgagtgttggatgtggtggtacatttctgtaatcctacctactcaggagtcttaggtgagagaatctcttaagcccaggaatttgagactgcagtgagctatgatcacaccattacgctctggcctgggtaacagactgagactctgtatctaaaaaataataaataatattttaaaaaattaattcatttcagatattgatatattgatcatgggaatgccagagaataagttaaggttgacttttttaggtgttcattagagacttgctttaatgagaatagtttcttagttggcataatgcttctgaagtaaaggtactttaaaacagtttatcttacggactttaagcattcctcttgaaatcttgtttttactctttctagtcagtctttataggcaatccaaagggatgctttggatgctttagtccagtggttctcagagagtggtctgtggagtcctggaagtcgctgagaccctttcaggcaatttgcaaggtcaaaactaatttcagaatgacaccaggatgttctgtgccttttttgctgtgttggctatttgcactgatgatgcaagagtactgggagaggagtaaaaccattggtgtcttaccactattcaagacggtggcaccaaaccgtactagtctaataggcattgtatcctgcacagcctcccgccaggagtgtgatggaagaacaaggaagcagtgtaaatggaggtaaacgggaagcacttcctttgcaccgtgaaagatgatgactgtttcaaggaaaagcacttatgccatggtttgtgtcgtgagctgaaccagctgcctttgtcatggaacatgacttttaattgaaagagtaactgacagaaaaccaattattctgacttgtgtttagcagacattttcttgaaaatgaagaagtgactctctgacttcaggaaaatgtctgacagtatctgttgccaaagaaaatgtgagttttcaagccaacaatagaattctagaaaacttgtattcaccaccatgggcttgatgacatcttagtacttagacctttctgacgagatagcagtgacattaacaaatgtgacgtttttcatgttatctaaatacatttgtcaacatttggaagatctgcacaactccctggaccaggattttccaaatgattgttgctttttgttacaaaatcagggaatagatagaagattcaaatagtacaagatagactgatggatttttatgtaacagaataggaaaagtttgctgacatgctttcagattccaccttgcaactaatttttaagaaactaccacttgtcagccaggcacagtggctcacgcctcataaaatgagttggaatgaagtttttctttcttattctctagaagaatgtaatgtaatttattgcttaaataattaggagaattcaccagtgaaacccatctgggcctggattttcttttgtgggattcatttttttcaataactattcagatttcagtttttcttttatgccaaggtttagtaagttgtgttttttacgtaatttgttcatttcctagaaatttacaaattgatgatccaatgttataatatccttttgttatctttttttttttttttttttgagacggagtctcgctctgtcgccctcaggctggagtgcagtggcacgacctcggatcactgaaagctccacctcccaggttcacaccatcctcctgcctcagcctcccgagtaggtgggactacagacatccgccaccacgtctgactaattttttgtatgtttagtggagacagggtttcactgtgttagtcaggatgttctcgatctcctgacctcgtgatcagccctcttcggcctcccaaagtgctgggtttacaggcatgagcccccgcacctggccctttgttatctttttaatgtctggacgttctaggatctgtagtgatgttccgtttttattcctgatattatttttgcctcctgtcatttttacctgatcactctttccaaggggtatataaatttcactagtattgtcaaataacccactttgggttttattgatttttctctatcgtatattggtcttatattgattttttgttgtttattttggggccgtagcaggagccacagccagctccacatagttcagagggcctggcaagtatggaggaagacccttgctttcccctggaggtgctgagagtttaattcccgaggaagtaaggggattatttccctgtattggcaaaggttctagtttttgagtagaactagaggacctcacttctcttgaaggagaagtagagaggctcctcctcattcccttccctacaagtccccacgtgactgattcttcctctccaggggcttctagaattagcaacattgttccctttgatcctttggctgattacatatcctgcatttcttctgtagggctgggtgttgatagagggccataagacattatacataaggtattttatcccatttaccttgtttcttacaaaataagtcccagttggagaattgtagtattaatgtatgtaagtaactcatgttcagaccatctctcttgattccgtagggaacactggggccatatggtattacagtaatatatcatttgctttttggtcatggatatgggtatccaaatagtttccagtgctggaggaggcactgtaacgggctctcctccagtattgagacctggttccccatattctagggtctttgcccagaaggctgattccaccctccaagaagcttccactggggattagtgatgacacaaatcctgtaactcttagcctgtaggatatttctggtcctttcagcttgctgctacacgcaggccactatggagtggaggtgctgggaagctaggagaggacaataggggttgcctctccctggatcatgttcagtctgggtagcttccctggaaatctcatggagattccacagtagttccggatccagcttgagtggtgggaggtatgtaaatcaatcaagtaagcaaggtgttctttctggagagggtgcacactctgctcatgtaaagtctacatcactgtattttggttccaggaattcccacccaaactgccccattctaaattaggcctcttcaaatcaataacagttcttctgtgactgctggaatatggaagcccaatattttagggattaccacagactaaggagaagggaatccagacttcacatgcattcaggccacaaagaaacacaagtattggcaaaagtgacaagcattcagcctacagatataccagacagggacaaagtcttaaagatgagagtcctcgtctttatattagggcttcccctgttaaaatggatggagacatctctcaactcctagacctgaaggggagtcctgcccattcccaacagtcctggatcccttgagctaggtcctaaacctgacaacccagagtcctaataatcaaaaccaaaaccactcttttagtcagttcacagaaccaccaccacttactgcctcaaaattgcaccaaatgaaaggtccaagcagccacttctgctttcctggtgggctggggggatggggttggcatgcctgaggcccttcaccaatctccctcttggcaacttaacccactcatgcttcctcagactgctgcttcgcctgtaagcagcctataagggaggtcgagtcagggctcagtccatagtcccatctggatcaaccagatttgtttcccaggccctcccaccccactgcctccaaaaaaaaagcggggtttgtttgcctggtgagtaacaaaagtcgctgagaacacagactttgatcaataggagttttattacttgtcacaagtaggaagagctctgggaatattcgtcaaagcagtgtctcctaagagaaaatgacaggaaggctttatagagtgatcgagaggggagaaggtgcatcatcacatgaagaggaggggtcccagtgacacagatggagggagtcatcgtgccaccacataggacgcatgctatggtaatgaaactatagctctcccagggtgcaggatttagcattgtaatgaggaaagttcactgtaagtgagttcatctataagttgctggggtctgtcaggagcaggttccaactgactaggtgaccacatttcacacagggtttgagacaaaaccgtctgcaaggcagaaggctgtaaaacgggctaattgctcaaattcattaaattccttcactccctgggggcccgccctgtcttgtctatatagccagtccttaggaagtgaggccaagctgaactgttgacacagtctatgtctttacgagtctgggagctgggtgattttacctctgatgctagacttatttttactggttttgaagccttgcttacagccctttcccagtttctcacgaaatactcatgaaaggggatggtggggagtgggcatggggaaaagggaatgatattaaaattaaagctaacatcattggcctctagggggcactcatggctcatctccatagcccttggctcttgcagctgcccaagatgagagtcctgatctaaggaaactccaccaccaccaaggctggggtggtggcaatgggggcattattttccaaacctgactaggctacattttaaggggatcatagtcacagagaacatagatgtggactattaattttctttgcctgagcagccgtagccctatgtgctcctctccagcctttcagggagctatgatgggccaaaaaatgctcagtagcccaagccatctcctccatagacactggagtaaaatctctgcctatgggtgtgtgtgtcttgtcttactctatcctggatttgtttcctccaatgctggtggctttactttagatagtctgattgttgcagagatgagacccaaggctccactctggagaaaatagagccctcttgagaggtcagcccaacttgctagacttctgcatggggcttggggttcaatgttccagcctgtccccaaaaagtcatggccaaattcacatattcctttgatccctgatggtgtctcatcacacagttcgtctggcctcaccattgctccactaagtccaggaacctcaaggaactatgagacaggtagggctagacttaacaaaatggctatcacagtcttcatttcatgagacagaggtgaactgagaaaaggtggaaggtgcttcagagacttctctgtattcatccctaacttaggcagagagccttggccacacaggaaactggggaagacccctctcttactcaggagtcccccacactggtgccatcttatgacaggcaggcatcagcttcagagccagtcaaacagttaggaatagcaaacattgctccagaatttgttggggttttttttcccctgaatttgatagtaagctccacataggcaagaatgacaaccatcttgttctccttgtttctctggagtctaacacaacatgtagcacgtggttggcccaataagaatttgtcgaatgggggccagatgtggtggctcatgcctgtaatcccagcactttgggaggctgaggtgggagagtcgtttgaggcctggagttcaagatcaacctgttcaacatagtgagacccctatcttcttttttttttttttttttttaaagtggagtttgttgaatggcacacagaaaataaacaatccaaatgacagatcagaggtgctggaaaagaccagggagatctaatcgttaaatcacgtcatctaaatattaagaggagacatttggacatctgatagaatttggcattgaataagtgataaatacacagaaaactgaacaacggcaaaaagaaaagtatcagttctaagggaaaagatacaaatcaaaagccttcaggaaaggataagtcatcatggcttactgtatagcttagcttaaaataacacagaatagtgaagtagcccaaagggccatctaaccacactgggaagctgagcaggggaggagtgcgtatatgcatggaggagacttgtcttcaccctcctcagcagctgacagcaggcaggctagacctggacaatggagcaggagtcacacagcctgtgaaagaagtgctggggaatgtaggggctgctgtttcacatgacagagccattgaaccctggctgtttataatagttacatacataattttaatagaaataaaaaccaaaaagaaaaaagacttaaacatgaaaggcaaaaccattacaatttttagaggaaaatataagagagtaagaacagaaaaatgtcttaaggcacaaagtgctaaccataaagaaaaagattgataaattcatcttgataaattttttgtttatcaaaaggcaccataaagacagtgaaaagacaaggcacaaaatgggagaagataattgcagcacatctgaccagcaaagaatttgtatccagaatatataaagaacttctatgagtcggttttttaaaaacacaatttatatttaagtctctttaaaacaaatagacaattcatagaaatatggtgatatggtttggctgtgtccccacccaaatctcatcttgaattgtagcttccataatttccacatgttgtgggagggacccagtgggaggtaattgaatcatgggggcagatttttcccatgttcttgtgttagtgaataagtctcatgagagctgatggttttataaagagcagtgcccctgcacaccctctcttgcctaccaccacataagatgtgcctttgctcctccttcacgttctgctgtgattggtccgcatccaaatgtcatcttgaattgtagctcccataatcctcatgtgttgtgggagggacctggtgggaggtaattgaatcatgggggcagatttttcccattttcttgtgatagtgaataagtctcatgagagctgagggttttataaaaggcagttcccttgcacaagctttcttgcctaccatcatgtaagatatgcctttttcattataagttacccagtcttggatatttcttcacagtggtatgaaaatggactaatacacatgggctaaactcatgagcaggcaactttatagaaaaacacaaatagcccataaacataaaatgtagattgagttcattattaattagggtaatgcatgttatggatagaataaaatacctttttacattcactggattggcacaaagttttgtctttgtgccactctaaatgttgacagggatgttgatcaactggaattcacacactgcttgaggaagcttgcattcactctataattcagcattctgaaaagtgctcaccaataatcagcccaggaaggttcacaaggacatcttcaccaaatatgtcctttcaccctagcaaagaactagaaacaactcaagtgtcttttgacaagagaatgagtaaatggcaagtggtatgtcacgcaaaagaattctagacagaagagaaaattaaggaacatcaaacttagtgaatctttgagacgatgttgagtaggaaaaaaaattcagaagaatatattgtatgatacttttatcataaggtttaaaagcaagccaaggtaaacatgtgcagggacacctagggacccatgtcattttaggatcaaacagatagatggacagatgatagatagacagacagatggatttttttaactcaaaatagtggttacatccttagggagctgggattggagaagagacacttagctttgaaagtattgtcaaatatagtgacctttctagttcatttgggtgctgggttcaggggtattcattttattatgcaccataatttatgtgagacattttattatatcaaatattttctaatcttacagtaagcagtttggtaaacagattcataactgcatataatgtgtaggtcttgtgaacaatgctgctgtgaatatcaggacccaactgcacttgtctctcactgccttttgtaagcctgctcaattggggagttcttccccttatactggagatgagaactcaggtaatgcctcgactgttcggatcactgtcaggggattacatgttctaccgtgctgacttttcactgaaagcccagtctccactcaataagtaaaagtgtaataatcgaaactcccaatttgagttccacttaaaatcttctctcttcccctgccagacctctctgcaccatctaggggagcatagtcccctctgtccctgcctgacagggctctcctcctcagcagcacagggaggtgtctgacccatctgtgtgtgtgtgtctatgtggtggggatggggaccatagcttggcatcctgccctctcaccctggcagttcattgtctcaagctgactttcttgggtgttttcatggcttcttctgaggcctccctctggaatattggatcgtaactccagcaatgcaagcaataggttttcctccagcttctggtcctcctcctcctcctcctcctccccaaacctggtttctagcagtcactccactgagactcagagtcttcttggcccagtgccagcctcttgcatgtcccaaaccttgtcctcaggaaacacttatgcatcctatgctggggtgaactcttaagagtgcaggatcacctcatggccacagcctagctaggccctgaaacccacactctgggtttgtcagacgtgagtcagccccaggccactgaacctctcccactgcagggaatccctgtcaagtggtgaaagccagcatctagacctggagtcacaggcacctgtagcataactcctcctgaaatggaggtttttctttagagattggtccatatcccttatccctggacttctgagaagggtggacaacctgtggactggacttgagtctggaatttagagaagtgtccatagtagggctgccagatgaggcaaacacaaatacaggatgcccaattaaatttgaatttcagataaatgatttttaatgtttgattctgtcccatgctaaaaattgcccactgtttatgataagtttaaatttattggtccattctgtactttatcaaggacacacgcaggaggaacagtagcacaaaggcttcccggtgccttgtgggtgaaagaaaggcttccagggaaaggagagaaacacccagggatcccggtgacgtcgggaagcagcacccagaccatgtaaggacaccgcctgcagggggagactcaaggcctgggaaggttttctaatctgtgccttgagtcgggtggggggattttctgggaaaggaaaaccagacacagtaggacaaatattgtatagtttcacttatatgaaattgtcagaataggcaagttcgtagagacagaatgtagaacagggctttccgggggctggaggagaagacaaggagttcttgcctagtgggtacagagtttctgtttgaaatgatgaaaaacttctggaaatagattgtggtgacagttacacaccattgtgaacataattagtaccactgaactgtacacgttaaaatggttagttgtatgttttatgtattttgccataataaaaactagggggaaaaaaaggaaggggagattgtctcaggctggctgactttccctgcatgtacgcacatcttcacatgtgcacacatgtaaaacaaaaatgaagcaaaaaaagaaattctaatttaaccagtaagcaatatgtaaaaggaaatctgaatgtcattacaattttaccaggttcagaataaaataccatccttcaaaatgaacaaattacttattagccgaagaaaggtgaaaggaagtttggaattaacagtctagattttctcactgattggtccaagtcactgacctctaaaattatcttagatcatgccctccctccttcctactttctggaaaacaatcagtctcctaccctatgcttgcccaaagagtttcccatacaaatcacaaatctgcacttgccattccctggaagcccttacattcccaaggcctggcctcatccactgccactgcccatggccccagtccaggcaaagcaatcactccctctccctctctgtcattcctttcttttcctttcactctctttctaccctcctcttccccactctctgtttcctctctctctctctatctctctctccccaccatctcctctctctgtctccccccgccttctctctctgtctctgtctctctgtttctctgtgtctctctctctgtctctctctttgtctctctctctgtctctctctcacacacacacacacacacacacacgcacacacacacacagccagcaacattctacctctgccagagttccaggttgaataggtgtggactttgactttcagattcctctggcaagtgtcaacatcagtcctgttgctccctggcagaggaggacttggagtcaccttggccaagaagctgtctggaggtcacagtggcaccgcccatcggccccttggctgaggctagatgagggcagattcagcacagcagcaactctccccataaaaaaaatccctcagtgtcttagttctctgacccttgtactccttgtgagttttagagccacatgaactcttcttttttcccaatgcttggagacaaaatttacataacctacagttagccattttcaagtgtacagttccctgccatttggtacattcacagtgttttgcaagcaacacccatatcaagccccaaaacattttcattacccaggaaggaaacctgtcgtcatggaaccgtcactcctcacatccccttcccctcaaaccctggcaaccccaaaccgttcttgacagcctcctttggcatttcttcattttggtgtcagatctcacagcagaatttcttacctattatatccagtgcctcagtgcgaagttccagtttaacttcctgttacctcgagcccactatcttgccccaataataccctcccccaattcacaaacacagacgcattccctcctacagctttgggcctcctatctgagtccttcaggaaagaagagcttgtaactcccttagcagtgagtgtagacttggtccaaggaagatgagcaccagtcagggcagctggcccctcctctctccctggtcttcagcaaatcagcactgcccatcgatgcccaggcaatgggagcgtcgaccagcagaggacacacctgaatttctctgcctcatgggagggcggccactgtgttgcatttaggaagaagctgtgcaagattcatactgttttgctaatgttaatcttgtgggcataataaacgtcgtacccacacttaactttcgagatcagacaagattgggtgtgttcagggtggtatggccgtagaccccacacttatttttaacacacttctaggcaaggctgctgcactggtctggggatcacactttgagtagcaaaggactaaattgcaataactgccggggggggagaaaaaaaaacaggatgaactgcttcctcctggctcagcagctagggagtcactgaactaacaaggggatggggtggggataagaatgttccaggcaaaaggaacaacatgcccaaaggcctcaagcagaaagagagcttcaggtattgaagaagtagaagtagctctgtgtggctggggagtgggcataagatggagcagaagaatgccaagtcctattcctgggtctgaatttccaggagcagaagccctgtcccctctagaaggtggatatagtctggatatttgtcttcttcaaatctcatgttgaaatgtgacccccagtgttggaggttggacctagtaggaggtgtttaggtcataagaagtggatccctcccgaatggtttggtgccctcctcatgactgagttgttactctattagttcgtgtgagagctggttgtttaaaaaagcctggcatctctctggttccctctcttgccatgtgacacaactgctcccccttcacccttccccatgagtaaaagcttcctgaggccctcaccagaggcatatgccagccctgtgattcttgtacagcctgaaaaactgtgagtcaaataaacatcttttcattataaattacctagtctcagatatttctttatagcaacgcaaaatagactatcacagaaagtcggtaccgaggagtagggcgttgctataaagatatctgaaaatgtggaagtggctttggaactgggtatgaggcagcggttggaagagtctggagggcccagaagacagaaagatgagaaaaggtttggaccttcttagagatttgtaatgtcgttgtaaccaaaatgtggacagaaatatgtacagtaaaggccagcctgatgaggtctcagatggaaatgaggaagttatggggaactggagcaaaggtcacccttgttaagccctagcaaagaacttggctgcattgtatctatgtcctagggctttgtggaaggctgaacttaagagtaatgacttagggtatctggtagaagaaatgtctaagcagcaaagcattcaagaaatggcctggctgcttctaatagcctatgatcagatattggagcaaaggactgacttaaatttggaactattaaatcaaactaaaatctggcctgagaaagcctcctcactcccatacttgagtccttaaggatgaaccataacctaactttgtaggtaggccaactgaaaacctaacttagaaggatgcttctgtagcaatagctgagcgtcagccaatcgcagcagccatgcttcagtgactcacaggcagcctattgttcaaaccatgttcaaataaggcaaacaccatgctgtaaccaatttggctatttctgtacctcacttcggctttctgcgtgtcactttactttttctattcataaggttttttccgaccacatagcatctctggtgttgctctgaatctgctgtgattctagggactgcctgatttgtgaattgtctttttttttttcttcaaaattaaattctgttaaatttagtttgtctaaggtttttcttttaccagatctggtgttggaagtgcaatttgaagtaaaactctggtgacctccaggaacaccaggtgaccaggccagttgtgctcactgatctcttgattgtaactggaggttgtagatgcgttttctcttggattcagagctccactaatgtgtattctaattgaagctctccaactttactggagcgatattaaagtggactgggttcaggatcaaatttgaatcaataattaactggattaggttccgttagagcctcagacctatactaggcactttttttttttttttttttttgataatgggtttgtctcaatccaaagattctgggactctaccttctgggactccatctaatttgatatgtaaaattatggacccagaatatgtgcatttttagaaaaatagattaaccttactagagaaaagatggccacaatggggaagttttaatttgtataaaattgtttatttgcatggcatattagaaaaagggggtcaaaaccccacaaaaacagtgggatatagtctttcattggtacatggaagcctctaaaagacaaaatgaatgaaaacttgcctccttaaaagattcttcgcaaaagcaagtgaacagcttaagtaacaggctaaggacatgatgaaagagaactgtactctgactgaactaaccccaactgattcttctctttatgcatctctacctacgtactctgagtctactaacctttttactaaattgacctttcactctcaagatgatgaaaaaagaggaattagatgtacgcctcacaaaggaagaccttctgattatccaggcctgcctgctataaccactttcactccatggtctaaaactgagcttagagctattgtagaagacttccctgatctaggagagaatcctcaaaaattgactgaggagtgtagaatcctcataggagattatgatccaggactccctgacaaaggttcatataaatttattcatatgatatggaggcctggtgaagctcaaaaatggatggcagca

SEQ ID NO: 115 - DNA, 53101 bp, Homo sapiens
ttgaccaaattcccatatgtgactaaggctctgttccttcttcaagatccagtttagtgctacctgctccgtccacttctgaccacccaaccagatgaatctggtcccagtccctccctccttggaagcctttgcatttctcattaagcacttgtattgctgccatttgttgcttacttaataattaacttatcatagttaattagactagaaattaacagttcaactaccctgataaactattttgtctttctattgcctctatgaacctgattataataaatcattgtattgttggagtcactgttattcccagagctgtcaggtttcagagcagcgtgtcagtgccaccccatgcctgcatccgggaagatcactcctccactggaccagcccagcctggaaaggggccagtgaggcggaaggtggacaatccagggccaatacattctgggagtctcagaggaagagaaaaatcgattcagactcatttaacataggctcctggaaaggatatcatctcccccaatctctcatcaataacccaacatcagatcagtgccctggacttatcatatgaagcagaatgaaagtagacagataggtcatccttggttagatgtccagaaatccgaggatggtggtcctagctcttcagagaggacacgttctttaacctaaccttttaacaaattctctacagaagatatcaggtcccaacatttcaagtagcttcgtagatataggtaatcaaaggactaattatgaaagtgtagatgggtagaggggagcaacaaggatggcacaggaacccatagccctgaggaggagggagagttgttggaacctgaaaggacctgggcagagcaggctgcccttagagcaggcctggggccaaggcacaatcaataccaagcctgcctcacgctctcttccctccactcctcaacttgctgctggctttcagaaaagttaagaacttgccatttctacccctttgccattgttgttgtcttaccataaggcggggagcaatatagtatccagttttctagatatggaagtggaaatcaggtgtatatacccagtatattagtacctattagtattcttattggtattactttctagatgttatgtaactgtagctttggattttctatttaattcaaaagacatataagagttttttttttgctaattccatgttggatttattgtcactacttattaagttataattttaatgtattgtgattagagattgtactgtgttctatttgtgttttaaggatacatagagattttctttgtggctaaatataagtaatccatgggtgttttaaagaaggtagagtttccaaatagagtatgacattccagtcactgtcagattccacacaacatttcagtcagccacagaacatataaatgatagcagtcccatgagattaaaatagtatatttttcctacaccttttctttatgtagatattttagatacacaaatacttaccactgtgttaaaattacctacaatagtcagtagagtaacatgctgtacaggtttgtagcctaggagcaataggctataccttatagcctagatgtgtagtaggctgtaccatctaggtttgagtaagcatacgctgtgatgttcacacaacaatgaaatcacctaacaatgcatttcttaatatacatctattaaatcattttattaattaaattatattcttcctgaatattgattttcttaatctgtcgagaacttcaaagagtatattttaagttaattgaatatagcttttgttaattgaatggttttatatatatatatatatatatattttttttttttttttttttttttttttttgagaaggaatctgcctctgtcacccaggttggagggcagtggcgtgatctcgacttactgcaacctctgcctcctggattcaaacgattctcctgccacagcctcctgagtatcttggactataggtgtgcaccaccacacccggctaagttttgtatttttagtagagatggggtttcaccatgttggccaggatggtctcaaactcctgacctcaagcgttccacccacctcggcttcccaaagtgctgagattacaggcatgagccacagcacccggcctggttatatatatttttattttcggcacataaatattaatgacatgaatattaatgacacttttttcactgtgaatcataccataaatcatataaagtaacttttattttacattttgaatatgttttgccttttattctacttcatccaatacagttttattaaatgtggatttgtaccattgctctttgtccatccttttacttttggcttttctgagtcacttcactcaagtggaagtagcacctacttgaatttaacttttttcccccacccaatttgaaggtctttttttgaagtgagttcaacttaagttcattgttgtaacaaatatgtttggtttaaattttatcatttccctttttgtttttttttccttttctggtaaacttattaagttaatgtttgttaaactaaattccatttcaaacggtgggaaggagtaaaaaacacctaacataaagtttaccatcttaagcattcttaagtgtacaggtcagtaatgttaaatatattcacattgttgtgagacagatctccagaacatttgaatattgcaaacctgaaactctatacccattgaataacaacttcccttgtcctcctcccccagcttctggtaaccaccattctactttctgtctctgtgaatttgtcgataccaagtttggaagataagaaatatcttttaattcctgattttgtgtgataagagaaataaaatatctaccctttagtgactgactcatttcacttagcataagatccttaagattcatccatgttgtagcatgtgacaggatttcctccctttttaagtcaggataattttccgtgggttgtgtgtgccacatttatgtatccattcctcagtggatgggcatctgtgttgcttccacatttgcctattgtgagttgtgctgctgtgagcatgggtatgctgttagctttttaagtccctgcttactgtgcttttggagacatactcagaagagggattactgaatcaaatggtagttctaagtttcacctttggaggaatctcaatactgatttccagagcagttgtgccattttacattgccaccaacagcacacatgagacccattttatctacatcctcaccaatacttgttattttcttttttttttataatgaccgtcctagtgggtgtgaggtgatatttcattgttgttttgatttgcattgctctgatgattggcgatatagagcatcttttcacatgcttgttggccatttgtatatcaactttggagaaatgtctattcaattcctttgcccatttttggtcaggttattgattttgttgtcattgttgaattctgagagttatttgtgtattctgtatatcagaatcatgagttgcaaatattttctcccaatccgtaggttgtcttttactctgttgaatgcatcccctgaggcacaacttaagcctggtggtcccatttgtctatttttgcttttgttgcctgtgcttttggtgtcatattcaagaaagcactgccatattcaatgtcacaaagcctttcctctatgttttcttccaagactttgatagttttaggccttacacataggtctttaatccattttgagttaatttttttacataagactagagtccaacttcattcttttgcatgtgaatgtccaggtttccaagcatcatttgtgaaaaatctgttcttttcccattgagtggtcttggcacccttgtcaaaaatcattttggccagggacagtggctcacacctgtaatcccagcaatttgggaggccgaggtgggtggatcacctgaggtaaggagttcaagaccagcctggccaacatggtgaaaccctgtctctactaaaaatacaaaaaattagctgggtgtggtggcgcacatctgtagtcctagctactcaggaggctgagacaggagaatcacttgaacccaggaggcagaggttgcagagagccaagatcgtgccactgcactccagcctgggcgacagagcaagaccttgcctcaaaaaaaaaaaaaaaatcatttgaccatatgtgagagtttatttgtaggcactttatcatatttcgttggtctattcgtctgtctttatgctactatcacactattttgattattgcacctttggtaatatgtttgggttttcggttgttgttgattattttggtttgtttgttttttgtagagatggggtctcactgtgtttcccagtctgatatcaaatttctgggctcaagtgatcccccagtcttggtctccagaagtcctgagattacaggtctgagacgccgtgcccagccagtaatatgttttaaaatcaggaaatgtgagtcctccaacattgttgttctctttcaaaattgttttggctgttcaggatgtcttatgatttttactgatttcttgccatttccaatcttttttgttcattactatgtaatatatgcttcttattttattttatttttggagattgagtctcgctctgttacccaggctggagtacaggggcatgatcttggctcactgcaacctccacctcccgggttcaagctattctcttgcctcagcctcctgagtagctgggattacaggcatgtgccaccatgcccggctaatttttgtatttttagtagagatggggtttcaccatggtggtcaggctggtcttgaactcctgacctcgtgatctgcctgcctcagcctcccaaagtgctgggattacaggcgtgagccaccatgcccggccataatatatgtttctttgagctgtttttctgataacttagcggccatgtaatctaattaactaatatccttcaaccactttctcaatctatcactctcagacacgaaacagtatctgttgactctatcatatgaaaaattaagaaagtgactgcacttctccccacctgtgcccccacatacagacattcccccaactaaccaataatggttatattttgtggattttgtgtcagctcattgtagtagtattactacattgactagctttacttattcgtggattcttgtaggtttttaagattttatactatgcagccataaaaaatgatgagttcatgtcctttttagggacatggatgaaattggaaatcatcattctcagtaaactatcgcaagaacaagaaaccaaacaccgcatattctcactcataggtgggaattgaacaatgagatcacatggacacaggaaggggaatatcacactctggggactgttgtggggtggggggaggggggaggggtagcattgggagatatacctaatgctagatgacgagttagtgggtgcagcgcaccagcatggcacatgtatacatatgtaactaacctgcacaatgtgcacatgtaccctaaaacttaaagtataattaaaaaaaaattgaacaaaataaaaaaaaaagattttaagtctagttacttttctagggtatgtctcaatgtaggtcaagctctgtttttttattaattgagataaaattcacattccatacaattcttttttagtatataattcagcatgtttttgtatattcagaaagttatacatccttcacccctaattcctgaacatttttgtctccccaaaaagaaaccgtgtgcccattagcagttacctcccattacccttgttcttgcacccccgcctcgccctggcaaccactaatctactttctgtctctatgggtttgcctatatgagacattccacataaatggaattgtaaaatatgtggctttttgtatctagcttctttgacttaacatgatatttttaaggttgtagcgtatatcagtacttcattttttggtttgcagaataaaatccgttacgtggatttacaacattttatttatatattcatgaatggatggatacttgggttgtttgtacttttttactttcacaaataatgctgttataaattgttatagattgtgtacacgtttttgtgtggacataattttttcagttctcttggatatatacgtaggagtagaacagctgggtcatatggtaactctctgtttaacctttgagtaactccccaactgttttccaaagtggctgtgccgcgttatatttccaccaggatcatattagggtttcagtatttccacgtcctcgtcaataattgttattttctgatttttgattataaccatcctaatgagtgtgaagtgtcatctcattgtggttttgatttgcatttctctaatgactaataatgagaagcacctttttaagtgcctattagccatttgaatatcttctttgcagaaatttctattcagatcctatgctcatgtttaaattggcttatttttgttcttttattattgggttcgacgtgttctccatatattctgaacagcagtcccttattcactatgtaatttgaaaacatgtctcccattctttgggatgcttttcactttcgatggtatcatttgcagtacaaaatttttagttttgacaaagtccaatttatctacttttgtcatttgtgtttttcatgttgtgtttaaaactattgcctaacccaacatcacacacaaaaaaagtttacttctttgcttttttctaagagtattataattttagctcttaaattagggtctatgatcattttttagctaatttttgtatgtaatgtgaggcaggggatacagtttcattttttgcatatggatatccagttgaccccgcaccatttgttgcagagactattctttcttccattaaattgtctggggtcctttgccaaaaattaattgaccataaatgtaagagtttatttctagactcttaattctatttcattgatccatatgtctctgcaaatgccaccaccacaccgtcttgttgtggtgttcttgtggtaaattttgatgtgtgagtcctccaactttgtttttcttttataaaattgctttagctatttatgggttctgtgaactttaagatcagcttgccagtctctgaaaaaaaataaaaggcagcatgaatcttggtagggatgtcattgaatctatagttggaattggggagtactgacatcttaaaaatattaagacttctaatctatgaacatgggatctattcccatttagttaagtcttctttcatttctttcaacaatgtttatagtttttacttctttgcagttcggcacatctgtcattaaatgtatttctatatattttcttctttctaatgccattgtaaatgaatttgttttcctaatttcatttctaggttgtttactgctagtgtatagaaatacaactgatttttcttacattgatcatagattgtacaagcttgctgaacttgtttatcagctctaataatttgtgtgtgtatatgtgtgccttaggattttctatatagaataccatgtcatcttcaaatagagatggtttttctttctaatcttatgctattttttctttttctttgctgattgcctttgtttgaacctccagaactatgttgaatagaagtggcaagaatggatgtccttgtcttgttcctaatcttaaaagggaaagcttgacagtcattaagcataatatgagggatgagttatttgtagatgccctttaacaggttgaggaagttcccttccattcctagtttgttgagtgtttttaccatgaaagggttttttattttgccagaagccttttctatttctattgagctgattatatgttttccctttattctattaatatggtgcattatattgatttattcatatgataaaccaaccttgcattcctgagataaatcccacttggttttgatgtgtaatcccgtttctgtcttcttggattcagtgagctagtatttttgtagtattttacatctgtagtcacaagggatattggtctgcagttctgtgatatcttcgtctgcctttgatatcaggataatactggcctacatagaaggaatcaagaagtgatccttctgattatgttttttgtatgagattgtgaataattggtgttacctcttctttaaatatttggcagaacttatcagtgaagcttggtccaagctttacttttggagaagttttctgattattaactcagtcttttctcattataagcctactgagattttttatttcttcttgaatcgattttgatcatttctttatctagaaatttgtctacttaatctaggttgtctaatatcttggtatatgattgttcatagtatcccctcatccattcttaattttagtgatttgagtcttcggtttttccttggtgaatctagctaaagatttcagtttttgttgatgttttcaaagaccaaacttggtttctttaattttctcttgcattttcctaatctctgttttatttatttccattctaacatttagcatttccctccttctacttatttttgttttagttacatagaactttagttacgtagagctcatctttttctaattcctttttaaaataatttcaatttttattatagattaaaggacacatgtgcacatttattacatgggtatattgcttgacactgaggtttggggtataaataatcccatcacccaggtggtgagcatagtacccaatcggtggtttttcagcccattccctcctcctttcctcccatctagaagtcctcactttgtattattctcatctttatgtatattcagtgttcagctcccgcttgtaagtgagaacatgcagtatttggttttctgttcttgcattaattggcttaggataatggcctccagctccatccatgctgctgcaaagggcatgattttattttatttttatgtctgcacggtatttcgtggtgtatatacactacattttctttatccatccactgttggtggccacctaggttgatttcatgtctttgctattatgaatagtgcgggaaagagcatgtgagtacatgagattttttgacagaatgaattcttttccttcgaatatatacccagtagtgggatcgctgggttgaacagtggttctttttcagttctttgagaaatctcccaactgctttatacaatggctgaaccagtttgcattcctaccaacagtgtataagcattcccttttctctgcagccttgactgcatctgttattttttgactttttaataatcagaattctgactggtgtgagatgttatctcattgtggttttgatttgtatttctctgatgaatggtgatgttgagcattttttcatgtttgtcagctgcttgtacatctgcttttgagaagtgtcttcctgttctttgctccccctacttttttttttttttttttttttttgagaaagggtctcactctgtcacctaggcggtagtgcagtggcacgatcttggctcactgcaacctccgcctcccaggttcaagcaattcttgtgcctcagcctcctgagtagctgggattacagctaatttttaaatttttagtagagatgggatttcgccatattggccagctaattttttaaatttttagtagagatggggtttcgccatattggccaggctggtcttgaactcctggcctcaattgatcttcccaccttggcctcccaaagtgctgagattacaggtgtgagccaccgtgcccagcccctttgcccatttttacaaatggaattatttgatttttgctttttaaatttttacatttccttacagattctggacattagagatttgttggatgcataatttcctaatattttctcccattctgtgagttgtctcttgattgatcatttattttactgtacagaagctctttggtttaattaggtaccaatcatcaatttttttattttgttacaattgctattcaggacttagccataaactattttccaaagccaatattgagaagggtatttcctaggttttctgctaggatttttgtagtttgaggtcctccatttaaatctttaatgtaccttgatttttttaaatatagtgagaggtaagggtccagtttcttctgcatatggctagccagttatcccagcaccatttattgaatacagagttctttcttcattgcttatttttgccaattttttgaaggtcagatggttgtaggtgtgcaggtttatttctgagttctctactctgttccattggtctatttgtctgtttttgtaccggtaccatgctgttttggttactgtagccttacagtggagttttaagttgggtaatgtgatgcctttggctttggtgtttttgcttgggattgctttgactatttgggttcttgtttggttccaaatgaattttagaatacatttttctaattctgtgaaaaatgatatgctattttgatagggatagcattgaatctgtaaattgctttgggaagtgtggccattttaacaataatattgattcttctcatccataagcatggaatttttttccatttatttgtcatctctgatttcattcagcaatgttttatagttctccttgtagagatctttcacctccttgattaggtatttcattttttgtggttattgtaaatgggattgtgttcttcatttggttctcagctagaacgttactgatgtagagaaatgctactgattttgtatcctgaaactttaataatttgttcatcaggtccaggaggcttttggtggagtctttagggtattctatgtaactcatatcatcagcaaagagagatagtttgacatcttgttttcctatttggatgcctttcacttctttctcttccataattgctctggctcagactttcagtactagaagtggtgagaatgggcatccttgtcttgttccagttctcaaggggaatacttccaacttctgcctattcagtatgatgttggctctatgttagtcatagaaagctcttattattttgaggtgtgttccttcaatgccttgtctgttaagggtttttatcatgaaggggtgttggatttcatggaagatgttttgtgcatctaccaggctgctctggggtccaaggcctatggaggtcccttgtggacttgagtgttgcctccttatacactctgggcaggcagctccctgtatcagtctatatgcctgggggtcaggaggaatctcccatcccaggattgcacaggtccccgcaggaagtgtagatcccccaggggctctcactcactatggaaaccatttagttgcccatagtaatgtggttgaattctctttaactgccttatacatgtttataagttgctgtttgaatccccttcccaggacatgactggtaattgtgtgtggtttgtattaattttgttccttggagcttggagaagccagagagggagtaggtgattctaggactctgtgcaacctcctgaagtgacatttttctctgcgattgttttaaaactcacaaactgatggctgctttagcaattgcagggtaagggaaatacctagttctatgggacgtgcccttgaggttttgcttttgtacttctttaaggtggctgttggctgctttggtggcttcctagtgtacagtaatattgctgggcctgattttttttctagcaaatcttcataatgcagctaagctattcagatctaagagataattttctagacatttttctgatttctttctggctagaaggagtatatgattaatcttcattcaagctggggcagaaatgctgttttcttttttaaacagggttgcatgtctctagttgagaagtttatctcttaccttagtcaccttttctgtcaaaagtgggctatccgtagggtattttgaatgtaatgactcacctttcaccctctgtatgtatgatcctttgtggagaaagaactgtgtattagctctaaatttgtgatatgagttgagccccttctctggattctgaagattcttttcatgttttgtttgtttgtatatttcagtcatggaagaggagattcattatacctgtctatttcctaaaatccatcacctgttttctcagtgtttctctctctcctatttactcagcttctctgtatctataggctgcttcctcttcactggaaccatgctttagtcattcctcacatggactggggaggacaagtgtgacaggatggcttctgttgatgtttctactgccttacatctttctctttattaccaaatatgtaatcttttattaagtataaagataaaaggatagttaaatataaagagttcaacaacatagaaaataaaaaggccttgtaattcatccgtaattctccccatcctgaaatagtcctgattaacattttatatataatcttccagttttatattttatgattcacataccttgttttattttaaaaaatggaattataccaggtgatttgaaagtcttattttcaacttttgtttgttttgaaactgttcatttaatatatcataatagacatctttctgtgtgaaatacagatttatgtagtcttttttattgctttatgagttccattgtatacttatactgtttaattagttccctaataacagatatttaaatcatttaaaatatttcttttttattattattatactttaagttctagggtacatgtgtacaacgtgcaggtttgttacatatgtatacatgtgccatgttggtgtgctgcatccattaactggtcatttacattaggtatatctccgaatgctatccttcccccctccccccaccccacaacaggccccactgtgtgatgttccccatcctgtgtccaagtgttctcattgttcaattcccacctatgagtgacataggtgtttgtttttctatccttgcgatagtttgctcagaatgatggtttccagcttcatccatgtctctacaaaggacgtgaactcatccttttttatcactgcatagtattccatggtctatatgtgccacattttcttaatccagtctgtcattgatggacatttgggttggttccaggtctttgctattgtgagtagtgccacaataaatatacgtgtgcatgtgtcttgatagtagcatgatttataatcctttgggtatatacccagtaatgggatggctgggtcaaatggtatttctagttctagatccttgaggaatcaccacactgtcttccacaatggttgaactaatttacagtcccaacaacagtgtaaaagtgttcctatttctccatatcctctccagcacctgttgtttcctgactttttaatgatcaccattctaactgttgcgagatggtatctcattgtggttttgatttgcatttctctgatgggcagtgatgatgagcattttttcatgtgtctgttggctgcataaatgtcttcttttgggaagtgtctgttcatatccattgcctagttttgatggggttgtttgatttatttcttgtaaatttgtttacgttcgttgtagattctggatattagccctttgtcagatgggtagattgtaaaaattttctcccattctgtaggttgcctgttcactctgatggtggtttcttttgctctgcagaagctctttggtttaattagatcccatttgtctattttgtcttttgttgttattgcttttggtgttttagtcatgaagtccttgcccatgcccatgtcctgaatggtattgcctaggttttcttctagagtttttatggtggtaagtctgacatttaagtctttaatccatcttgaattaatttttgtataagctgtaaggaagggatccagtttcagctttctatatatgtctagccagttttcccagtaccatttattaaatagggaatcctttccccatttcttgtttttatcaggtttgtcaaaggtcagatggttgtagatgtgtggcattatttctgagggctctgttctgttccattggtctatatctctgttttggttaccagtaccatgctattttggttactgtagccttgtagtatagtttgaagtcaggtagcgtgatgcctccagctttgttcttttggcttaggattgtcttggcaatgcgggctcttttttgattccatatgaactttaaagtaggtttttccaattctacgaagaaagtcgttggtagcttgatggggatggtattgaatctataaattaccttgggcagtatggccattttcacaatattgattcttcctatccatgagcatggaatgttcttccatttgtttgtgtcctcttctatttcattgagcagtggtttgtagttccccttgaagaggtccttcacatcccttgtaagttggattcctaggtattttattctctttgaagcaattgtgaatgggagttcgctcatgatttggctctctgtttgtctgttattggtgtataggaacgcttgtgatttttgcacattgattttgtatcctgagactttgctgaagttgcttatcagcttaaggagatttggggctgaggcaatggagttttctaaatttacaatcatgtcatctgcaaacagggacaatttgacttcctcttttcctaattgaataccctttatttctttctcctgcctgattgccctggccagaacttccaacactgtgttgaataggagtggtgagagggcatctctgtcttgtgccagttttcaaagggaatgcttccagtttttgcccattcagtatgatattggctgtgtgtttgccataaacagctcttattattttgagatatgtcccatcaatacctagtttattgggagtttttaacatgaagggctgttgaattttgttgaaggccttttctgcatatattgagataatcatgtggtttttgtctttggttctgtgtatatgatggattacatttattgatttgcatatgttgaaccagccttgcatcccagggatgaagccaatgtgatcatggtggataagctttttgatgtgctgctggattcagttttccagtattttattgaggatttttgcatcaatgttcatcagggatattggtctaaaattctctttttttgttgtgtctctgccaggcctaggtatcaggatgatgctggccttgtaaaatgagttagggaggattccctctttttctgttgattggaatagtttcagaaggaatggtaccagctcctctttgtacctctgatagaattcaactgtgaatctgtctggtcctggactttttttggttgataggctattaattattgcctcattttcagagcctgttattggtctattcaaggattcaacttcttcctggtttagtcttgggagggtgtatgtgtccaggaatttatccatctcttctagattttctagtttatttacatagaggtgtttatagtattctccgatggtagtttgtatttctgtgggatcggtggtgatatgccctttatcattttttattgcatctatttgattcttctctcttttcttctttattagtcttgctagcggtctatcaattttgctgatcttttcaaaaaaccagctcctggattcattgatttttggaagggttttttgtgtctctatctccttcagttctgctctgatcttagttatttcttgccttctgctagcttttgaatgtatttgctgttgcttctctagtttttttaactgtgacattaggatgtcaattttagatctttcctgctttctcttgtgggcatttagtgctataaatttccctctacacactactttaaatgtgtcccagagattctggtatgttgtgtctttgttctcattggtttcaaagaacatctttatttctgccttcatttcgttatgtacccagtagtctttcagaagcaggttgttcagtttccatgtagttgagcggttttgagtgagcttcttaatcctgagttctaattgggttgcactgtggtctgagagacagtttgttatcatttctgttcttttacatttgctaaggagtgctttacttccacctatgtggtcaattttggaataagtgcgatgtggtgctgagaagactgtatattctgttgatttggggtggagagttctatagatgtctattaggtctgcttggtgcagagctgagttcaattcctggatatccttgttaactttctgtctcgttgatctgtctaatgttgacagtggggtgttaaattctccaattattattgtgtggaagtctaagtctctttgtaggtctctaaggacttgctttatgaatctgggtgctcctgtattgggtgcatatgtatttaggatagttagctcttcttgtttaattgattcttttaccatcatgtaatggccttctttgtctcttttgatctttgttggtttaaagtttgttttatcagagactaggattgcaacccctgcctttttttgttttccatttgcttggtagctcttcctccatgcctttattttgagcctatatgtgtctgtgcacatgagatgggtctcctgaatacagcatactgatgggtcttgactctttatccaatttgccagtctgtgtctttcaattggagcatttaggccatttacatttaaggctaatattgttatgtgtgaatttgatcctgtcattatgatattagctggttattttgctcgctagttgatggagtttcttcctagcattgatgttctttacaatttggcatacgtttgcagtggctggtaccggttgttcctttccatatttagtgcttccttcaggagctcttgtgagacaggcctggtggtgagaaaatctctcagcatttgtttgtctgtaaaggattttatttctccttcacttatgaagcttagtttggctggatatgaaattctaggttgaaaattcttttctttaagaatgttgaatattggcccccactcctttctggcttgtagagtttctgctgagagatcagttgttagtctgatgggcttccctttgtgggtaacctgacctttctgtctggctgcccttaagattttttccttcatttcagctttggtgaatctgacaattatgtgtcttggagttgcttttctcgaggagtatctttgtggcattctctgtatttcctgaatttgaatgttggcctgccttgctaggctggggaagttctcctgggtaatatcctgcagagtgttttccaacttggttccattctcctcatcactttcaggtacaccaatcagacatagatttggtcttttcacatagtcccatatttcttggaggctttgttcatttctttttactcttttttctctaaacttctcacttcatttcattcatttgatcttcaatcactgattctctttcttccacttgattgaatcagctactgaagcttgggcatctctcacatagttcacgtgccatggtttttagctccatcaggtcatttaaggtcttctctatgctgtttattctagttagccattcatctaatcttttttcaaggtttttagcttctttgcaatgggttcgaacatcctccttttgctcagagaagtttgttattaccaatcatctgatgcttacttctgtcaactcgtcaaagtcattctccatccagctttgttccattgctggaaagcagctttgttgctttggaggggaagaggtgctctgatttttagaattttcagctgttctgctctggtttctccccatgtttgtggttttatctacctttggtctttgacgatggtgatgtacagatggggttttggtgcggaggtcctttctgtttgttagttttccttctaacagtcaggaccctcagctgcaggtctgttggagtttgctggagctccactcctgaccctgttcacctgcgtatcaccagcggaggctgcagtacagcaaatattgcagtacagcaaatgttgcagcctgatccttcctctggaagctttgtctcagaggggcacccagctgtatgaggtgtcaagttgtcccctaatgggagatgtctcccagttagggtactcgggtgtcagggacccacttgaagaggcagtctgtccgttctcagatggcaaactccatgctgggagaaccactactcccttcaaagctgtcagacagggatgtttaagactgcagaagtttctgctgccttttgttcagctatgccctgccctagaggtggagtctacagaggcaggcaggccttgttgagctgtggtgggctccacccaattcatgctttccggctgctttgtttacctactcaagcctcagcactggcggacacccctcccccagcctcgctgccaccttgcagtttgatctcagactactgtgctagcagtgagtgaggctctgtgggcatgggaccctccaagccaggcgtggggtataatctcctggtgtgccgtttgcttagactgttggaaaggtacagtgttagggtatgagtgtcctgattttccaagtaccatctgtcacggcttcccttggctagtaaagggaattcccctaccacttgcacttcccggatgaggtgatgccccaccctgcttcggctcacactccatgggctgcacccactgtccaacaagccccattgagatgaacctcgtacctcggttggaaatgcagaaatgacctatcttctgcatccctcatgctgtgagctgtagactggagctattcctattcagctatcttggaaccctccggtggttttgaagttcatcactttttttagctatctccaggcctccttatctcacatgaaaattatatgcaagtgtcacttcagaatttccttctgaagatgcatcagactaatgtttggctagcattctcttcagagtttttccaggcccagtgaaaatagccaggctttttttgtcttaccaccttacaacaaacagcttaagtcctatccaactactacattctcccaacacagatacaaggcagcatgttcacattatctcaagcttcctccaaatacatctcaacagttagaattggattagaaagaggacttgttggcttgcttatcctgtgggtaactgtgacattgactgcaggtaataataacaagatctcttttatttttctaggtggcaaaccatgtgatttcttctgactctatttcctcttctgccagtagtttcctgagctcgaactctactttttgcaacaagcagaatgtacacatgttaaacaagggcacacaagcaggtaattacttgaatctgaactttttcattgaaatacattgaaatggctcttaaacatataagatactcaacctcaatcatagtaaaggacatgaagttaaaactatatccaactgccaattttcatcttatcagattggcgtaaattcaagtgtgatggcaagtttgtgggcaagagtgtagggaagtgtgttcccttgtatattccagtgggagtagaagttggtttactgtgaaagacaatttgacaggtcctgtcaaaattactttcactcagcatttttacctttgaaatgtctgctatagatatactatgaatatgtggattttaacctatagatatacttgcatatgtgcaaaatagtgtacaaaattaaccactgaaacattgttttttatagcagaagattaaaatgaatttaggtattcctcaatagctgaatgattacataaattattgtatatctggataatgaatgaaattctacatagaatgaggaagctctctctttactaacgtggaaagatctccaaggcatataactgattttaagaaaaggtacagaacagtgtatggcatactacaatatgagtttttttaaataaaagaaataaaggagggaagagaattgcttaaatgtgcaaaatgaattctctggaaccatatggggttgtgaacagagtaaatggagaccagaagtgggaaggaggatttttagctattgcctttctatacttttggtttcataaaataaaaataaataaactttcttgatttgtttcttcccctcaaatcctgtctttacttctgtcaacctcttccatacctgggtgactaccaaaaggactctaagtatttattgtctttctgccttgggatccaggtggaaattctttaccctttgaacccatattcattcttctttccctctcatacctaaaatgacttacaaataaaaccctttcttttttcttctccctctttttccctcctactctcccctgtccttccttcttttcctctctcttcccatcactccatcccacacaaagggattgtatttttgaaacattaaaaaggttcacatactcacttgaataaacctgtcaactcagcctcaaggttactcccagagacacctgtgatccttcccctcaggtaacttggagattgtgaacggtgccgaaaaacacactcgagccaactccaagttccagcgaggctaaattggaagaggacagtgatgtgacttcttggtcagaagaaaaacatgaagagaaaatgctctttaccagttatcctgaggacagaaagttaaaaaagaacaagaagaattcccatgaaggtcagtttctcattccagatcttgtagtagagaaactagtgaatttcaagtcccctgcaatgctgactctgtgtttccaagtgattctatgtgacccccacctacccccagtcaccaccttgtcagattttcgaagtccagcatggcagttacacagtcatccctgcagtgaaaccaaactcaagggcaccctgtggccgctgacagctgagacccctgagagcctgtattatatgcatctccttgatgaaagccaggtggggctgtaaaaagtgaaaattctgttttacttctaaaaactatttcctgtaggagtttcctggtttgttcctgtggaaaatgtggagtctagataaaaagaaggaaaacatgctcaagactcatgaccctggcatctcccggttggaaccagtaaccaagaccaagccgtggagggagccactgtgggagcggaactggcaggggcagcacctggacagtcggggctacctggcaggcccaggcagagaggatggcagaaacccactgaagctgtttgtgagagcaaccctgcaggtgcagtgacgtttacttaactttagccctacatgtagggagaagaagggtaaggcgcagagaagctggctctgtgacttggcgagctgaggtgtaggcctgagacgctcttttccagcacctccgcagttcacctgttttcacacgtgaggactgagtttctcatcatctgtcaaaggctgccttactcttagccatagatggtgcatcactgtcaggatctggagacaagggcacaggagggaggatttgtggctctgctcattgggtttgtgggtccctgtgtgtggagggcccagaggcctgatgcttgtgcagcctcatgcatgttcctccatgtccgcagctcctgtttctgctccatgtcggatttaaaggaaaccaagtctcttctgatgtgtccctctggggataaaggaaaagttattaatgatgtatttgtttgaatagatctttaaaatagcagcatgggcagagctgtattgcgttgatgtttcagagagttgtaatcgccatagtcttagttcctggcctatgctgaaggcatgtctttgatccctgtgggttccaagctgcagctctccgccatagagaggtgtcagaggtttcttcaactctaggtattttctcggcatttgaatcaggcttccccagacctcttgggtacgtggtgtgtttccagccatatggagagtagattgcatcattaatctgaggctgggtattttctctctctctctcttttttttttttttttttaaggaatcgcttcagtttcacagacctgacttcatctcccacattggggagcggataaagcgtctgaagttaatagtccaggagagaaagctgcagagcatgttaaagagcgagcgggatgcgctattcgacattgacagggaacggcagggccaccagaatcgcatgcgcccactacccaagagaggtacgccctgcccgttcactttcctgtgagtggaatagagaaggcaaggtctgctgctgtgctgcagagccctgctaaaggccagcccaggccagttacctgggcagacagcaaccttttgcttgccaagactcaaaccttcttagctaacagaacctccccaccttagccgtcagcacattcatgatccaagtaagcccagttactctagccctgtcactgcatcttaaaccagctctgtctgtgagcaagttagttccaaaagtatattgatttttcctgaaaagatggggctgattccaggcttgcctacctcttaggatggtaataatgataataataaacacatagtccttacatcttgcccaggcactgttcacattagcgcttacagcactctcagtaggtactattaatatatctactttatagtgagaaaactgaatcaaagggagattaactacctctcccaaggtgacatactcaggtgtgctgctctggagtctgcattcttaacaattatggtaagcagatcttgataaaataatgaaagctgtgaaaactacaaagtactatctaattctttcatcaagccttacctggaaactggccagttttttaattcaaagcctagtctttgctacagagtgttaggtccttagggccttaggctgctgtcctgttaccctagtctaaccctggcttgccttggtcattgctccccactcagtcttgccagctcagggtaggggcaccaagtcctagcagctccctctcccagctcttgcaccacaccctctgggttaagtcactgtccactgaaaaccctttcttctcttccttagtcttcctggctgtccagaagaacaagcctatcagcaagaaggaaatgattcagaggtccaaacggtaagaccaagaaaacaagagtttgtgtacaagtgttaaccaggccaccaagtggtcaggagctctggcttgcacccagaataaaggcattatgctcaaatttaaacattatgagaaagttgtgagagtcatttctcacttatggcactgaaaaaaaaagtagcacatcatggtatgaatgactcatatgcaaaagatgaaaaacttctcattaatttgcatatcttaggctcctctttattaacctaaatgtaaataaagaatattttaggccaggtgcggtggctcacgcctgtaatcccagcactttgggaggtcaaggtggataaatcacttgaggtcaggagttcgagaccagcctggccaacatggtgaaaccccgtctctactaaaaatacaaaaagtagccgggcgtggtggtgcacgcctgtaatcccaaccactcagaaagctgagccgggaggatcctttgaacctgggaggcagaggttgcagtgagcttagatggcactactacactccagtctgggtgacagagcgagactccatctcaaaaaaaaaagattattttaaaataaaattaaatatgtatttgggttattataccttttatcttagcaatcccatttcttggaattgatcccatagggtgagaaagaacagtgttctccagaacatattaagttaaacttttttaaaaaattaaattttcgaagtatgtcaacactgtttccatttgtggtctttaaaagtaagtatttgtgcctatgtagacgtgtatacttttatatgcatagaatatttctggaagacagaaaaacctgataatactgattgcctttggaaaggagaactgatgtaggatgtagtagattttttgactttttgaatgttgtgtcatgaggaacgaacattagttactcataaattaattcatttgagtgttggatgtggtggtacatttctgtaatcctacctactcaggagtcttaggtgagagaatctcttaagcccaggaatttgagactgcagtgagctatgatcacaccattacgctctggcctgggtaacagactgagactctgtatctaaaaaataataaataatattttaaaaaattaattcatttcagatattgatatattgatcatgggaatgccagagaataagttaaggttgacttttttaggtgttcattagagacttgctttaatgagaatagtttcttagttggcataatgcttctgaagtaaaggtactttaaaacagtttatcttacggactttaagcattcctcttgaaatcttgtttttactctttctagtcagtctttataggcaatccaaagggatgctttggatgctttagtccagtggttctcagagagtggtctgtggagtcctggaagtcgctgagaccctttcaggcaatttgcaaggtcaaaactaatttcagaatgacaccaggatgttctgtgccttttttgctgtgttggctatttgcactgatgatgcaagagtactgggagaggagtaaaaccattggtgtcttaccactattcaagacggtggcaccaaaccgtactagtctaataggcattgtatcctgcacagcctcccgccaggagtgtgatggaagaacaaggaagcagtgtaaatggaggtaaacgggaagcacttcctttgcaccgtgaaagatgatgactgtttcaaggaaaagcacttatgccatggtttgtgtcgtgagctgaaccagctgcctttgtcatggaacatgacttttaattgaaagagtaactgacagaaaaccaattattctgacttgtgtttagcagacattttcttgaaaatgaagaagtgactctctgacttcaggaaaatgtctgacagtatctgttgccaaagaaaatgtgagttttcaagccaacaatagaattctagaaaacttgtattcaccaccatgggcttgatgacatcttagtacttagacctttctgacgagatagcagtgacattaacaaatgtgacgtttttcatgttatctaaatacatttgtcaacatttggaagatctgcacaactccctggaccaggattttccaaatgattgttgctttttgttacaaaatcagggaatagatagaagattcaaatagtacaagatagactgatggatttttatgtaacagaataggaaaagtttgctgacatgctttcagattccaccttgcaactaatttttaagaaactaccacttgtcagccaggcacagtggctcacgcctcataaaatgagttggaatgaagtttttctttcttattctctagaagaatgtaatgtaatttattgcttaaataattaggagaattcaccagtgaaacccatctgggcctggattttcttttgtgggattcatttttttcaataactattcagatttcagtttttcttttatgccaaggtttagtaagttgtgttttttacgtaatttgttcatttcctagaaatttacaaattgatgatccaatgttataatatccttttgttatctttttttttttttttttttgagacggagtctcgctctgtcgccctcaggctggagtgcagtggcacgacctcggatcactgaaagctccacctcccaggttcacaccatcctcctgcctcagcctcccgagtaggtgggactacagacatccgccaccacgtctgactaattttttgtatgtttagtggagacagggtttcactgtgttagtcaggatgttctcgatctcctgacctcgtgatcagccctcttcggcctcccaaagtgctgggtttacaggcatgagcccccgcacctggccctttgttatctttttaatgtctggacgttctaggatctgtagtgatgttccgtttttattcctgatattatttttgcctcctgtcatttttacctgatcactctttccaaggggtatataaatttcactagtattgtcaaataacccactttgggttttattgatttttctctatcgtatattggtcttatattgattttttgttgtttattttggggccgtagcaggagccacagccagctccacatagttcagagggcctggcaagtatggaggaagacccttgctttcccctggaggtgctgagagtttaattcccgaggaagtaaggggattatttccctgtattggcaaaggttctagtttttgagtagaactagaggacctcacttctcttgaaggagaagtagagaggctcctcctcattcccttccctacaagtccccacgtgactgattcttcctctccaggggcttctagaattagcaacattgttccctttgatcctttggctgattacatatcctgcatttcttctgtagggctgggtgttgatagagggccataagacattatacataaggtattttatcccatttaccttgtttcttacaaaataagtcccagttggagaattgtagtattaatgtatgtaagtaactcatgttcagaccatctctcttgattccgtagggaacactggggccatatggtattacagtaatatatcatttgctttttggtcatggatatgggtatccaaatagtttccagtgctggaggaggcactgtaacgggctctcctccagtattgagacctggttccccatattctagggtctttgcccagaaggctgattccaccctccaagaagcttccactggggattagtgatgacacaaatcctgtaactcttagcctgtaggatatttctggtcctttcagcttgctgctacacgcaggccactatggagtggaggtgctgggaagctaggagaggacaataggggttgcctctccctggatcatgttcagtctgggtagcttccctggaaatctcatggagattccacagtagttccggatccagcttgagtggtgggaggtatgtaaatcaatcaagtaagcaaggtgttctttctggagagggtgcacactctgctcatgtaaagtctacatcactgtattttggttccaggaattcccacccaaactgccccattctaaattaggcctcttcaaatcaataacagttcttctgtgactgctggaatatggaagcccaatattttagggattaccacagactaaggagaagggaatccagacttcacatgcattcaggccacaaagaaacacaagtattggcaaaagtgacaagcattcagcctacagatataccagacagggacaaagtcttaaagatgagagtcctcgtctttatattagggcttcccctgttaaaatggatggagacatctctcaactcctagacctgaaggggagtcctgcccattcccaacagtcctggatcccttgagctaggtcctaaacctgacaacccagagtcctaataatcaaaaccaaaaccactcttttagtcagttcacagaaccaccaccacttactgcctcaaaattgcaccaaatgaaaggtccaagcagccacttctgctttcctggtgggctggggggatggggttggcatgcctgaggcccttcaccaatctccctcttggcaacttaacccactcatgcttcctcagactgctgcttcgcctgtaagcagcctataagggaggtcgagtcagggctcagtccatagtcccatctggatcaaccagatttgtttcccaggccctcccaccccactgcctccaaaaaaaaagcggggtttgtttgcctggtgagtaacaaaagtcgctgagaacacagactttgatcaataggagttttattacttgtcacaagtaggaagagctctgggaatattcgtcaaagcagtgtctcctaagagaaaatgacaggaaggctttatagagtgatcgagaggggagaaggtgcatcatcacatgaagaggaggggtcccagtgacacagatggagggagtcatcgtgccaccacataggacgcatgctatggtaatgaaactatagctctcccagggtgcaggatttagcattgtaatgaggaaagttcactgtaagtgagttcatctataagttgctggggtctgtcaggagcaggttccaactgactaggtgaccacatttcacacagggtttgagacaaaaccgtctgcaaggcagaaggctgtaaaacgggctaattgctcaaattcattaaattccttcactccctgggggcccgccctgtcttgtctatatagccagtccttaggaagtgaggccaagctgaactgttgacacagtctatgtctttacgagtctgggagctgggtgattttacctctgatgctagacttatttttactggttttgaagccttgcttacagccctttcccagtttctcacgaaatactcatgaaaggggatggtggggagtgggcatggggaaaagggaatgatattaaaattaaagctaacatcattggcctctagggggcactcatggctcatctccatagcccttggctcttgcagctgcccaagatgagagtcctgatctaaggaaactccaccaccaccaaggctggggtggtggcaatgggggcattattttccaaacctgactaggctacattttaaggggatcatagtcacagagaacatagatgtggactattaattttctttgcctgagcagccgtagccctatgtgctcctctccagcctttcagggagctatgatgggccaaaaaatgctcagtagcccaagccatctcctccatagacactggagtaaaatctctgcctatgggtgtgtgtgtcttgtcttactctatcctggatttgtttcctccaatgctggtggctttactttagatagtctgattgttgcagagatgagacccaaggctccactctggagaaaatagagccctcttgagaggtcagcccaacttgctagacttctgcatggggcttggggttcaatgttccagcctgtccccaaaaagtcatggccaaattcacatattcctttgatccctgatggtgtctcatcacacagttcgtctggcctcaccattgctccactaagtccaggaacctcaaggaactatgagacaggtagggctagacttaacaaaatggctatcacagtcttcatttcatgagacagaggtgaactgagaaaaggtggaaggtgcttcagagacttctctgtattcatccctaacttaggcagagagccttggccacacaggaaactggggaagacccctctcttactcaggagtcccccacactggtgccatcttatgacaggcaggcatcagcttcagagccagtcaaacagttaggaatagcaaacattgctccagaatttgttggggttttttttcccctgaatttgatagtaagctccacataggcaagaatgacaaccatcttgttctccttgtttctctggagtctaacacaacatgtagcacgtggttggcccaataagaatttgtcgaatgggggccagatgtggtggctcatgcctgtaatcccagcactttgggaggctgaggtgggagagtcgtttgaggcctggagttcaagatcaacctgttcaacatagtgagacccctatcttcttttttttttttttttttttaaagtggagtttgttgaatggcacacagaaaataaacaatccaaatgacagatcagaggtgctggaaaagaccagggagatctaatcgttaaatcacgtcatctaaatattaagaggagacatttggacatctgatagaatttggcattgaataagtgataaatacacagaaaactgaacaacggcaaaaagaaaagtatcagttctaagggaaaagatacaaatcaaaagccttcaggaaaggataagtcatcatggcttactgtatagcttagcttaaaataacacagaatagtgaagtagcccaaagggccatctaaccacactgggaagctgagcaggggaggagtgcgtatatgcatggaggagacttgtcttcaccctcctcagcagctgacagcaggcaggctagacctggacaatggagcaggagtcacacagcctgtgaaagaagtgctggggaatgtaggggctgctgtttcacatgacagagccattgaaccctggctgtttataatagttacatacataattttaatagaaataaaaaccaaaaagaaaaaagacttaaacatgaaaggcaaaaccattacaatttttagaggaaaatataagagagtaagaacagaaaaatgtcttaaggcacaaagtgctaaccataaagaaaaagattgataaattcatcttgataaattttttgtttatcaaaaggcaccataaagacagtgaaaagacaaggcacaaaatgggagaagataattgcagcacatctgaccagcaaagaatttgtatccagaatatataaagaacttctatgagtcggttttttaaaaacacaatttatatttaagtctctttaaaacaaatagacaattcatagaaatatggtgatatggtttggctgtgtccccacccaaatctcatcttgaattgtagcttccataatttccacatgttgtgggagggacccagtgggaggtaattgaatcatgggggcagatttttcccatgttcttgtgttagtgaataagtctcatgagagctgatggttttataaagagcagtgcccctgcacaccctctcttgcctaccaccacataagatgtgcctttgctcctccttcacgttctgctgtgattggtccgcatccaaatgtcatcttgaattgtagctcccataatcctcatgtgttgtgggagggacctggtgggaggtaattgaatcatgggggcagatttttcccattttcttgtgatagtgaataagtctcatgagagctgagggttttataaaaggcagttcccttgcacaagctttcttgcctaccatcatgtaagatatgcctttttcattataagttacccagtcttggatatttcttcacagtggtatgaaaatggactaatacacatgggctaaactcatgagcaggcaactttatagaaaaacacaaatagcccataaacataaaatgtagattgagttcattattaattagggtaatgcatgttatggatagaataaaatacctttttacattcactggattggcacaaagttttgtctttgtgccactctaaatgttgacagggatgttgatcaactggaattcacacactgcttgaggaagcttgcattcactctataattcagcattctgaaaagtgctcaccaataatcagcccaggaaggttcacaaggacatcttcaccaaatatgtcctttcaccctagcaaagaactagaaacaactcaagtgtcttttgacaagagaatgagtaaatggcaagtggtatgtcacgcaaaagaattctagacagaagagaaaattaaggaacatcaaacttagtgaatctttgagacgatgttgagtaggaaaaaaaattcagaagaatatattgtatgatacttttatcataaggtttaaaagcaagccaaggtaaacatgtgcagggacacctagggacccatgtcattttaggatcaaacagatagatggacagatgatagatagacagacagatggatttttttaactcaaaatagtggttacatccttagggagctgggattggagaagagacacttagctttgaaagtattgtcaaatatagtgacctttctagttcatttgggtgctgggttcaggggtattcattttattatgcaccataatttatgtgagacattttattatatcaaatattttctaatcttacagtaagcagtttggtaaacagattcataactgcatataatgtgtaggtcttgtgaacaatgctgctgtgaatatcaggacccaactgcacttgtctctcactgccttttgtaagcctgctcaattggggagttcttccccttatactggagatgagaactcaggtaatgcctcgactgttcggatcactgtcaggggattacatgttctaccgtgctgacttttcactgaaagcccagtctccactcaataagtaaaagtgtaataatcgaaactcccaatttgagttccacttaaaatcttctctcttcccctgccagacctctctgcaccatctaggggagcatagtcccctctgtccctgcctgacagggctctcctcctcagcagcacagggaggtgtctgacccatctgtgtgtgtgtgtctatgtggtggggatggggaccatagcttggcatcctgccctctcaccctggcagttcattgtctcaagctgactttcttgggtgttttcatggcttcttctgaggcctccctctggaatattggatcgtaactccagcaatgcaagcaataggttttcctccagcttctggtcctcctcctcctcctcctcctccccaaacctggtttctagcagtcactccactgagactcagagtcttcttggcccagtgccagcctcttgcatgtcccaaaccttgtcctcaggaaacacttatgcatcctatgctggggtgaactcttaagagtgcaggatcacctcatggccacagcctagctaggccctgaaacccacactctgggtttgtcagacgtgagtcagccccaggccactgaacctctcccactgcagggaatccctgtcaagtggtgaaagccagcatctagacctggagtcacaggcacctgtagcataactcctcctgaaatggaggtttttctttagagattggtccatatcccttatccctggacttctgagaagggtggacaacctgtggactggacttgagtctggaatttagagaagtgtccatagtagggctgccagatgaggcaaacacaaatacaggatgcccaattaaatttgaatttcagataaatgatttttaatgtttgattctgtcccatgctaaaaattgcccactgtttatgataagtttaaatttattggtccattctgtactttatcaaggacacacgcaggaggaacagtagcacaaaggcttcccggtgccttgtgggtgaaagaaaggcttccagggaaaggagagaaacacccagggatcccggtgacgtcgggaagcagcacccagaccatgtaaggacaccgcctgcagggggagactcaaggcctgggaaggttttctaatctgtgccttgagtcgggtggggggattttctgggaaaggaaaaccagacacagtaggacaaatattgtatagtttcacttatatgaaattgtcagaataggcaagttcgtagagacagaatgtagaacagggctttccgggggctggaggagaagacaaggagttcttgcctagtgggtacagagtttctgtttgaaatgatgaaaaacttctggaaatagattgtggtgacagttacacaccattgtgaacataattagtaccactgaactgtacacgttaaaatggttagttgtatgttttatgtattttgccataataaaaactagggggaaaaaaaggaaggggagattgtctcaggctggctgactttccctgcatgtacgcacatcttcacatgtgcacacatgtaaaacaaaaatgaagcaaaaaaagaaattctaatttaaccagtaagcaatatgtaaaaggaaatctgaatgtcattacaattttaccaggttcagaataaaataccatccttcaaaatgaacaaattacttattagccgaagaaaggtgaaaggaagtttggaattaacagtctagattttctcactgattggtccaagtcactgacctctaaaattatcttagatcatgccctccctccttcctactttctggaaaacaatcagtctcctaccctatgcttgcccaaagagtttcccatacaaatcacaaatctgcacttgccattccctggaagcccttacattcccaaggcctggcctcatccactgccactgcccatggccccagtccaggcaaagcaatcactccctctccctctctgtcattcctttcttttcctttcactctctttctaccctcctcttccccactctctgtttcctctctctctctctatctctctctccccaccatctcctctctctgtctccccccgccttctctctctgtctctgtctctctgtttctctgtgtctctctctctgtctctctctttgtctctctctctgtctctctctcacacacacacacacacacacacacgcacacacacacacagccagcaacattctacctctgccagagttccaggttgaataggtgtggactttgactttcagattcctctggcaagtgtcaacatcagtcctgttgctccctggcagaggaggacttggagtcaccttggccaagaagctgtctggaggtcacagtggcaccgcccatcggccccttggctgaggctagatgagggcagattcagcacagcagcaactctccccataaaaaaaatccctcagtgtcttagttctctgacccttgtactccttgtgagttttagagccacatgaactcttcttttttcccaatgcttggagacaaaatttacataacctacagttagccattttcaagtgtacagttccctgccatttggtacattcacagtgttttgcaagcaacacccatatcaagccccaaaacattttcattacccaggaaggaaacctgtcgtcatggaaccgtcactcctcacatccccttcccctcaaaccctggcaaccccaaaccgttcttgacagcctcctttggcatttcttcattttggtgtcagatctcacagcagaatttcttacctattatatccagtgcctcagtgcgaagttccagtttaacttcctgttacctcgagcccactatcttgccccaataataccctcccccaattcacaaacacagacgcattccctcctacagctttgggcctcctatctgagtccttcaggaaagaagagcttgtaactcccttagcagtgagtgtagacttggtccaaggaagatgagcaccagtcagggcagctggcccctcctctctccctggtcttcagcaaatcagcactgcccatcgatgcccaggcaatgggagcgtcgaccagcagaggacacacctgaatttctctgcctcatgggagggcggccactgtgttgcatttaggaagaagctgtgcaagattcatactgttttgctaatgttaatcttgtgggcataataaacgtcgtacccacacttaactttcgagatcagacaagattgggtgtgttcagggtggtatggccgtagaccccacacttatttttaacacacttctaggcaaggctgctgcactggtctggggatcacactttgagtagcaaaggactaaattgcaataactgccggggggggagaaaaaaaaacaggatgaactgcttcctcctggctcagcagctagggagtcactgaactaacaaggggatggggtggggataagaatgttccaggcaaaaggaacaacatgcccaaaggcctcaagcagaaagagagcttcaggtattgaagaagtagaagtagctctgtgtggctggggagtgggcataagatggagcagaagaatgccaagtcctattcctgggtctgaatttccaggagcagaagccctgtcccctctagaaggtggatatagtctggatatttgtcttcttcaaatctcatgttgaaatgtgacccccagtgttggaggttggacctagtaggaggtgtttaggtcataagaagtggatccctcccgaatggtttggtgccctcctcatgactgagttgttactctattagttcgtgtgagagctggttgtttaaaaaagcctggcatctctctggttccctctcttgccatgtgacacaactgctcccccttcacccttccccatgagtaaaagcttcctgaggccctcaccagaggcatatgccagccctgtgattcttgtacagcctgaaaaactgtgagtcaaataaacatcttttcattataaattacctagtctcagatatttctttatagcaacgcaaaatagactatcacagaaagtcggtaccgaggagtagggcgttgctataaagatatctgaaaatgtggaagtggctttggaactgggtatgaggcagcggttggaagagtctggagggcccagaagacagaaagatgagaaaaggtttggaccttcttagagatttgtaatgtcgttgtaaccaaaatgtggacagaaatatgtacagtaaaggccagcctgatgaggtctcagatggaaatgaggaagttatggggaactggagcaaaggtcacccttgttaagccctagcaaagaacttggctgcattgtatctatgtcctagggctttgtggaaggctgaacttaagagtaatgacttagggtatctggtagaagaaatgtctaagcagcaaagcattcaagaaatggcctggctgcttctaatagcctatgatcagatattggagcaaaggactgacttaaatttggaactattaaatcaaactaaaatctggcctgagaaagcctcctcactcccatacttgagtccttaaggatgaaccataacctaactttgtaggtaggccaactgaaaacctaacttagaaggatgcttctgtagcaatagctgagcgtcagccaatcgcagcagccatgcttcagtgactcacaggcagcctattgttcaaaccatgttcaaataaggcaaacaccatgctgtaaccaatttggctatttctgtacctcacttcggctttctgcgtgtcactttactttttctattcataaggttttttccgaccacatagcatctctggtgttgctctgaatctgctgtgattctagggactgcctgatttgtgaattgtctttttttttttcttcaaaattaaattctgttaaatttagtttgtctaaggtttttcttttaccagatctggtgttggaagtgcaatttgaagtaaaactctggtgacctccaggaacaccaggtgaccaggccagttgtgctcactgatctcttgattgtaactggaggttgtagatgcgttttctcttggattcagagctccactaatgtgtattctaattgaagctctccaactttactggagcgatattaaagtggactgggttcaggatcaaatttgaatcaataattaactggattaggttccgttagagcctcagacctatactaggcactttttttttttttttttttttgataatgggtttgtctcaatccaaagattctgggactctaccttctgggactccatctaatttgatatgtaaaattatggacccagaatatgtgcatttttagaaaaatagattaaccttactagagaaaagatggccacaatggggaagttttaatttgtataaaattgtttatttgcatggcatattagaaaaagggggtcaaaaccccacaaaaacagtgggatatagtctttcattggtacatggaagcctctaaaagacaaaatgaatgaaaacttgcctccttaaaagattcttcgcaaaagcaagtgaacagcttaagtaacaggctaaggacatgatgaaagagaactgtactctgactgaactaaccccaactgattcttctctttatgcatctctacctacgtactctgagtctactaacctttttactaaattgacctttcactctcaagatgatgaaaaaagaggaattagatgtacgcctcacaaaggaagaccttctgattatccaggcctgcctgctataaccactttcactccatggtctaaaactgagcttagagctattgtagaagacttccctgatctaggagagaatcctcaaaaattgactgaggagtgtagaatcctcataggagattatgatccaggactccctgacaaaggttcatataaatttattcatatgatatggaggcctggtgaagctcaaaaatggatggcagcagcagaatggaacaaaccggaggaagatattaaagactctgcccctactgcccgcccccacaaaacttcctcatgagaaggcccaacaggagctagaaatattgctgcaaatcccagcctgggcaacatggcaaaaccctgtctatacgaaaaatacagaaagttagctgggcatgatggcacacgcctgtagacccagctacttatgaggctgaagtgggaggatcacctgagcctgggagcttgaggctactgtgagccatgactgtgccactgcactctagcctgggtagcagagcgagaccccatctcaaaagaaaagaaggaaaaaaaaattgctgaaaatcttttaaattcaagtgctaaaatttttccgcaaaagttgattggtacatcatacaatattgtaaaccaaaaaaagaatgaaccagtgtcagattacagaacttgcttagaaataatgtgaaacattctgggctcagagtaccagcaaggagtatttcctgcagggactgaaatggtattaactactctatttataaagggacttcatcctgaacttagaaatttaattagaaaacataaactcggatgggaagttacagccatgactgaattggtggctctagctgaacattttgagaggactgtagagcaagaaaaaacccaaaaggctaacaagcttatgactgttcaattacaacagttacaggggccaagaccaaagggatcttctcattctcattttaaatcacaaccaagaggtattagaccaagaaattcttcaccctaagatgtctgccttattgcaaacaaccaggacagtggaatagggattgtgcccttttataccagcccaccaatgaccctccctttaggccagcctgtttcaccactagagggagcacaagagaccttagctctcctgaagataatcagcattgaagcggctctgagggatttcccagtatattgctcctcataacacccttaaaagaatatggagaaacagaggttacaataaatggggactcatgtatagtcttggtggataccagagctaccttatctgccactaccgtaaaacacactttcatacgccaacagatccctcagagttaaaaaggctatttctgtggttggggtttcaaatcaaattcaagaggttcccatatctgaacccgtccaattgactttggggcactcttcagaaaatcacacttttttactgtatgatagtgctccagtaaatttgctagagggagatttactttcaaagctgaaagggcatagaagactacctattgggtacattgtacactgcttgggaaatgggcacactaaaatctcagaactcaccagtaaagaacttgtccatgtaaccaaaaaccacctgtactcccaaaacaattgaaattgtttaaattaaaaaatttttaaaagtggggaggatgtaaaattttccttagaaggagtaagaatcagtttcctgattctcctgaaccagaattgttatgctctctataggcagaaattaataagattgaaactcaggcctgtaatgcctgatcttccaaaaatacatgaatgtttatgggtctcttcctcaactgacacaggaagaatttaaagtgtggaacttataaaagtccaaatagaccactctaaacttttgcctaaattacccaatatccactaaaactagaagcaattcaagggctctcgccaattatagaagatttaattaaacagggacttataattctatgcaccagccgttgtaacactccaatcctactggttaaaaaaaaaatggatgaggttgaagatttattcaagatttatgggcagttaacaaaattgtagtagcaaggtttcctatagtcccaaatcctaatactttattatccagtatacatgctgattcttaagtggttcacaatattagatctctgctcagcctctttttgcaatccaattcgtaaagagagtcaatgcttatttgccttcacttggaaaaatcagcagtacccctagactgtgatgccgcaagggtttaccgaagccccttcgtatttttcccaggccttgcatcaggacttaatgacattatagtttccttaaaattctactctcattcggtacatagatgacttactatatgctctcccactaaagagtgctctgaaatggactcagtttaccttttacagcaactcacacatcaaggtcagaaagcttcaatagaaaaacttcagttttcaaggggaaaaagtccattatttgggacatgacttgaagggatttccctctcacctaaaaagttaaaaactattcaaaattttccttggcctgcaaccaaaagataattaaatagttttcttggacttgcaggatatgtttttagacttgcaggatataaaattcctgggttctgaatttttccttaatagcctcaccatttcatgagctccctaaaaaatgctgtaccagagcctttatcttgggatgatagttacgagcaggcttttagctaaataaaattgaccttgtaacagcctccagctttaggacttccaaattgcactaaactgtttacctaattggctcatgaaagtaataatcaggcatttaggagttcttacccaggaacatggggagaaacataggcccattgcatattatagcctgcaattagacccagtagctaaggtatatcctaactatttaaaagcagtagcagcagcaaccaggatgaaagaagcttcagctgatctggttttaggaaatgaatttaatttggaagtcccacatgctaaattccacccaaacccagcattttttagtaagtagactaacatgaaatactctgtctccttctaatctctctctaaaacactgcaatttacttaaccatgccactgtattactgctgcctgatgatggtgaagaccacaattgcataagtgtagcatcagaaatagtggcccctcatgttaatttacaagttagtcctttggacaatcctgagttaatacttttgttgatgggtcctatgccaaaagctcagaaggaaaatatcagctaggatatgctgttaccaaaatgagttaatagagaagggaccccttcctctattagtcagctctattagtctaagctctataagtcagcttaactcttgaagatttttgccctcacccaagcttgtcgtatagctaaagacaaatcagtaagtatttagacagatagtagatacgctttaggagtagtacatgattttggcatgatagggaaactctaagggtttctcacttctagtgggatcaccatcaaaaatggactccagttagataaactcctagtttgctgttagtgatcgaagctcatacctgcagaactgaacctgaatatcaagggaatgcttagcagatatttatgctaaatcagctagtactgaaactgttcagatatgcaacctgaatgaacttcataagattaatccaatccaactaccttacaatgacctatttaataaacagtgcaatgcacctcatttggaaaaacaaaactggtatctaaaaggatataaattcaatgttaagtgcagactcacagagggcctagatggctgtctggtctttcctgagtctttgaagcttctattttcaaaagctctgtactccacaactcatcatggaacagaaaaatacgtccaaattgtgaaaaaatacttgtgggatgattgttccaaaattgctagaatatatatatatatatatatgtatatatattttgagacggagtctcactctgtcacccaggctggagtgcaagggcgcgatctcaactcactgcacactccacctccctggttcaagtgattctcctgcatcagcctcccgagtagctgggactacaggtgtgtgccaccatgcccgactaatttttttttatttttagtagagatggggtttcaccatgttagctaggatagtctggatatcctgaccttgtgatccacctgcctcggcctcccaatatgctaggcttacaggcattatccactgcacccagcctgctagaatattttataaccaatgttggcttgtcaaacccatagtcctggaaaaacaaaagattcaggtggtgtattgtattttcaccacctaatggatcatttgaacaattatagatagacttcattcagttgccaccttcaatgggggtctcagtatgttcttgtaatagtttccatgttttctggttgggtagaggccttcctgtgtaggaaagctgatgctgtgacagtagctaagaaattattagaaaatgtgttttctttatggagcatccctggaaaaatccccagcaataggggaattcattttattaggcaggttataaagcagttaaacaaggtgttatggacacaatggcactaccattgtccctatcgccctcagtcttctgaaaaggttgaaagaacaaatggcatattaaaactgaaattggcaaagttaactgaatcagttgggttgccttggccaaaggtactatcattggacttaatgacaatcagatccactctcactaaaaaacagaagtggatcccttatgaaatagtcactagaaggcctatgccccaatagtgaaacctcatgcatctttctgtctcctaaattctgatatgagtaagtactgcaaggccattataccaaagtgtactttcaccagataaaggaagcttttcaagatccaccaactgaggataatcaaaccttccacagtctagaacctggagattgtgtcttctggaaatgacatcagagaaaggctgctcttgacaactctttggaagggaccgtgctgagatcttctcaacacctacactgcagtgaagcttcagggccttgaaacttgggtccacacctcacaactcagaagggcctcttcagactcctggaactgtacacctgctggagactttaaggtaaagctgtctaaggaaatatctctccagagcagcgggcattctagctgtggacagctttcccaagatcacagatcaagacttctgtatcatcatgaaagccttacattttttcttttctccgcatttcctgttgccctaattctttctttttccctacagaaaaatccatgggacgataatcagtggatggctttagcttgagcatatgctctagcacagaaccagagtttgtggcttattgggtttgtttttattgccaaaaaaataaggaaacaattccgctaatgccaatgcctctccatgttgccaatgagagtcaccccaaaattccaagggaaggatagaaagctatccttgatattctgaacaccattgctacttgttttcctgcactcactaaaagcaacactttaacttttcctttttttttttttttctgaggcagtctcactctgttgcctaggttggagtgcagtggccttatcttggctcactacagcctccacctccaaggttcaagcaattctcctgcctcagccacccaagtagctgggactctaggcatgcaccaccgcatccagctgatttttgaatttttagtagagactagattttgctatgttggccaggctggtctcgaacctccttgcctcaagtgatccaccagcctcggtctcccaaagttctgggattacaggcgtgagccaccatgcctggccttaactgtttcaattaataacctgatcaataccaaaatatagaaaaccagtccaagtgatgcctgcaaaagatatattgtgctttcaggcatcatgcactcaagttacgggaattacctatgtgagtacaagtaattgcttgtataatatcaccagattaaattcaacagggtctctttttactaaatgtgttatacacccttacaacatactacagggcgagcacaaaaaggtcaatttcccagtggattttgttcaggagctgtgtaggtttattaatgaacaaatctaactgacccctgctcaaatgcaactatgtggccctgtttttcaactcccaagggcctatactgggtctgtggataatctgcgcatttcattctgcctcctcgttgactcagaccttgctgtttggtctggctcacttctgcctttcaaatagtttcacctaaaaattctcctaacagctcttatgattggaggccaaaatagacaataactgaaattagcactagctttgaaatagacaaagataagctagtttccactgaggaaagattccagtggggttcctggggactcactcttggtggtggtgggatactagttgtatggaatctgaagctaatccatatttggggtcttggattttatagccaatcagacatcccaatgttccagacaggtagaagctactctccaaaaggtagatgtggcctggtgcagtggctcatgcctgtaattccagcactttgggaggctaaggcaggtggatcacctgaggtcaagagttcgagaccagcctgcccaccatggtgaaaccccatctctcctaagtacaaaaaattagccaggcatggtggcgtgtgcctgtagtcccagctacttgggagactgaggcaggagaattgcttgaacccagaagacagaggttgcagtgagctgagatcaccccactacactctagcctggttaacagagcgagaccctttctcacaaaaaaataaataaataaataaataaataaataaataaataaataaaataaacgaggtagatgttacagttaatggaacatcatgcagcttcatatctcctttttactcaagctggggcctatgtttggtattgaacaaaatggaatgctgcaattttctctctactgattttgttactacagaaagcttaatgtaaaggtggctgatactgctgtttccttagacactgacaccaaatacaataaagaagtctctcaagaggaaaacatggtgtgtttacaggagcaactaacagttggtttgtaggcatcctaaatggtggatggcaagcttgggtttcccaaaggtttctagtctttatatgtcttctagtaggtgtccaggttagtatggcctgtgttaccagagtaacaatgaaaatggctacgtctttaaatcaggccactttacagtgaactatggtccttaattgctatcacatttcaaacaagaactatgaccaattaaactttactattgttgaactgcctatgttgcctgaactttgactggtttaagttggtttcatttatttcataagaactcttgttaaggggtgcaccttggtattttgatattattctcttgatagtcataataatagttccctggtgtgctgcatcctctcaagtcataaatgttttgtatgcagccatacattgagaattgaatggtctcacttcaactaggtcagcaagaacataaagaatcatttacctagtgtgaagttgtgacttgtgaacttcatagtgacaccaataaagacttgtgaactccatactgagactaaaaggacttgtgaattccatactgagccaatttacaatagtgggagagtggcatcaatgcctaaacttttgatcaatctctctaaattgagagtctgacaaagagaggggagttgataaatgaaactcaaatccggcctgaggaagccttcatattgccatgcttgagttcttaagggtgaaccgtaatgtaactagtaggcaggcagactgaaaacctaacttaggaggatgcttctttagcaatagctgagtctcagccaatcccattggccatacttcaaccactcacaggcagccgactgttggaatcatgcccagataaggcaaacaccaagctgtaaccaatctggctgtttctgtacctcacttccattttctgtatgtcactttcctttttctgtccacaaatttgctttgacaacacagcatccctggtgtctgtctgtatctgctgtaattctgagggctgcccaacttgcaaaatatttatttttcttgctcaattactctgtgaaatttaatttgtctaatggatttcttttaacagaacttataattaaaatggagagcgggtgtaaatatttataaaacttgcagcctggccatgtggtagacaaggaggaatccaagcagcctgctgagcaactacttgctggagacattagcatgtctaaaagggagccaggtgctaatattcaagacagtgggaaaaggcctcagaggcatttcagaaggcccctcctatcacaggcccacaggcctaggaggactgaatggtttcagagaccaggcccaggacaccattgccctatgtcacctcaggatgctacttcccacatcccagcttctccagctccagccttggctcaaagggccccaggtgaagcgcagaccactgctttggagggtacaagccctaagccttagcagcttccatatgtttttttttttgtcttttttttttgagacagagtcttgtcctgtcaaccaggctggaatgcaacagcacgatctcagctcactgcaacctctgcctcaaaggttcaagtgattctcctgcctcagtatcccaagtatctgggattgcaggcatgtgccatcatgcccagctaattttgtattttcagtagatacggggtttcacaatgttggtcaggctggtctccaactcctgacctcaggtgatccacctgcctcagcctcccaaagtgctggaattacatgtgtgagccaccatgcccagccttccatatggttttaggtctgcaggcttgcagaatgcaagagtgaaggaggcttgggagcttccacctaaatttctgaagatgtatcaaaaagcctgggtgcccaggcagaagcctgcacagggcggagaccccacagagaacctctactagggcagagccatgggaaaacatagggttggaacccccatacagggtcctcactgggacattgcctagtggagctgtgggaatggggccaatgccttccagacaccagaaaggtagagtcgccagcagcttgcaacctcagcatggaagacccacaggctcaatcccaacctgtgagagcagccatgtgggctgcacccagcaaagccatagagacagggctgctcaaggccttgaaagcccactcctctcaccagtatggagttaaggaagatgattttggaagtttcagatttagtgtttgccctgctgggtttcagacatgtgtggggcctgttgcctctttcttttggccaatttctcgcttttggaatgggaatgcctacccaatacctgtaacacagttgtatcttggaagtatgtaacttgtttttgatataacagcctcatgggtggaaggcatttgccttgaggctcagatgaaactatggattctggacttttgagttgatgctggaacaagctgagacattgggaaactatcaggaagggatggttgcattttgcaatgtgagatgacatgagattttggggtaagaggcagactgatatagtttagatgtttgttctctccaaatcacatgttgaaatatgacccccaatgttagaggtagggcctagtgggaggtgtttcgctcataggggtggattcctcatgaatgggttggtgctctgtccatggtaatgaatgagttctggccctgttagttcacatgtaagctggttgtttgaaagcacctagcatctttcttgtgtgctgtctcgccgtgtgacacacctgctcccccttcagcttccaccataagtgaaagattcctgaggccctcaccagaagcagatgcctgcactgtgctttttgtacagcctgcaaaaccatgaaccaaatacacctcttttccttataaattacccagtctcaggtattctgttatgatcccctggaagagttatactacttccaggtctagaccatggtaaatcccacactcccctctgaggccaccttcttccctctgcagagaccctgtggttagagtggattggttgtgtctctggccccaattcttctcccgaggctgcattccacccttttgctatgtgactttgcagcccttcatgatcattacagaggcaggttcctctctccttgaatttggggaagatgcgacgcatgcaggagtttgaaaacacgtttgtttgcttctgcttttgtttttgctcctctgcaatttccttgaaaccatgcctgagctagcctgagggaaaatgaaaaagcaccattgagctaatctttcagccaatcccactgcatttgcacaatgcagtctgagaccagaggaactgcccagccaagctcaggcaaaattgctgacttcagactcatgagctaaataaatattgatttcattttatgattgttcttatgcaacattatcctggcactagaaaaatgaaacagatgggaatcaaaaagactgaatgaagcagaaacccagaagctaccccacaggcaatcgcatgggactcagatgttaatggacaataagcttttattgcacagaaaggtcattgcagtcagaggttggggattgcttgctgctacagccgaatggattctattctgaccaatacagaaggaaagaaatcatagacgccctgcctgagcagaagggaggtgatagatgaaatgaactgtatgaagatccaccagcctggcccacacgtggaagaaggactggcccgtcttcttgaagcccaagctctggtagaggcccatggcagagagctggatgttgctggtgtccaggacaacttcactgtagccctagtcccgggcaaactggaggacagtcctgaccagggcttttgctatcccctgaccacggtgctcattgtccacagagagatgaaacagctgcaaccgcttctccctcaaggtgggatcatcaacgggcagagctcctactgtgcccaccaccttctcttcagattcacccacccagaagcaggagccacactcactcaggtaggatttggtgatgtcagacatgtctgtgcgcaatgctatgtctacataccgcgtccagggttttttggcaaggaaccacagggcaggaaggaggctgaggctgaacacgagggccagaatccaggagccagagaccaggagtagggcaagggcccccccaagtaagagtatgagggttcgaggcagcttcagtaatcgccggaaggtggctggggcgtgttcggccatcccccgggagagcaagcccacgacctacttgcggtcgctctcctggtatttgcggatgtgataaggagccatggacagacttctgtgtctgaagtcactgagtccaggaaacagagctaggcctccctgcacgcctttacgccaggcctggggaagagagaggaaaccacgtgagtgcctgcatggctcccagccttgcaggaacagggagacctgcttaagggtgtgtctttccgcgtttgcccatgaggaagcaggcctctgccactgggagaaggtagcatgagaaagacctgcattggaatctggctccatgcctttctagctgtgtgaccttgggcatgtcacttaacctctctgagcctccacttcttcatctatagaacaggggagaagaaaacctgccttctagagttgtttcgaagattgaataaaataccttctataaagccctgatagatgaactacccaccactcttccctctgtttcctttttctggctctctcagcttcttggtgcattgagagagtacctacctcaggcaggccacatgcccaaccctttggtgcttctccagggaccatacatcgcagaaatcctgtgaccaagcacaagtttcaggaaaggctccctccagctttattgtaagtttttaggttgctgaggtggcataagtgccaagcataaaaaacagcccagcctccagatcccaaggaaggtgcatgctcagagcactgtccttccacccagtcccctcacctgtcaccacaagagccttgagtgtccagggagcttcagctgtcagccgctcactggcatccaggagataccgtctggggcttgctcacccctggaaagcaggctgcctgcctcattgcttggctcctgaatgtttggtaatcatcaaccctagggtcaaagagctgggctgtaacacagcagggagcccagtgtgcattcccctttatagtcaaagggaatggcctggagggggaaactcagggtctggaaccgcctgggttccttgcccttctggaaggcctgccacctctcttgcctgttcaggccctgggcatctttctgccacctggcacacttgatactctctgagatccaccttggtccctgtacacatataccacgagcctgagaactgtgccattcaccctgcactcagtcaccattggccagaagccgagtccccacacttggcaacaaggcccttcccagctaggcttctccatgctgaggtttccctggtccacaaagcatcgattgttggcagttctttgcactcacctcaccaacccccacctccacccattcattgattcagtcaacaggtgtgtgcgatgcacttcccatgtctgggggtcatttcagccatgagcaaggttgacattcggctgacaggcatggctgtgtgtggcttgtgtgtgttctggctgttggtcagaggctgtgccacacccgttgttaaatattttgcactgcagatgttggagaggcccaaattcaagctcttgtacccgacgtggagctgatcccaaacactgacacatgggtgcttggagatagagaaagttgtattcgatttggccaaagcaagaaggcaggagaggaagatctctcaacttcagttcaacaaagaagcagcagcagaatgtttttatgcagctagagagtgaggaagggggagttcagggggattgagaggaaaagtctgtgtttcctcagtctgagataacaccttgtgcaaccaggcttctcagtgtcagcagctggtcacagtgtccttcaaggcattcattccttctgcaaacttttcctgaccctgaaggaatgtcttcctgctgaacaaagaaacagtgcatgagcagtttatcattatgttgtgggaacaaggaatattggaccaaaagcaagtggttaacatgtgcaagccagcaacggtctgatcagaatgttcattatttcagtcactaaaacatggtatggtgctgaaatctcaaggggcccaattacaaggatgcaacatatacaagataggcaaaagcaaaacctaacagaaaaagcccttttccacaccaacttacatgctattgaagggaaacttccctaaaagattagccaacccattgttgatcagccacgctgggcccgtcatctaggttaggtagtttggactctattccaagagcaaggggaggacattgatatgcacagaggggagaaggggtgtgtgtgtgtgtgtgtgtgtgtgtgtgtgtgtgtgtgtgtgtgtgtgtgtgcgcgcttcactctggctgcaggtggacaatggatctgaggaggtgggaatggaagcagctaccccttaaggctagtgccgcatccaggcaacagcagggcccccagtgcagggatgcaggtgctcactgtacaagagcagctggcccagaggggctggtaggagctaaaatcgggcctcccgttgccaagccatgagccatggcacgaaactgagactggccaaaggaaaaggcaaccttttcttatttgctcgaaggcattgcttgcctgctaaactctgcatccagtggactgcatggcttgaggctgtgcctagctctgtgttcacaaagaagccgcctgggctagcagaggcccatgagacagcagtggcttcaacagagggaggaagtcaagaatgtgagacatgagccacatggaggtgcacttggggcagaaatggcaggagttggaatgattcacacagggaggaggatgaggaagggctcagagatgacagccaggcttctggtaggggcattcaggaaaacactggagagagcccagatctggaaaagtcaaggcttcccctaaaggtgctgccctgcagccttcctcagcagaaaccagaggctgggagtcagcagcaggaacccagggccagccagtggaggctgctgagattccagatctttggtacccaacaccacctccgaggaaaagtctaaggagcatcaagtctgggcaggaagtccatggcttatctttagagtgttctcagaacagttcagtgtcaagcaggagttggcctaggaattacaagaggtgagcagctgcttcaaagcaccactgagtacttctagtgtgagtctgaccaatattcagagtcagaaacctgccggtcacttggagggggagaggtttgtgctccgtccctgtgtgctgtctcttcctccatgctcacccgtggctgtggcttcctcaaaacacagcgacctcacttgacattcaggcatctcttgctcccaggatctactgtgacttctgcatttttgtagctttcctgataaaagcctgggctttccttgtcagacctgaaagattcatttattcattcaacaaacagttcccgaggacctgaggtgtgccgggcctggacttggcatgaaggcaccagatgttggaagcgaggctgccgcccaggaggacacacctgatggggctctgggaacaggatgatggtggagacatcacatccggaat

SEQ ID NO: 116 - DNA, 53940 bp, Homo sapiens
ctataaatgagatagaagcaatctaagaaacatgtagtcatcttcttctctcaggttgtctggttctctgtcctgcagctagtcagtttttgagtcagtgacacactggttccttattcagagtaaggcaggaccaaacctcggtgctatgaggttcctgccttcctcactccaccaaggatacatttctgggagcacctggttggtaactacaccagcagtctgatggcaaagtctgctggagaaggttgagaaccaatccctttaagagcagtggttcccagctgggaatgactttgttcctcttggagacatctggcagtgtctgagacatctttggttttcacagctaggagtttgtgctctggtgggtatgagccagggatgctgcttgcatcccataatgaacagggcagctcccacaacaaaaattatccaacccagaatgtcagcagtgcaaattgagaaaccttactttgcagagctctcagagagcaggccggtggtggagaacatgaagttgatgggagagtgcattctgaaatcgggagtgtgagtccacctgggagtccctaaaggggagtcagggattatcaaaggtgcacttgaggccctggccagtatacctgtagtaaacgggaagcagcagttctggcttcttcttttcctgtgggggcaggatgacactttgatcctcaaactctgctgtctcttctgcctccagctgtttcaggagctccaggtcactggcagaggtaagctcatcccgaatgtgactccagtcgtactgctggcgcaggaagctctgccacttgttgggggatgccccaggccttcgaggacgcttgctctggatccatcgggctgtgcgctcgttcagcttttccagcacagtggcctcccacgctctggcctccttctcaggaggcagaagccaggcttctctttcctccaggttcacatctagagaaggtggccgacccagcatatctggatgcatgcagggatgatggatgagagggcggggtgcttcccggacggtgctggctggctttgatttcttcagcttcttttcgggattggcagagctttctgtcttcacagccagggaggtgtctcctgttaagggacttgaggaacccaggaacttgaagctaacaggtttctgaggccgggccttcctgatctggggagtatggatgatgtcattggtattgtagaggtggtcaaagctgtactggctataaggaatgctgggcaggcctcgctgccacaccacctcctgagagaaggtaaggtttgcagcagccattttcaaatattggctcttgcggtgtagacggtactgtgagctgaagaagaccataggcacactggagacagaggcacactcctccttgcctttcaattttgagtagtttaaaatcatgccccatcccagtcgtgggggcagtgactgatagaagcaatgggggagaaaggtctttcccttctgggtcctggtcataccgcgtcccagcaaatgcttccttccacactgcctggcctagaggaaaggcctggagatgagacctggcacctgttaagggaatgggaggaactgatgagaactctagagcagcagaaattggtagcccatagcagttcagaaagagaataacttgaaaaacagatggaaagggggtggggaagagccatgtgagttagaagaacaaaagaagaaaatggtgcaacatcctaaatatttcatgtatcagacccgtgtttttggttcttatacttgttcccaaagctcagaccctcatctccgtgtgagggatgactgcttttcagcagtatcccatgcttccagtttgtctttaaatgttgctttctttcattcaaaaggcttatagtgtaaagttcagactattcagcatggcattcagggttctccatgagtttggcctcagtttatgactttgtcctggcatgtaacctctgcttgagccagtccagtctcctggctgttctctgagtatcctctctccacataatgaagcttccttctgtgtcctctacatgaaatggcctttcgtacttgacacaaattctatccaatttccaggcccagctcaatttgtgctgctccataactctttcttgacctatccaggccaccaggtcatacccaagtttataaattcctcctggtctgtaccacttactttaactgttaatcctatgatacctcgcattgttaaatatttgagactctaattccattgcccagtgaccatgtctcccatttcttctgtctttcagagtcatccagcacacctattgctacatagtttttattgttaaaatatttaatagctgtaggccgggcgcagtggctcacgcctgtaatcccagcactttgggaggccgaggtgggtgggtcacctgaggtctggagtttgagaccagcctggccaacatggtgaaatcccatctctactaaaaatacaaaaaattagccaggcgcggtggcatgtgcctgtaatcccagctacttgggagattgaggcaggagaattgcttgaacccagggtgggggagattgcagtgagccaagatcatgccattgcacaccagcctgggcaacaagagcaaaactccgtctcaaaaaaaaaaaaaaaaaatatatatatatatatatatatatattatagctgtaacgtattttatcaaataggtaaatggttttgactcttcatgaattattggatgggttgtttccagattttagctagcatggcaaacactgtagataacaaatgcttagatttaatgttagtttagttttgttttgttttccttttgaagcattcccttggcctaataatgatagttttggaataaccttgctgaggattttacgtagggaagatattatgatcttcctttcctattttaagaagctgaggttcagagaggtaggtaaattgcttcagatcacatagcccgtaagcagaggagtcaggtttcaaatctagcctactagatcacaactctggagcacttaacctccgtgccacactggccttggcccaagcaccactccctaccactcactttgttggccttgcctctccaaggaacaggtaggcctccttatgtgtaaggatgaaggagagaccattattccatatgtttctatcctgctagtgtcaactcctgcccggtgtccaaggtgcccatgcagaccagatctgacttgtttctctttactccttaacacccagcacatagcctctctccctagggcatgatttctcttactgtcttccatgtgtaaaagtgaccgtattgtatttctttctgttaagggcaagttcttttttgtgtgttttttttcttttgttttgtttttttgagacagggtcttgttctgtcgcccaggctggagtgcagcactggcacgatcatagctcactgcagcctcaacctcctgggcccaagtaatcctcctacttcagcctcccaagtagctgggactacaggtgcatgcgccaccacacccagctatctgttttttatttttaatagagatggggtctcactatgttgcccaggctggtctcaaactcctggggtcaacaatctgcctgccttggcttctcaaagcgttgggattacaggtgtgagctacagcactcagcaaaggctcaactttcatctagatgccattaggccagaatcaataacctccctcaaattacgtgacacatgattaatatgctatcactccaggactttttgcacataaggctaaatgtaattgcttcatctcttcacaaccatgaaggcaacgtcttcatgaaggcaagttaagagaaagagggtggtcacaagatgatgttttctcctgaaacagtggctactcccactggctgaaaatagaaaggctagagcaagacggccaaacagacccctccagcgattgtctccatgcaggaacaccaaactgaacaactgtccccacaaggaaagcacctttaggccggatgcggtggctcacgtcagtaatcccagaactttgggaggctaaattgggcaaatcacttgaagtcaagagttcaagactggcctggccaacatggagaaaccccatctctactaaaaatacaaaaattagctgggcgtggtggtgggggcctataatcccagctacttgggaggctgaggcagaagaattgcttgaacctgggaagcagaggttgcagtgagacgaaatggtgccactgcgctccagcctgggtgacagagtgagactccttatttaaaaaaaaaaaaaaagcatcttcataagaaacaaaaaatcaggtgagtgatcacagtacctggttttcacatcgtatcaagaagaggcactgaagagggtgggaaagacggtcctgcatcgcctatgcccccctccctcacctctggcacaacagcttggagagagaatctgtgcatgtggtggagcgagaggagtgtgggattttgcattggaactcactgctgccctgtcacagcacagcactacactgagcagaattctgctggcacccacagaggacacatttagatcagctctgggccagaggagaatcctcaggtagagtgggacagacctgagtcccagctggttctgccaccagctgaccaaagtggcctggggccctgaatacatatgagtgacagtcaggtcacaaggactatattccttaggcaaaccctggagatgcactggtcatggaggcagtggactttgggtgtgtgtgaccgcgtgtgacaccaactgtggtgaacaagggagtgcctgcatcattcctcccccaactccagacagggcagctcagggagagactcctacttggggaaaggagagggaagagtactcaagttgcaagacaaagtccagaagactttgagtagcagctcagccacaggaaaataaagcaccaggcagaatcctgaggctcctgattccaggcctttgctcctaagctacatttccagacctaccctgcgccagaagggaatccactgctctgatgggtcagatttatcctggcaggattccccacctgctgactaaagtgcccttgggctttgagtaaatatcagtggtagctaagcagttctggccacaggccttgggcaggatccaatactgtactggtctgcaaagcttcaggtgtgacccagtgcactgccatctgtggtggccatgggagtgctcatgtcacccttccccccaactccagacagcccagtggggagagagattcctgactgggggaaagagaagagacaaagtgagagatgttgcctgggtaaccggggaattttcccttatcttacccaaggccaccaaagatacaggagtatccaggagttggcaacagttgcaggggtcataggcttagggcaccccctggtatacatcagctgcagagaccgtaggcttaagtcacagcacttaatcccctttgaatatatagaaagccttctcaaggaggatgggtacaaataagtccagactgtaaagacttggaataaatacctaactcttcaatgtccagacattgatgaccatccacaagcatcaagaacatccaggaaaacattatttcaccaaatggactaaataaggcaccagtgaccaatccaggagtgacagagatatgtgacctttccagacagggaattcaaaatagtagtcttgaagaagctcaaacttcgagataacaccgagaagaaattcagaattctatcagaaatttcaaaaagagattgaaataacaaaaatcaagcagaaaggctgctctgcctatggagtagccattcttttgtttctttacttctctaataaacttgctttcacttcgcaaaagaaaaaaaatcaagcatcacttctagagctgaaaaattaagttgactaaaaaatgcattggagtctctcaacagcagaattggtcaagcagaagaaagaattggtgagcttgaagacaggttatatgaaaatacacagtcagggccaggcaggatggctcatgcctgtaatcctagcactttgggaggccaaggcaggtggatcacctgagatcaggggttcgagaccagcccggccaacatggcgaaaccccatctctactacaaatacaaaaaattagccagtcatggtggcaggtgcctgtaatcccagctacttgggaggctgaggcaggagagttccttgaacctgacaggcagaggttgccaccgtactccagcctgggtaacaggggcaaaactccatctcaaaaaaaaaaaaaaaaaaaaaaaaggagtgatttaggatgtccccagataaatgccctttagcctgtgacgtaaagaatctttagttacaatgcaaacatcccagaaagaataccatattaccattatcaattattagaaattcttaaggaggctatgcgcggtggctcatgcctgtaatcccaacactttgggaggctgaggtgggcagatcacctgaggtcaggagtttgaaatcagtctggccaacatggcgaagccccatctctactaaaaatacaaaaaattagcgggtgtggtggtgggcatccgtaatcccagctactcaggaggctgaggcagaatcgcttgaagctgggaggcggaggttgcagtgagccaagatcgcgccactggactccagcctggacgacaagagcgaaacttcatctcaaaaaaaaaaaaaaaaaaaaaacttaaggaatagttattatctgatatgatggcttattaagaaggaagggaacacatgataggtctgttttgaaaaggaatggggacagaacaaaatattactaggtctgatcaaaagaggcttgttctggcttgtctttgtctgccttggagtcacgggacaggtgtaaggccaaattgtgcacttcccagtcatgttaccttgggcaaataatttaaaatctgtagtttcccaatctgaaaattgagtctgatacctgttctaatttagtgttgattgatatgaagctcaaaatcagaaacatgtatgaaagttctttgcaaactaaaatatatgtgtgaggaattgttattattagtttagaggatggactgttgtccttagaaggcaagtctctgggtcctacagttagatgcactgagcgcttcgggaagaatttagggctatggggtactcagcaattaaaagagagggtgcttagagaaggaagaaaggacttattaatggagtttggaggctccttattattgaaacttacacattacgtgaccagcattatgaggcagcacccacttccaacaaatagccctctagaaccaaaagcagagtggcaggtcctgggtccttttgtacacagcataaaaaattaagtcaatcggccaggcgtggtggatcatgcgtgtaatcccagcactttgggaggctgaggcgtgtggatcatctgaggttaggagttcaagaccagcttgaccaacatggtgaaactccgtctctactaaaaatacaaaaaattagccaggcgcagtggtacatgtctgtaatcccagctacttgggaggctaagacaggagaattgcttgaacccaggagtcggaggttgcagtgagccaagctcgtgccactgcactccagcctgggcaacagagtgagactctgtctcaaaaaaaaaaaaaaaaaaaaaaattaagtcaatcctggcataactgcagaccaggccctggaatgagcaacccaccagcattatctgcatttctaggaacttgggctagaaggggaggaatggggttggaagggttaggctacatgcctctagttaaaacctgatgaacttcctagatccccaactagaaaatgtaggagttggactaaattcctctcctgcctctaatattttatgaatacagaactcaactcaaaatgggtagtatctcagagattccaaatttagttctacttttctgtttgcttatcagtcgcttaccctcaccctctggtctgatacctttatcctgtacaagtggtcaaagtaggttgagtaacgtgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaactttttttgtagagacagggtcttactatgttgtccaggctggtttcaaactcctggaatcaagcgatcttcctgccttggcctccagaaatgctgggactgcgcctggaatagatacgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaatttctcaccatgcactcacacagctatacagctgtctccagagattactctggaaactctgctataaagatgacctggtctaatgccttgatttgttttttgtttgtttgtttttttgagacagggtctcactctcctggagtacagtggcgtgatcatggctcactgcagccttgacctcctgggctcaagcaatcctcccacatagctgggagcataggcacatagcacaccactctcggttaaatttttttttttttttttttttttttgtagagatagagtctcaccatgttgttcaggctggtcttgaactcctggactcaaacgatcctcccaccttggcctcccaaaatgctaggaatacaggcatgagccactgcaccaggcctaatgtcctgattttataaatcccaaaactggggcccagagaggagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctacaaggcagtcctcagagagaagcaaggttctgcatcttaaaccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctgtgagaaattgcatcttatttattgattatttattgaatggtagtttcatggagtttttcgtctttttttttttttttgcgagggagtctcactctgtcgcccaggctggagtgcagtggtgtgatcttggctcactgcaacctctgcctcccaggttcaagcaattctcctgtctcagcctcccattacaggccacaccaccacgccccactaattgttgtacttttagtagagatggggtttcaccatattggccaggctgttctcgaactcctgacctcaagtgatgcacctgccttggcctcccaaagtgctgggatttgcaactgtgagccaccacacccagcctcttggtcattctttgaaaaataaacctcagccaggcgcaatggctgacacctgtaatcccagcaacttgggaggctgaggtggcggatcacctgaggtcaggagttcgagaccagcctgaccaacatggtgaaaccccatctctactaaaaatagaaaatttaaaaagaaaatcagctgggcctggtggcgcatgcctgtaatcccagctacttgggaggctgaggcaggagaatcgcctggacccaggaagcagaggttgcagtgagccaagatcaggccattgcactccagcctgggcagcaagagtgaagtgcagtctcaaaaaataaaaataaaaaaaccctctagatgtatgcggctccatattctcccaccacaagggtttataaatcctgagaaagaggcaaagcagggaacacatgaccacatagctctggcaggcgtcagattaccaggctgataaaacagatggtaaagtagaagctgtccgttgacttttccattcccctttcagctcctccactgctacttaatctcctttgcccacacagttcaatcctattttccctgatctccaaatcctggctagattattagccattaacactagcttttacaaggagactcttcaatcttgtatttctagtagtataatttcacacgtacagaaattctttaagtcatagaagtcttacagatacagaaattctgatcttcaggagtcctgttgtgaaacaaactaatttatcctgacagcaggaaagatttctgggcctaaggctctgtctcgttgacccagctcatgctattcaggtggtccatctcttggttccaggcaagactgctgctgctgaccaacctgaatatggactttagcacttgggctcaagctgcactcagatggttggaccaccataaaagagcgagagggtacgtttttggtatgaaaagtaaagactaggccgggtgcagtggctcacgctcataatcctagcactttgggaggccaaggtgggcagatcacaaggtcaggagattgaaaccatcctagctaacacagtaaaaccccatctctactaaaacatacaaaaaaattagccgggtgtggtggtgggcacctgtagtcccagctacttggaggctgaggcaggagaatggcgtgaacccaggtggtggagctttcagtgagccaagattgggccactgcactccagcctgggtgacagagcaagactccatctcaaaaaaataaataaataaataaaaagaaaagaaaagtaaagactaaaaaaattaaatattataaccctgctaaggcaggaggatcctttgagcccaggagtttgaggctgcagtgagctatgatggcactactgcaacccagcctcagtgacagagggagaccctgtttctaataaaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggccaggcgtggtggctcaggcctgtaatcccagcactttgggaggccgaggagggtagatcacctgaggtcagaagttcaagaccagcctggtcaacatggtggaaccccatctctactaaaaatacaaaaattagctgggtgtcctggtacgcgcctgtagtcccagctacctgggaggctgaggcaggagaatcacttgatcccaggagacggaggtttcagtgagctgagaccgcgccactgcactccagcctggggggacagagcaagactccaaaagttctggaaatggataatggtgatagttgtacaacaatgtaatgtacttaatgtcactgacttgtacacttaaaaatggttaaaatgggcttgttccagcagctcatgcgtgtaattctagcgctttgagaggccaaggcaggatgatcacttgaggccagagttcgagaccagtctgggcaacatagcaagaccctgtctctaaaaaaaaaaaaaaaaaaaaaaggttaaaatgaggccatgcatgcctacaatcccagcactttgggaagatgaggtggtagggtcacttgtttgggaagaggaggtgggaggatcctttgaacccaggagttcaaggctgcaatgaaccatcatggtgccattgcactccagcctgggtgacagagcaagacctagtctctaaaaaataagagttaaggccagacacggtggctcatgcctctagtcccagcactttgggaggctgaagcaggcagattacaaggtcaggagtttgagaccagcctggccaacatggtgaaacctcgtctttactaaaaatacaaaaatcagctggccgtggtggcatgtgactgtaatcccagctactcaagaggctgaggcaggtgaatcactggaacccgggagccagaagttgcagtgagccgagatcagaccactgcactccagcctgggcgacagagcaagactctgtcttgaaaaaaaaaaaagaattaaaaaaagaaacatggccgagtgtagtggctcttgcctataatcccaacactcagggaggccaaggtgggaggattgcttaagcccaggagttcgagaccaggcaacatagggagaccccatctgtacaaataatctaaaaagttagccaggtgtggtggtgcatgcctgtggtcccaggtgctcgggaggctgaggtgggagaactgtctaagcctgggaggttgaggctgcagtgagctatgatcgcaccactgcactccagcctgggtaacacagtgagacaccccgtcttaaaaaacaaacaagcaaataaacaaatactatgcataaaacctcaaggctcaagaaacaacagtttgaaatagttagatgtgtgttttttttaattttcatgtcttatcttttctgcttttttttttttttttaagggatgaggtcttgctctgttgcccaagctggtatcgaattcctcctgggctcaagcaatctcctgcctaggcctcccccctaacagctggaactacaggcatctaccactgcattcagctactgggggagtgtttgactagtctttttaaaaaatatgttaatatcttggtaaaaagtatatttatactgttctctaacctgctttttttcatcagtttcatggaagaatgctcatcatatattcttctgctttataactaaactgctttcatttatgacatcacaattaaactggtaaaaccaaatttatattgctaacttgtttctaattttttctctattaaaatgatatgattagcatccttgtagccaaatatttacacatatttatgaagttatacttaaaacaaattcctagacgtggaactgtgagtcaaagagaagggatcttttaaatatttttgcatagattgccatgaaaaggtcataccagtttatatatccaccaatatgagtttcttttccaaatcttcttcaacatcctgtgagagacagttaaacatagttgttcagagcccagccttgagaatcagatttcaaacatatgaaccctctccctttttcttttctttttcttctttcttttttttttttttttttttttttttttttttttttttgcccaggctggagtgcagtggcgccatcttggctcactgcaagcactgcctccagggttcacgccattctcctgccccagcctcccgagtagctgggactacaggcgcctgccaccacgcccggcgaattttttgtatttttggtttttttttagtagagacggagtttcactgtgttagccaggatggtgtcgatctgctgacctcgtgatccacccgcctcggcctcccaaagtgctgggattacaggcgcgagccaccgcgcctggcccctttttcttgttagagacagggtcttatccaggttggtctgaaactcctggccttaagaaaccctgccacctcagcctccaagtaaactgggattataggcgtgagccacctcacccaacttccacttcccagctgtatgatcttcagaaaatcagttaaattctctgggccttaatttactactacggttcttgtaagtattaacaattagctactattatttaccttctttagttcctgagacttctatgcacagaatatacttgatgtgtgccacagaacctatacaaaggtaattacaactaacagggagttgtatgataatgacatgggacatgggacatgagagcatttggaaagagataaaaaggcttaccttgaggacagccttattaggagcagaggcaaacacaggttttgtgagtttgaagcttacgcatttataggtttctctaattaccaagataggaaattatgaaatcaggtacaagggcttgggaggggcctaaagcttaagtttgatgaaaaaaaaaaaccacctctggttggaaccaatagcctatgaaaaagtagaaaaaagcccaatgcatggggagcgccggtagtcccttgaggtgtttgagaggctgaggcaggaagatggctttagcccaggagtttgaggcttgtaagtgcgcagtgatggtaaaccgccgctgtactccagactggcaacgtagtgagaccctgtctctttaaaaaaaaaaaaaaaaaaaaaaaaagatgagaggtaacacttgcctgactgggacaaaaatgagaaaccagtataagaaaataataactattggccgggcgcggtggctcatcgcctgtaaatcccagcactttgggaggccgaggcgggcggatcacaaagtcaggagttcgagaaattaataactattacctcatttggctatttttacacctgtaaggaataaagctcagaggtcacacagctagtaagaagccagcacccttcgatgtgggagtgatgtggaggataggcatatacagagaacacgaaagcaaaacaccatggtgcagattttgaaagaaaagccctaagattagtaatgagtgtgaattattcaacaaagtgatcaaaaccaactccagtcctgcattcctcttcgccatcaggagtttggagcctggagactgctagctgcctggttgttgttgtttttttttttttctgagacggactttcgctctgtcgcccaggctgtagtgcagtggcatgatcttggccaactgcaagctccaccccccgggatcacgccattctcctgcctcagcctcccgagtagccgggacgaaccagtcctggcccagcccattccgcgagccagcaagcttctgaaaagcaaacctaggaagttgctttccaacataaagtggaggtttcaacacaggagactttaagcaagttccagtgtgtctatatttggtctggctgatcggctggactctggccttccccgctcacattagcagacagctctgccctagtgggcgtttagcctgcgacggcagcccgagaggaagagttgggcagagttgcaggggtctccacagctgaggcagtttggccggattatttgggttcctgctcggatggcggcgacgctgatcctggagcccgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacacccttggcgagctggacctggagcgcgcgcccgcgctgggcggcagcttcgcggggcttgagcccatggggctgctctgggccttggagcccgagaaacccttggtgcggctggtgaagcgcgacgtgcgaacgcccttggccgtggagctggaggtgctggatggccacgaccccgaccccgggcggctgctgtgccgggtgcggcacgagcgctacttcctcccgcccggggtgcggcgcgagccggtgcgcgcgggccgggtgcgaggcacgctcttcctgccgccaggtgactcacctccgctaattgttcccctctgcccatccctgttcctgcgctttccactgtgtgtgtgtgtgtgtccccttcgccccgccccgctcttttcgcttgtgtgtgtgtccctcctcccgccccaccaccaccaccccgggctatgttgcccaggtaggtcttgaactcctggacccaagctatcctcccgcctctgcctccccaagagctaggattgcagggtgagccactgcgcccggccctttgaggggagttacacttatttttttatttttattttttttcgtccctgcgcttttcatacggagaaaggatgtagcttccaacattccggaggttagtgtaaggagacaggaatggaatggaaagttggttggggaattgcccctgccgctccaaaactgagaggtccctcaaacctagtgctcagttaaaagacattgtaagggctgggcgcgctggctcacgcctgtaatcccagcactttgagaagccgaggcgggcggatcacgacgtcaggagatcaaggccatcctggctaacacggtgaaaactcgtctctactaaaaatacaaaaaattagccgggcgtggtagcgggcgcctgtcgtcccagctactcgggacgctgaggcagaagaatggcatgaacccaggaggcggagtttgcagtgagccaagatcgtgccacgcactccagcctgggcaatagagtgagactccgtctcaaaaaaaaaaaaaaaaaaaggcattgtaaggaaagagaaaagacacataatattaaaaacaaacaaaacaaaacaaaaaaaacaggccggacgcggtggctaacacctgtaatcctagcactttgggaggccgaggcaggcggatcaagagttcgagaccagcctggccaacatggtgaaaccccgtctctactaaaaatacaaaaattagccaggtgaggtggtgcacacctgtagtcccacctactcgggagtctgaggcaggagaatcgctggaaccctggaggcagaggttgcagtgagccgagatcacgccattgtactccagcctgggggacaagagtgaaactccatctaaaacaaaaacaaaaacaaaaaacaaacaacaacaacaaaaaattttcaagtagtttcaatgttcttatttatgtatggaccaggaagtcacttttttttttaataaaaagaattccaactggttttctcactgtatttccatggcagctaggaggtgccaggtggctgggcctgtgacagtgcagaggttttggtgcctgcccgcccaccattgctccagctgcagctgctgccccctgcagggcctgttcgttcctgctgcctagctccctgctggctggctatgatctccgtcctgttaccattccaggagagcagccacctccctgtgcatggcaggaccaggtactgattgtggcctctcctcttggcctcgaatggtatccttgtcatcagtgagcaagtccccaaagaccacggtcttgtccattgtcaggataattcactccacaagctgggactccaggtgctgctctacccagcggtgcttctcacccacacagtggtcatactttggcaggggctggtgcagtgtgaagacctcggtgttttgcatgtgcttcatctcttgcaaggccctctggggttgggcttcaagactagggaaaagcctagggcttcacacccatgggccactttatccaccaggtccggcagcagggtgaggtactgcttccagaccaggaagctgcggtgctgctgcagtgtcacatgcagctccctgagaagcggcggctgaagccccacaggatgccgtctggaagctgccagcacgcggtccctgtccatcagcacacgcgtgggctgtgctcatcgctgccggggcactggggtttctcgggatcctaggggtatggggcccagaaatgttctttaaaagtttctcatttttgcaacttttctttcaattcacacagtatgttaaggtttatgtaaattagcatttacaataggaaagcctcttcctgtcaaatggaaatttgaggttactggatacttttatattacataaagagcaatcagccagtgtagaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagtcaacatattcatctgctctgggcaacaatttgtcttaacttacaaagttaaatatgttattctacttgtacatgtgcaccaggaggcatattccttataagaggaaagccattgcagatgagcagtctggattaatttaaaaaaagagcaaagtcaactggaaacagtccaaatgtccatcaacaatagaacagattaataaattgaggtatatttccagcagtcaaagtgattgaactacagctagaagaatcaacatctatcaagatatacaaaagaaaagaaaaaaataaaaaagaatcaacatggatgaatctccaaaccactgttgagtgaaacagtcaaacactaggagaacacattcagtatcattccatttagatacagttcaaaaaataggcaaaataaaatattgtttaaggtacataatctaagtggtaatactatgaagaaaaccaagagtgatacacagaaagtccaggatactggaaagagaggaaagggcacaggggtctgtgggacgttgatggtttgcgggtatcagcactgaactatgtcttaaaagtgttgcctgtaaggtgtttgcattctttttttttttttttttttgagacagtgtctcgctctttcgcccaggctggagtagtggcacaatcttggctcactgcaacctccaactcccgggttcaagcgattctcctccctcagcctcccgagtagctgggattacaggtggccgccaccacacccagctaatttttgtatttttagtacagatggggtttcaccatgttggccaggctggtctcgaactcctgacctcaggtgatccacccgtctcagcctcccaaagtgctgggattacaggcgtgagccaccagacccagcctgcattattattctttaattttgtgtgaaacacaaaacctttaatgtaaatgataaaaatattcagtaagtggagtcattcagaatgagtagccttttgagtctgtctccattgaataagtgcattctgttgagtgcactggagaggaatttgtgctcttctatgtagcagtctttctttttgtttcttggtggtgcaccattaaatggattcattcaccagttaaaggacatttgggttgtttccagtctttggctacaatgaataaagtcactataaacacttgccagaagtttctggacgaacacaggttttcatttctcgtgggtagatacctaggagtgggattgctgggtcacatgtgtggtaagtatatgtttaacttggtaagaaaccatccaactgtttcaggaatagcttagttttgcattttgttttgtttcttcccaagaacctgggccctttcctggcattgtggacatgttcggaactggaggtggcctgctggagtatcgggctagtctgctggctgggaagggttttgctgtgatggctctggcttactataactatgaagacctccccaagaccatggagacgctccatctggagtactttgaagaagctgtgaactacttgctcagtcatcctgaggtgagttcttctctcagatttatgggctatgatgtatcaggtctcttcttaaatggtctgggttttcacagaagttagctcattcatgacagccattccctaccccaacacacactaccttttttagtcacttcttatagacagtttctttctttcttcttcttcttctttctttttttgagatggagtctcactctgttgccaggctggagtccagtggtgcgatcttggctcactgcaacctccacctcccaagttcaagtgattcttgtgccccagcctcccaagtagctgggattacaggcacctgccaacatgcctggataatttttgtattttcagtagagacggggtttcacaatatttgtcaggctggtcttgaattcctgacctcaaatgatccacctgccttggcctccccaggtgctggattacaggcatgagccactatgcctagcctaatttttgtattttttttttttagtagagatggggtttcgccatgttggccaggctggtctcaaactcctgacctcaagtgatctgcccacctcggcctcccagagtgctggaattacaggcatgagccaccacacctggcctcttatagacagtttctattcaattctatattactatatttcctgctagtaaagatatttgtagttggtattatgcaattttaaattccagtatgttttttctttctttttttttttttttttttaagacggagtcttgccgtgtcaacgaggctggagtgcagtggcatgatctcggcttactgcaacctccacctcccaggttcaagcgattctcctgcctcggcctcctgagtagctgggactacaggcgcatgccacttctgcctggctaatttttgtatttttagtagagacagggtttcaccatattggccaggctggtctcgaactcctgacctcaaatgatccacccgcctcagcctcccaaactgttgggattacaggcgtcagccaccacgcccggccatgagatgacgtacttgttgatgacgactcagtttagttatgacagtgggaatgggtggctcaggtgggagacagaaaaagatcatgggagataatgagattaaggaactgagaaaccagagtaattgatagatcttccacatggttatcaccaagagtggtgatggacaaattgtggaaaggaagagatagaggggaggtaaattcccaaagctgcaaatctgggtaaatggtagaacccagattcagactcaggttcaactaacttccagggtgggcacaactcaccatattccactgtttgtggagccattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattctttctcataacttcttaaagtttcttcccctcattattaaaatgaatttaccagtaagaatgagtttttaagatttttataaactgtatactttatcagtttgggaagggagtaactgtaggaaacacaagaagtggaaaaagtctcctcttcctatctcaacacacaactgataaggctttagttctgaaaggaaaagtgagtaacatcaattaacagtgtctggtacgtaaatggagttcaataattatttgctgaatgagtataagtgagccaggcgtggtggctcacacctgtaatcctagcactttgggaggccaaggtgcgcggattacttgaggtcaggagtttgagaccagcctggccaacatggtgaaaccccatctctactaaaaatacaaaaaattagccgggcgtggtggcgcatgcctgtagtcccagctactcaggaggctgacgcaggagaattgcttgaacccgggaggcagaggttgcaatgagctgagattgcactactgccctccagcctgggtaacacagcaagactatgcctcaaaaataaataaattaattaaataaataaatgattacctactgtggaagaaaagcacataatataaaaagtatatcagatttgagtttctcctttaagaatggaagttaacatcttgcctataaactgattactagttagatataaaactactaaaacttttcaaaaccaatacatatttagttctttgatatcttctccttggattaataaggattctcctagtgcaaataaattttatgttcctgtttatacatatggacctttaggatttaattgtttcaaaagctgataaaacattattgagatgaattacataagcgattttaacaatgacaaatgtgaaattcaataacaatttaggcttggcatggtggctcacacttgtaatgccagcactttgggaggccaacgctggtggattgcttgaacccaggagttcaagacaagcctgggcaacatggcaaaaccccgtctctacaaacaaataccagacattgtggcggatgcctgtagtcccagctactggggaggctgaggtgggagaactgcttgagccctggaggcagaggttgcagtgagccgagattgtgctactgcgctctagcctgggtgacagcaggatactgtctcaaaaaaaaaataaagaaaaagaaagacaatatttatatcacttgatataaatagttacacaataaacttgattttttcttaaaccttagttgtatttaaaagaaaaaaaaaaccttaatttattattattttctttccttttttttttttggaggcagggtctcattctgttgcccaggctggagtgcagtggcacagtcacggctcactgcagcctcaacctcgtaggtttaagctattctcccacctcggcctccctagcagctgagaccacacaggcacacaccaccatgcctggctaatttttaattttttgtacagatggggtctcccaatgttgcccaggctagtcctgaattactgagctcaaacaatcctcctgcctcagcctcccaaagtgctgaaattacaggtgtgagccaccgctgccagcttccggcaccttttttctaaaggaattcatggttttgtagcagtagaatataaccagatctacagtagagagatgataccctgagatgaagctacctcctgtgttactctgcaacccaggaatgcagctggtgccatgtctccaaacttccacaagaatgccagtgctgggcatggagccccatttagagtacacatgacctgaggctctgaaaactcttagagatgatgcaatctgggacagttgctcatagctggcctggccaagtcccaccccaagatgccaggccacaacacaaaatttcaagtcatattgttttatcttttcccttgcaattatatagtatatgactctcttagaaaagtgcaatagttaaaacttgttttagtagatgctagatcccaaacttgagtctgctgaagcccttttgagaccttagggaccctattctccattcttagaaattcaggctggtgaatattagattcaaaagcaccacagatgagccggtggttgtagaagtacatgcctgtaatcccagctacttggaggctgaggcagtagtagtattgcttaagcccaggagttcaagccagcctgggtaacatagtgggacaccatcttataaaaacaatttttttttgagacagtctcgctctgttgcccaggctagagtacaatggcttgatctcggctcactgcaacctccgcctcctgggttcacgtgattctcctgcctcagcctcccaagtagctgggattacaggcgcccaccaccacacccagctaaattttgtatttttagtagagatggggttttgccatgttggtcagctggtctcgaactcctgacctcaggtgatacacccggcttggcctcccaaagtgccaggattataggcgtgagccaccgcacttggcaaaaaaatgttttaataacatgaaaaattttaaaaagcaccacaagggttcagattacctatcagcctcttgacatttcgtattttttttttttttttgagacgagatctaactctcacccaggctagagtgcagtggcagtaacatgatctcagctcactacagtcttgatctccaaggctcaagtgatcctcccacctcagccccctgagtagctgggactgcagacacatgtcaccatggacagctaatttttgtatttttgcagagacaaggtttcaccatgttgtccaggctggtctcaaaactcctgggctcaagcagtctgtccatcttggcctaccaaactgcttggattataggcatgagcaaccgggcccagcctagttagtctttattagttatttgaaagacatttttcttttcactttcaacccatgcacactgtgaacactgtgaaatacacagaaaagttcattaaactaacatgctccataatgattcacttatttatttgaaaacagaggttgggtgcagtggcttatgcctgtaatcccagcactttgggaggccgaggcgggcagatcacctgaggtcaggagttctagaccagcctgaccaatatgatgaaaccctgtctctactaaaaatacaaaaattagccaggtgtggtggcatgtgcctgtaatcccagctacttgggaggctgagacaggagaatagcttgaacaaggaggcggaggttacagtgagccaagatcacgccactgtactccagcctaggcaacaagagcaaaactccgtctcaaaaaaagaaaaaagacccggtgcggtggcttacgcctgtaatcccagccctttgagaggccgaggtgagtggatcatgaggtcaggagcttgagaccagccaggccaacatggtaaaacgccatctctactgaaaatacaagtattagccgggcgtggtgctgggcgcctgtaatcccagctactccggaggctgtggcaggagaatcacttgaaaccggaaggcggaggttgcagagagccaagatcgtgccactgcacgccagcctgggcaaaagggcaaaacgctgtctcaaaaacaaaatagagatggggtctccctatgttgcccatgctggtcttaaactcctgggctcaggcaatcttcccaccttggcatctcccaaagtgctgggattacaggcaatcaccactgcacctggccatcatgaataattttaaagggaaccacaacataaccaatacccaagtccaatcggcatggtttttaaaagcatatttaaagtgtataacatggaccaggcacagtagctcacgcctgtaatcccatcactttgggaggccaaggtgggtggatcacttgaagtcaggagttcgagagcagcctagccaacatggtaaaactccatctctaccaaaaaatataaaaatttgccaggggtggtggtgtgcacctgtactcccaactacttggcaggctgaggtgggtgaatcgcttgaacctgggagtcggaggttgcagtgagccaagattgtgttactgcactccagcctggacaacagagtgagaccctgtctcaaaaaataaaataaaaataaagtgtacaaagagatggttgtggcgggttgtttttgtttttgttttaagagacaggctctggccaggctggagtgcagtggtgccatcatagctcattgtagcctcaaactcctgggggcccaacccatcctcccacttcagcctcctgagtagctgagactataggcacttgccaccatgcccagctaatttttaattttttgcagaaacagggtcttattatgttgcccaggctggtctcgaactcctggcctcaggtgagcctcctgtaatcagtagaagggtccagctgccagccacttgtaaaaagaagccaatataataagagtgaggtgtgataaagagagtgagttttattatccatgctagcaaggggagaagtgagtgtagttatttgcaaatatttccactcttcaatttgtggagggaatccaggagcttttgaagagagagtttggagtgcagaagaggcagcggaactaggagttgtcgggtggcgtgacctgctccactggcttgttttgaagtattgtttcatctggtgaaggagccagtgccatcattgtggctagaggtgtctggtccatatccagatccagtccctgaagctgaaggaaatatatgaccaggtaatggtgtgtacttaacaagcatctaggtaaatacatgtgcataaggcacggaagcacagaatgggaaaagaaagggcgtggaggttcagcacattctgagggtgtatttcaagatgaaaggaaactcatatgcagatggtctcagagttctatcttgagactcactgggggaggagaaaggggaaaggaaaaaaagtcttaaggtttgaggctaagctgctaacctgcttagttacactcccaccttggcctctcaaagtgctgggattataggcatgaaccactgtgccaacccaacatggtgttttgatatgtgtatattaacacactgtgaaaggattcacaggtaattaaccaggtaattccaggtaattaacctatccatcgcctcacatctttctctctctctctcttttttttttttctggtggtgaggacacttgtcttagtctgttcaactgcagtaacaaaatgtcttataccgggtaatttataaacaacagaaatgtattgctcacagttttggaggctaggaaatccaagatcaaggcaccagcagatctggtgtctgctgagggcctgttcctcatagatagcaccatcttgtgtcctacctagtggaaagagcaaggcagctctcttcaacctgttttataagggcaccaatcccattaatgagggttccaccctcatgacagtcacttcccaaatgcctcgtgatgtgtgtgtgtgtctgtgtgtgtgtgtatctcaggggcgtcaggcctcaatttcctcatctatacaatgggtataacaacaatcccatcttgttgggaggaattaacaatcatgcatcgagccctgggcctcaggcttcaatgtattagttattagagctaatcattatttaatgttttaaacacccccaggaagtagagaacattcctgtcacattctgcagaaaaagaaattgaggcaaggggcaaagccatttgccaaggtcatagatcctgcaagccaatggcaaggcaggatctgaacctggggcttcagatcctggggctttacctgattaaataccaagagagagtgctgagatttttttggtggtggacagtccctgaggcaagccatttttagagcatctgggccacttggggaattgaatctttaccagggcttcccacctcctgttgccccttctctgaaggtgacccccctcccacagtagcaccccaaccactcagaacccccaagccaccttctttgcacatgctgaagctaatattgccctccactccaccccaacatcagggaccctggcccaagcccttccctgggagcccttcctcctctcatgaggcctccttcccagcccctcagaacagcctcctttatgagagtggccaagatcccactgaaaccttccctatcaactttataaaattaatcaggggagaagggaggggcgaaatggaaatcagcccagcttgcagcacacacagcattggtcatgaggtcagctgctctctgacccacttgctcagagttgtttgctgcctgttgctccagagtctcatagaccctgtcacaaggtcatagttccccttcactgctcatagataacaactggaacattataaaacattaacttttccatttgagatattctttcaggtcctgcatagcaatgaaactgaggcaggataggtagctaagggagtgaccgtgttctcgggatgcagcgaccatggcacccatacagtcaacacagtgagcctcagcattcgcattgtcattgcgctcattcaagcaaagctgtcttcattagggaatttcccccatagacagcatgagcattttgattttacctgtcctcaaactgacattttgctcattataatagtagaagacagccctacatggagatgtaatatgctaatgagacatgtgacatatgaacaagcatgtacagctactgtgcatgtgcacacagaagaccacccggaacatgcttattagcaacacctcttcccaccaccttatgaataatcatgtaagactcccataaagggagtctccctactgccagtctctgctgtctcacccttatgagcagcctgccttgaaccctctctctcacagtatacagtccattctgcatgtaaatttcaaaatattcttcttcctttgcaataaattactctatgctgcacttctttgctgtgtgtctcttgtttaaattcttttaaaccaagaagacaagaaccgaggtgtcacatcagccgccaaagaaactgctgatgccagcctgaatgaaagaccccacaggaactcactcactaaagaatgcagtttttgctgggcgcggtggcatggctatagtcccagcactttgggagacagaggcgggccgatacgaggtcaggagttcgagaccagcctggccaacatagtgaaacaccgtctgtactaaaaatacaaaaattagccgagtgtggtggcatgtgcctgtagtcccagctacttggaggttgagaggctgaggcaggagaatcacttgaacctgggaggcacaggttacagtgagctgagatcgtgccattgcactccagcctgagtgacagtgtgagactccgtctcaaaaaaaaaaaaaagaatgcagtttccacctcctgaaaatttaatcccctttaccccaactagtcaatgagcccaattttctagccctttaccctccatgatccctttaaaaaccctgttacaggtagttagacatgagcagggaaggagagggcttttctccctcacccactaggaatgtcaggtggtggttgacagttatcacgttgcctctctaaactgaaaattcgcagttggtgccagagggccagagtgagacaagctcctgatgatccacaggtgttaacattaaagtgttaattgaatgcaggtgccagggagaagcaacttcctgggcacgtgcattaagagacaaaatggcaggccaggcgcggtggctcacgcctgtaatcccaacactttgggaggctgaggtggatgggtcacctgaggtcaggagttcgagaccagcctgaccaacatggtgaaacaccgtctctactaaaaatacacaaattagccgggtgtggtggtgcgcacctgtagtcccagctactcaggaggctgaggcaggagaatcgcttgaaccccaggaggccgaggttgcagtgagctgagaccacgccattacactccagcctgggcaacaagagtaaatctccgtcttaaaaaaaaaaaaaaaacagacaaaatggctatgtatgacctctccaggacactccactggaaaagggaagaaagcctcagatgggcacgtatacaacttcctacacacactgtgcatgctcacttccgaaaggtaaagagagcacagagcatgagggcagctcaccctcagagaagaatcatgagaaagaggcgagcctataaagtcctaggatcacagttaaacagggctcttgaccttcaggtgcccggtcaggtctcttccaagtgaactttcctttctttcatgtcctaaagactttttaaataaacttccactctgctctgaactcacctccgtctctttttctgccttatgcccctcagtcaaattctttcttctgaggaggcaagaactgaagttgctgtagacctgtacagattcgccaccagtaactcagacaccttccactggtaacaaccccagcccagaattcttcaaggagatggatttgagggtctcctcccatctccttgctaggtgccctgtgatcatgaagctctttctgtgctgcaaaccctgctgtctcagtgtaattggtctgtaacagcagagtgggcattctgcagcctcttccttgcccggggcctgttgggagcccccagcactgcctgtaccatcataaacccaccctggcccctttcccaggctccaagctcagaggaggcagaggcttcattctaaactacagcatcccctccctaatcctcatttgccttctccttctgagcttgggccccattttttgagaccctaccagcccccattcccacaatcccctgtgccgacacaaatcaacctccccatgtcccaaccactgtcaaccccaacttagaccagtgcatcccacagctattctagcaccccataaacactccagtgtcccccacttcctgatcccacaacaccttgggccctccagataacccgctgctccagcctggcagtttgtcaaccccctcacccagacccccaacacctcatgcctgtcttatgccatgagtctgaggcccctgacccctacacctcttgggtgccacccaggcctgtctgtgtgggcagctcccccaccagctcccttccatcccccatgggtcctatccagggtttccccgacccaagcacacactattcggcattcctgactcccactgttcctggctcacggcctggccaccttgtctcgctcatctgccatagcccctgcctggcccagcaggacaggcctaggtcagggcaaggacaggtcagcaccagggctggtgccccaccccgaaggacacaagcctcctgctcaggacactttctggggtcctgtgcctccccttcttctcccccaggtgccaagtccccactttttaatactatcgcattgaggctgggcatggtggctcacacctgtaatcccagcactttgggaggctgaggtgggcggattacctgggctcaggagttcaagaccagcctgggcaacatggtgagaccccatctctactaaaaatccaaaaaataattagctgggcttggtagcactcgcctgtaatcccagctacgggggaggctgaggcaggagaatcacttggaacccagaaggtagaggtccagtgagccgggatcgcgccactgcactccagcctaggcaactgaacaggactagatctccaaaaaaaattaaaataaaaaagtattatcacattgggtattaggtttgttaaataaaaattattgctgtggaggatacacttgaagggaatgaaaaaaagtataggagactattgttttgctttttttttgttttgtttttgagatagagtcttgctctgtcccccaggctggagtgcagcagcgcaatcttggcacactgcaacctctgcctcccaggttcaagcaattcttgtgcctcagcctccctagtagctgggattacaggcatgcactagcatgccccgctaaggccattgttttggactaggctctagcactaggccccaatagacaagactaaaaaccaaaatggcgtcacctgtgctaaagtttcacccaacctaaactgaagtgttacctggccttctgagaaatcaggagagaaataacagccaatttcccaaacatgccagttttgatctttaattatcatgacaatgaggttcccctctgctttaatctgtacacaaaagaattagccagctgggcatggtggcttactcatgtaatcacggcacttcgggagcccaaggcaggcagatcactagagaccaggagttggagaccagcctgcccaacatggtaaaaccctgtttctatgaaaaataaaaaaaattagcaggcatggtggtgggggcctgtaatcccagctactcaggagacagaggcaggagaagcgcttgaaccagagaggcagtggttgcagtgagccgagatattggattaggcagtcaaaaaaaccaagcaagcataaaaggtcaataagttgtaatcttgatagtaaaagtggaaaacttattataaatggaaagaaagttttgatttccttttttgtttgatgggcagtatgccatattatacccaaagttcgtttaaaaaatatttccatcaactatttttatttgaaataaatatttgaggtaagttaccaaggcagcttttttcctcaaaagtaacctgttcctctttggaatagcacattttaggggcatggttaatacctgagatttttactcagtaaatcctgatggttactatgtgtaaaatatctttaagtaggattgaaggcctctgtggggaataaaatattaccaaagtctataaaaataaattttacatgttctcctttatgacagagagcagcactggttctgctacttttaaaatgaataattgatttcttgataggtgtttgatatttcttccctcactgctgattcttagatagaaaccattctttatatttgatagactgttttcagaaaacccttatcaacaagtgtacaatacttatctgaaactatacgtttagaatggagcagtttaatactagatctcagaaatttgaaaaatagcaaagaagactggatttggaaagcatggtctacaattgcttgtcaaattctgaagctatgaagaataaatgtttcaactttggattatgaaaccccatttatgattttttaaataaacttgaaataaaaatgattaaactaaaaaaaaagaatgtagagggagagatcaatgtaaaaatttatttaaagaaatagtaacagagaactttctaaaactagagaaagatatgaatatacaggtataagaaggtcataaaacaccaagccaactcagcctcaataagactacctcaaggcatataataatcaaactctcaaaggtcaaggctaaaaaaggatcctaaaagcagcaagagaaaagaaggacatattaataacatcataaaggagctccaatatggctggtagcagacttctcagcagaaactttacaagcagagagtggggtgacaaagtgctgaagcaaaaaaacttccaatctagaatattatattcagcaaaaacagccttcaaacatgaaagagaaataaggatattcttagttaaaaaaaaaaaagtgagagattttgacatcagacctgtcttataagattcttgttaagaggagttcctcactggttgagtatgaatggtcaaatgaaaagaacattaatattctcctgccttgcatattcttctaaaacattttacattcctaacacatcagtgtgtccacatcttgcttctaaggcagggggcaatttgatcctaaacagttgaaaaatgggatgaggactcatttcatccccagatgactacctataaggagtgattggctaggtgggtggctcacgcctgtaatcccagcactttgggaggctgaggcgggtggatcacccaaggtcaggagttcgagaccagccagcctgatcaacatggagaaaccccatctctactaaaaatacaaaattagccaggcatggtggcacacacctgtaatcccagctacttgggaggctgaggcaggagagttgcttgaacctgacaagcagaggttgcagcgagccgagatcgtgccaccgcactccagcctggataacaagagcaaaactctatctcaaaaaaaaaggagtgatttagggtgtccacagataaatgccctttagcctttgacataaagaatctttagttacaatgcaaacatcccagaaagaataccatattaccattatcaattattagaaattcttaaggaggctgggtgcggtggctcacgcctgtaatcccaacactttgggaggctgaggcaggcagatcaccagaggtcagcagttcaagagcagcatggccaacatggcgaaaccccatctctactaaaaatacaaaaaattagccaggcatggtggcaggcacccgtaatcccagctactcaggaggctgaggcaggagaatcgcttgaacccaggaggcggaggttgcagtgagccaagatcacaccagtgcactccaggctgggtgacaagagtgaaacttcttctcaaaaaaaaaaaacaaaaaaaacttaaggaatagttattatcatccgatatgatggcttattaagaaggaagggaacacatgataggtctgttttgaaaaggaatggggacagaacaaaatgttacacaaggtctgatcaaaagaggcttgttctggcttgtctttgtctgtcttggagtcacgggacaggtgtaaggccaaattgtgcacttcccagtcatgttaccttgggcaaataatttgaaatctgtagtttcccaatctgaaaattgagtctgatacctgttctaatttagtgttgattgatatgaacctcaaaattagaaacgtatgaaagttctttgcaaactaaaatatatgtgtgaggaattgttattattagtttagaggatggactgttgtccttagaaggcaagtctctgggtcctacagttagatgcactgggcgcttcgggaagaatttagggctatggggtactcagcaattaaaagagagggtgcttagagaagaaagaaaggacttattaatggagtttggaggctccttattatcgaaacttacacattacgtgaccagcattatgaggcagcaccccactcccaacaaatagccctctagaaccaaaagcagagtggcaggtccggggtccttttgtacatagacggcataaaaaattgactaagtcaatcctggcataactgcagaccaggccctggaatgagcaacccaccagcattatctgcatttctaggaacttgggctagaaggggaggaatggggttggaagggttaggccacatgcctctagttaaaacctgatgaacttcctagatccccagctggaaaacgtaggagttggactaaattcctctcctgcctctaatattttatgaatacagaactcaactcaaactgggtagtatctcagagattccaaatttagttccacttttctgtttgcttatcagtcgcttaccctcaccctctggtctgatacctttatcctgtacaagtggtcaaagtaggttgagtaacatgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaacttttttttgtagagacagggtcttactatgttgtccaggctggtttcaaactcctggaatcaagtgatcttcctgccttggcctccagaaatgctgggactatgcctggaatagatatgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaattttttaccatgcactcacacagctatacagctatctccagagattactctggaaactctgctataaagatgacctggtctaatgccttgatttgtttttttttttttgagacagggtctcactctcctggagtacagtggcgtgatcatgactcactgcagccttgacctcctgggctcaagcaatcctcccacatagctgggagcataggcacatagcacaccactctcggttaaatttttttttttttttttttttttgtagagatagagtctcactatgttgctcaggctggtcttgaactcctggactcaaacagtcctcccaccttggcctcccaaaatgctgggaatacaggcatgagccactgcaccaggcctaatgtcctgattttataaatcccaaaactggggcccagagagaagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctaaaaggcagtcctcagagagaagcaaggttctgcatcttaagccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctttgagaaattgcatcttatttattgattatttattgaatggtagtttcatggagtttttggtcttttttcttttttgagacagtctcactcagttgcctaggctggagtgcagtggtgcgatctcggctcactgcaacctgtgcctcccaggttcaagcaattctcctgtctcagcctcccattacaggccacaccaccatgccccactaattgtacttttagtagagatggggtttcaccatgttggacaggctgttctcaaactcctgacctcaagtgatgtgtccgccttggcctcccaaagtgctgggatttgcaactgtgagccaccacacctagcctcttggtcattctttgaaaaataaacctcagccaggcgcgatggctcacgcctgcaatttcagcgctttgggaggctgaggtggcggatcacctgaggtcaggagttagagaccagcctgaccaacatggtgaaaccccatctctactaaaaatagaaaatttaaaaagaaaatcacctgggcctggtggcgcatgcctgtaatcccagctactcgggaggctgaggcaggagaatcgcttggacccaggaagcagaggttgcagtgagccaagatcaggccattgcactccagcctgggcagcaagagtgaagtgcagtctcaaaagataaaaataaaaaaaccctctagatatatgcagctccatattctcccaccacaagggtttataaatcctgagaaagaggcaaagcagggaacacatgaccacatagttctggcaggcgtcagattaccaggctgataaaacagatggtaaagtagaagctgtccgtcgacttttccattcccctttcagctcctccactgctacttaatctcctttgcccacacagttcaatcccattttccctgatctctaaatcctggctagattattagccattaacactagcttttacaaggagactcttcaatcttgtatttctaatagtataatttcacacgtacagaaattctttaagtcatagaagtcttacagatacagaaattctgatcttcaagagtccctttgtgaaacaaactaatttatcctgacagcaggaaagatttctgggcctaaggctctgtctcgttgacccaggtcatgctattcaggtggtccatctcttggttccaagcaagactgctgctgctgaccaacctgaatatggactttagcacttgagctcaagctgcactcagatggttagacccccataaaaagcagagggtacgttttctgttatgaaaagtaaagactgagccaggcgctgtggctcacgcccataatcccagcactttgggaggcaagttgggcggatcacgaggtcaggagatttaaaccatcctgggtaacacggtgaaaccccatctctactaaaaatacaaaaaaattagccaggcgtggtggcaggcgcctgtagtcccagctacttggaggctgaggcaggagaatggcatgaacccgggaggcggagcttgcagtgagccgagattgggccactgcactccagcctgggcgacagagcaagactccatctcaaaaaaaaaaaaaaagaaaattaaatactaaaaaaattaaacattataaccctgctaaggcaggaggatcatttgagcccaggagtttgaggctgcagtgagctatgatggcactactgcaccccagcctcagtgacagagggagaccctgtttctaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggctgggcgtggtggctcaggcctgtaatcccagcactttgggaggccgaggagggtggatcacctgaggtcaaaagttcaagaccagcctggtcaacatggtgaaactccatctctactaaaaatacaaaaattagccaggcgtagtggcaggcgcctgtaatcccagctactcaggagaccgaggcaggagaatctcttgaacccaggaggcagaggttgcagtgagccaagatctcgccattgtggtccagcccgggcgacagagcgagagtttatctcaaaaaaaaagaaagaaaaaaaaagaaaaaggaatgaaatgggccaggtgcagtggctcacgcctataatcccagcactttgggagcctgaggcggacagattactcaaggtcaggagttcgagaccagcttggccaacacagtaaaccccgtctctactaaaaatacaaaaattagctgggcatggtggcacacacctgtagtcccagctactggggaggctgaggcaggaaatcacttgaacccaggaggttgcagtgagccaagcaagattgcaccactccaccccagccgggcaacaagagtgaaactctgtctcaaaaaaaatgaatgaaatggctgtgtgaggtggctcatgcctatgatcccagcactttgggaggccgaggtaggaagattgcttgaatgtagaagttcaagaccagactgggcaacaaagtgagacccccatctctacaaaaaacttaaaaagtatccaggtgaggtggcacgtgcttgtcgtcccagctactggggagactgagatgggaggattgcttgcacctgggtgttgagactgcagtgaactgtgatcttgccactgcactccagagcctgggtgacagagcaaaattcctggggagagtgaagttatgatatgctgtaaatatatggatgagccttgaagacaatatgctaagcaaaataagccagagatgaagggccaaatactgtataattacactttatgaggtacctaaagtagtcaaattcagagacaggaagtggaatagtggttgccaggggctggtggcagtggggaataaggagttattgtttaatgttgtgggaagtcaaggaccccgaatggagggaccggctggagccgcggcagaggaacataaattgtgaagatttcatcttaatatggacatttatcagttcccaaataatacttttataatttcttatgcctgtctttaatatcttaatcctgttatgttcgtaagctgaggatgtacataacctcaggaccactgtgataattgtgttaactgtacaaattgattgtaaaacatgtgtttgaacaatacgaaatcagtgcaccttgaaaaagaacagaataacagcgatttttatggaacaagggaagacaaccataaggtctgacagcctgcggagtcgggccaaaagagccatatttttcttcttgcagagagcctacaaacggacgtgcaagtaggagagatatcactaaattattttcctagtaaggaatattaatattaataccctgggaaaggaatgcattcctggcgggaggtctataaacggccgctctgggaatgtctgtcttgtgccgttgagataaggactgagatacgccctggtctcctgcagaaccctcaggcttactagggttgggaaaactccaccctggtaaatttgtggtcagactggttctctgctctccaaccccgttttctgttgtttaagatgtttatcaagaaaatacatgcaccgctgaacacaacccttatcagtggttctgcttttgccctttgccttgtgatctttgttggacctttgtcagtggttctgcttttgccctttgtcctattccctcagaagcatgtgatctttgttagaaccttattagtggttctgcttttgccttttgaagcatacgatctttgtacccactccctgttcttacccccgctccccttttgaaacccttaataaaaacttgctggtctgagactcaggtgggcatcacggtcctaccaatatgtgatgtcacccccagcggcccaggtgtaaaattcctctctttgtactgtctctatttgtcagccggccgactcttatagaaaatagaaggaacctacgttgaaatattgggggcgagttcccccaatagtttaatgggtaaagactttcattgtacaatgatgtaaaaattctgggccagacgcagtggctcacgcctataatcccagcactttgggaggctgaggcaggccgatcacttggggtcaggagtttgagaccagcttggccaacacagtgaaatcccatctctactaaaaatagaaaaattagctgggtgtggtggtgcgtgcctgtagtcccagctactcgggaggctgaggtaggagactcacttgaacccgggaggtggaggttgcagtgagctgagatcgcgccactgcactccagcctgggggatagagcgagactccaaaagttctggaaatggataatggtgatagttgtacaacaatgtaatgtacttaatatcattgatttgtacacttaaaaatggttaaaatgggcttgttccagcagctcatgcctgtaattctagcgctttgggaggccaaggcaggagggtcacttgagaccagagttcgagaccagtctgggcaacatagcaagaccctgtctctaaaaataaaaaaataaataaataaatggttaaaatgaggccatgcatgcctgtaatctcaccgctttgggaagatgaggcggtagggtcacttgtttgggaagaggaggtgggaggatcctttgaacccaggagttcaaggctgcaatgaactatcatggtgccattgcactccaacctgggtgacagagtaagacctagtctctaaaaaaataagagttaaggccagacacggtgactcacgactgtagtctcagcactttgggaggctgaggcgggcagattacaaggtcaggagtttgagaccagcctggccaacatggtgaaaccccgtcgtactaaatatacaaaaatcagctggccgtggtggcatgtgactgtaatcccagctactcaagaggctgaggcaggtgaatcgctggaacccgggagccagaggttgcagtgagccgagatcagaccactgcactccagcctgggtgacagagcaagactctgtcttgaaaaaaaaaaaaattaaaaaaagaaacatggcccagtgtggtggctcttgcctataatcccaacactcagggaggccaaggtgggaggattgcttaagcccaggagttcgagaccaggcaacatagggagaccccgtctgtacaaataattttaaaaattagccaggtgtggtggtgcatgcctgtggtcccaggtgctcaggaggctgaggtgggaggactggctaagcctgggaggttgaggctgcagtgagctatgatcacaccactgcactccagcctgggtaacacagtgagacaccccgtcttaaaaaacaaacaaacaaataaacaaatactatgcataaaacctcaaggctcaagaaacaacagtttgaaatagttagatgtgtgttttttaattttcatgtcttatcttttctgttttttgtttttttttttttttttttagagatgagatcttgctctgttgcccaagctggtatcgaactcctcctgggctcaagcaatctcctgcctaggactccctcctaacagctggaactacaagcatgaaccactgcacccagctactggtgtattgtttcagtagtctttttaaaaaatgttaatatcttggtaaaaaatatatttatactgttctctaacctgcttttttcatcagtgtgatggaaaaatgctcatcatatattcttctgctatataactttagatgtctacactgatttcatttatgacatcacaattaaactggttaaaccaaattcatattgctcacttgtttctaattttttctctattaaaatgatatgataagcatccttgtagccaaatatttacacacattcattaaggtttacttaaaagaaattcctagacgtggagctgagtcaaagagaagggatcttttaagtatttttgcactgattgccatgaaaaggtcataccagtttatacattcatcaatatatgagtttcttttctaaatcttcttcaacatcatgtgagagacagttaaagcatagttgttcagagcccaggcttgagaatcagatttcaaaggtatgaaccctctccctttttcttttccttttttttttttttttctgaggagtcttgctcagtcgcccaggctggagtgcagtggcccaatctcggctcactgcaagtgtgtccagaattggtggattcttggtctcactgacttcaagaatgaagccgtggaccctcacgggagcattacagctcttaaaggtggcatgtccagagttcgttccttctgatgttcggatgtgttcggagtttcttccttctggtgggttcatggtctcgctggcttaggactgaagctgcggaccttcgtggtgagtgttacagctcttaaggcggcgtgtctggagttgttcgtttttcccggtgagttcatggtctcgctggcttcaggagtgaagctacagaccttggtggtgagtgttagagctcataaaggcagtgtggacgcaaagagtgagcagcagtaagatttattgcaaagaacgaaagaacaaagtttccacagtgtggaagggggaccccagcgggttgccactgctggctagggcagcctgcttttattctcttatctggccccactcacatcctgctgattggtagagcccaggggtctgttttgacagggcactgattggtgcgtttacaattcctcagctagacacaaaagttctccacgtccccaccagaatagttagatacagagtgttgacacaaaggttctccaagtccccaccagagtagctagatacagagtgttgattggtgcattcacaaaccctgagctagacacagggtgctgattggtgtgtttacaaaccttgagctagatacagagtgccgattggtgtatttacaatcccctagctagacataaaggttctccaagttcccactagactcaggagcccagctggcttcacccagtggatcgtgcactggggctgcaggtggagctgcctgccagtcccgcaccgtgagcccacactcctcagcccttgggtggtcaatgggactgggctccgtggagcagggggcggcgctcgtcagggaagctcaggctgcacaggagcccacggaggcggggggaggctcaggcatggagggctgcaggtcctaagccctttcccgtgggaaggcagctaaggcccagcgagaaattgagcacagcgccagtgggccggcactgctgggggacccagcacaccctccgcagccgctggcccaggtgctaagcccctcattgcccggggctggcagggccagctggcggctccgagtgtggggcccaccaagcccatgcccacctggaactccagctggcccgcaagtgcggaacgcagcctcagttcccacttgcgcctctccctccacacctccctgcaagctgagggagacggctccggccttggccagcccagaaaggggctcccacagtgcagcggtgggctgaagggcttctcaagtgccgccaaagtgggagcccaggcagaggaagtgctgtgagggctgccagcacgctgtcacctctcacaagctccacctctggggttcacgccattctcctgcctcagcctctggagcagctgggactacaggtgcctgccaccatgcccagttaatttcttgtatttttttttagtagagatggggtttcactgtgttagccaggatggtgtcgatctcctgacctcatgatccacccgcctcagcctcccaaagttctgggattacaggtgtgagccaccgcgcccatcccctttttctttttagagacagggtcttgctatgttgtccaggttggtgcgaaactcctggccttaagcaaccctgccacctcagcctccaagtaaactgggattacaggcgtgagccatcttgcccaacttccactttctagctgtgtgatcttcagaaaatcagttaaattctctgggccttaatttactgatagggttcttgtaagtattaaccattagctactattgagaggtgaagaccgctgggcttctgggttgggtggggacttggagaacttttttgtctagctaaaggattgtaaatgcaccaatcagcactctgtgtctagctaaaggtttgtaaacgcaccaatcagcactgggtaaaaacgaaccaatcagcactttgtaaaacgaaccaatcagcactctgtaaaatggaaaatcagcgctctgtaaaatggaccaatcagcaggacatgagcagggccaaataagggaataaaagctggtcaccccagctagtagtggtaacctgcgtgagttccgctccaggctgatggaagctttgttcttttgtacttcacaataaaccttgctactgctccttctttgggtccatactgcatttcagagctgtaacaccgtgaaggtatacagcttcactcctgaagccaagaccatgaacccactgagaggaacaagaaaaacaactctggacctgctgcctttatgagctgtaacactcaccttgaaggtctgtggctttactcttgaagtcggtgagaagcgagaccatgaacccaccagaaggaacacattccggacgcatctgaacatcagaggaaacaaactccagacacactacttttcagaactgtattaagaactgtaacagtcactgcgagggtctgcggcttcattcttgatgtcagcgagaccaagaatccaccagaaggaaccaattccagacacagaattatttgccttcttacttcctgagagttctaggcacagaacatacttgaggtgttatacaaaggtaattagaactgacagggaattgtatgattaatgacgtgggacatgagagatttggaacgagataaaaaggcttaccttgaggacagccttattaggagcagaggcaaacacaggttttgtgggtttgaagcctacacatttatagctttctctaattacacaggtaggaaattataaaatcaggtacaagggcttggcaggggcctaaagcttaagtgatgaaaaaaaaaaacaccacacctctggtgaaaccaatagcttacgaaaaagtagaaaaaagcgcgatgcatggggagctccggtagtcctttgaggtatttgagaggctgagtcaggaagatggcttgagcaccaggagttggaggtttgtaagtgcagtgatggtaaactgccgctgtactccagtctggcaatgtagtgagaccctgtctctcaaaaaaaaaaagtaacccttgcctgactgggacaataattgagaaaccagtaaaacaaaataataactattagccgggcgcggtggctcatgcctgtaaatcctagcattttgggaggctgaggcgggcggattacaaagtcaggagtttgagaaattactacctattaccccatttggctatttttacacttgtaaggaatgaagctcagaggtcacacagctagtaagaagccagcacccttcgatgtgggattgatgtggaggataggcatatacagagaacacaaaagcaaaacaccatggtgcagattttgaaagaaaagccctaagattagtaatgagtgtgaattattcaacaaagtgatcaaaactaactccagctctgcattcctcttcgccatcaggagtttggagcctggagactgctagctgcctggttctttaagaaccagccctggtccagcccattccgcaggccagcaagcttctgaaaagcaaacctaggaagtagctttccaacataaagtggaggtttcaacacaggagactttaagcaagttccagtgtgtctatatttggtctggctgatcggctggactctggccttccccgctcacgttagcagacagctctgccctagtgggcgcttagcctgcgacggcagcccgagaggatgtctaacaagcttctttctccccacccccattcagttgttctcaggtctgaattcaaaatggcctcatctcctgctgtccttcgagcgtcccggctgtaccaatggagcctgaagagttcggcgcagttcctggggtctccacagctgaggcaggttggtcagatcattagggttcctgctcggatggcggcgacgctgatcctggagcctgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacactcttggcgagctggacctggagcgcgcgcccgcgctgggcggcagcttcgcggggcttgagcccatggggctgctctgggccttggagcccgagaaacctttggtgcggctggtgaagcgcgacgtgcgaacgcccttggccgtggagctggaggtgctggatggccacgaccccgaccccgggcggctgctgtgccagacgcggcacgagcgctacttcctcccgcccggggtgcggcgcgagccggtgcgcgtgggccgggtgcgaggcacgctcttcctgccgccaggtgactcacctccgctaattgttccgtgttcgttcgcctttcactttgtgtgtctcccccgccccacgcttttcgcttatgtgtatgcccccccgccgcgcccccgggctatattgcccaggcaggtttcgaattcctggtctccagctatcttcccgcctctgcctccctaagagctgggattacagggtgagccaccgcgcccggcactttgaggggagttacactttttttttttttccgtccctgcccttttcacacgaagaagggatgtagcttccaaccttccggaggttagtgtaaagaaacaggaatggaatggaaagctgattggggaagtgtccctgccgctccaaaactgagaggtccctcaaacctagtgctcagttaaaagacattgtaagggccaggcgcagtggctcacgcttgtaatcccagcactttgggaagtctcggcgggcagatcacgagatcaaaagattgaggccatcctgactaacacggtgaaaccccgtctctactaaaaatacaaaacagtagctgggcgtagtagcgggcgcctgtagtcccagctactcgggaggctgaggcaggagaatggtgtgaacccgggaggcagagtttgtagtgagctgagatcgcgccactgcactccagcctgggcgacagagcgagactccgtctcaaaaaaaagacattgtaaggaaaggaaaaagacacttatattaaaaacaaaacaggccgggcgcggtggctaacgcctgtaatcctagcgctttgggaggccgaggccggcggatcacctgaggtcaggagttcgagaccagcctggccaacatggtgaaaccccatctctactaaaaatagaaaaattagccaggcgtggtggtgcatgcctgtagtcccaactacttaggaggttgaggcaggagaatcgctggaacccgggaggcagaggttgcagtgagctgagatcatgccattgcactccagcctgggggacaagagtgactctatcttaaaaaaaaaaaaaaaaaattcaggtagtttcaattttttaatgttcttatttatgtattgactaggaagccacttttttttttttttaaataagaattccgactggttttctcactgtatttccatggcagctaggaggtgccaggtggctgggcctgtgacagtgcagaggttttggtgcctgcccgcccaccattgctccagctgcagctgctgccccctgcagggcctgttcgttcctgctgcctagctccccgctggctggctatgatctccctgttaccattccaggagagcagccgcgtccctatgcatggcaggaccaggtactattgtggcctctcctcttggcctcgaatggtatctttgtcatcagtgagcaagtccccaaagaccacggtcttgtccattgtcaggataattcactccacaagctggggctccaggtgctgccctacccagcggtgcttctcacccacacagtggtcatactttggcaggggctggtgcagtgtgaagacctcggtgttttgcatgtgcttcatctcttgcaaggtcctccggggttgggcttcaagactagggaaaagcctgggcttcacacccgtgggccactttatccaccaggtccggcagcagggtgaggtactgcttccagaccaggaagctgcggtgctgctgcagtgtcacatgcagctccctgagaaggggcggctgaagccccgcaggaggccgtctggaagctgccagcacgcggtccctgtccatcagcacacgcgtgggctgtgctcatcgctgccggggcactggggtttctcgggatcctaggggtatggggcccagaaatgttctttaaaagtttctcatttttgcaacttttctttgaattcgcacagtatgttaagatttatgtaaattagcatttacaataggaaaacctcttcctgtcaaatggaaatttgaggttactggatacttttatattacataaagagcaatcagccagtgtaaaaatgaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagcaacatattcatctgctctgggcaacaatttgtcttaacttacaaagttaaatatgttattctacttgtacatgtgcaccaggaggcatattccttataagaggccagatgagcagtctggattaatttaaaaaaagagcaaagtcaactggaaacagtccaaatgtccatcaacaatagaacagattaataaattgaggtatatttccagcagtcaaagtgattgaactacagctacaagaatcaacatctatcaagatatacaaaagaaaagaaaaaaaaagaatcaacatggatgaatctccaaaccactgttgagtgaaacagtcaaaccctaggagaacacattcagtatcattccatttagatacaattcaaaaactaggcaaaataaaatattaaggtacataatctaagtggtaatactatgaagaaaaccaagagtgatacacagaaagtccaggatactggaaagagaggaaagggcacaggggtctgtgggacgttgatggtttgcgggtatcagcactgaactatgtcttaaaagtgttgcctgtaaggtgtttgcattttttttttttttttttttttttttgagacagtgtctcgctctttcgcccaggctggagtagtggcacaatcttggctcactgcaacctccacctcccgggttcaagcgattctcctccctcagcctcccgagtagctgggattacaggtggccgccaccacacccagctaatttttgtatttttagtacagatggggtttcaccatgttggccaggctggtctcgaactcctgacctcaggtgatccacccgtctcagcctcccaaagtgctggggttacaggcgtgagccaccggacccagcctgcattattactatttaattttgtgtgaaacacaaaacctttaatgtaaatgataaaaatatcagtaagtggagtcattcagaatgagtagccttttgagtctgtctccgttgagtaagtgcattctgttgagtgcactggagaggaatttgtgctcttctatgtagcagtctttctttttgtttcttggtggtgcaccattaaatggattcattcaccagttaaaggacatttgggttgtttccagtctttggctacaacgagtaaagtcactataaacacttgccagaggtttctggacgaacaggttttcatttctcgtgggtagatacctaggagtgggattgctgggtcacatgtgtggtaagtatatgtttaacttaaaccatccaactgtttcaggaatagcttagttttgcattttgttttgtttcttcccaagaacctgggccctttcctgggattgtggacatgttcggaactggaggtggcctgctggagtatcgggctagtctgctggctgggaagggttttgctgtgatggctctggcttattataactatgaagacctccccaagaccatggagacgctccatctggagtactttgaagaagccatgaactacttgctcagtcatcccgaggttagttcttctttcagatttatgggctatgatgtatcaggtctcttcttaaatggtctgggttttcacagaagttagctcattcatgacagccattccctaccccaacacacactaccttttttagtcacttcttatagacagtttctttttttgagatggagtctcactctgttgccaggctggagtccagtggtgcgatcttggctcactgcaacctccacctcccaagttcaagtgattcttgtgccccaccctcccgagtagttgggattacaggcacctgccaccatgcttggctaatttttgtatttttagtggaggcggggtttcacaatattggtcaggctggtcttgaactcctgacctcaaatgatccacctgctttgacctacccaagtgctggattacaggcatgagccactatgcccagcctaatatttgtatttttttttttttaagtagagatggggtttcgccatgttggccaggctggtctcaaactcctgacctcaagtgatctgcccaccttggcctcccagagtgctggaattacaggcatgagccaccacacctggcctcttatagacagtttctattcaattctatattactatatttcctgctagtaaagagattcgtagttgttattatgcaattttaaattccagtatttttttttttttttttttgagatggagtcttgctgtgtcacccaggctggagtgcaatggcatgatctcggctcactgcaaactccacctcccaggttcaattgattcttctgcctcagcctcccacgtagctgtgactacaggcacgtgccactactgcccggctaattcttgtatttttagtagagatgtttcaccatgttggccagactgatctcaaactcctgacctcaaatgatccacccgcctcagcctcccaaactgttgggattacaggcgtcagccaccactcccggccatgagatgatgtacttgttgatgatgactcagtttagttatgacagtgggaatgggtggctcaggtgggagacagaaaaagatcatgggagatacgagattaaggaactgagaaaccagagaataattgatagatcttccacatggttatcaccaagagtggtgatggacaaattgtggaaaggaagagatagaggggaggtaaattctcaaagttgcaaatctgggtaaatggtagaacctagattcagactcaggttcaactaacttccagggtggacacaactcaccatattccactgtttgtggaatcattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacactacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtat

SEQ ID NO: 117 - DNA, 57771 bp, Homo sapiens
ccccataaaaaaatccctcagtgtcttctctaacccttcttatactccttgtgagttttagagccacctaaactcttcttttttcccaatacatggagacaaaatttacataacatacagttagccattttcaagtatacagttccctgccatttggtacattcacagtgttttgcaagcaacacccatatcaagccccaaaacattttcattacccaggaaggaaacctgtcgtcatggaaccgtcactcctcacatccccttcccctcaaaccctggcaaccccaaaccgttcttgacagcctcctttggcatttcctcattttggtgtcagatctcacagcagaatttcttacctattatatccagtgcctcagtgtgaagttccggtttaacttcttgttaccacgagcccactatcttgccccaataataccctcccccaattcacaaacacacaagcattccctcctacagctttgggcctcctatctgagtccttcaggaaagaagtgcttgtaactcccttggcagtgagtgtagacttggtccaaggaagatgagcaccagtcagggcagctggtccctcttctctccctggccatcagcaaatcagcactgcccatcgatgcccaggcaatgggagcgtcgaccagcagaggacacacctgaatttctctgcctcatgggagggtggctgctgtgttgcatttaggaagaagctgtgcaagattcatactgttttgctaatgttaatcttgtgggcataataaacgtcgtacccacacttatttttctagatcagacaagattgggtgtgttcagggtggtatggccatagaccccacacttttttttttttttgagacggagtttcgctctcgcccaggctggagtgcagaggtgcaatctcgactcacagcaacctccgcctcccggattcaagccattctcctgcctcagcctccagagtagctgggattacaggcatgcgccaccacgcctggctaattttgtatttttagtagagatggggtttctccatgttggtcaggccggtctcgagctccggacctcaggtgatccgcctgcctcggcctcacaaagtggtgggattacaggcgtgagccaccgcgcctggccgaccccacacttagttttaatacacttctaggcaaggctgctgcactggtctggggatcacactttgagtagcaaaggactaaattgcaataactgccggggggggagaaaaaaaacaggatgaactgcttcctcctggctcagcagctagggagtcactgaactaacaaggggatggggtggggataagaatgttccaggcaaaaggaacaacatgcccaaaggcctcaagcagaaagagagcttcaggtattgaagaagtagaagtagctctgtgtggctggggagtgggcataagatggagcagaagaatgccaagtcctattcctgggtctgaatttccaggagcagaagccctgtcccctctagaaggtggatatagtctggatatttgtcttcaaatctcatgttgaaatgtgacccccagtgttagaggttggacctagtaggaggtgtttagatcataagaactggatccctcctgagtggtttggtgccctccctatgattgattgctctattagttcatgtgagagctggttgtttaaaaaagcgtggcatctctctggttccctctcttgccatgtgacacaactgctcccccttcacccttccccatgagtaaaagcttcctgagaccctcaccagaggcacatgccagcagtgtgattcttgtacagcctgaaaaactgtgagtcaaataaacctctttacattataaattacccagtctcagatatttctttatagcaatgcaaaatagactatcacagaaagttggtacggaggtgtagggcgttgctataaagatatccgaaaatgtggaagtggctttggaactgggtatgaggcagcggttggaaagagtctggagggcccagaagacagatgagaaaaggtttggaccttcttagagatttgtaatgtcgttgtaaccaaaatgtggacagaaatatgtacagtaaaggccagcctgatgaggtctcagatggaaatgaggaagttatggggaactggagcaaagatcacccttgttatgccctagcaaagaacttggctgcattgtatctatgtcctagggctttgtggaaggctgaacttaagagtaatgacttagggtatctggtagaagaaatgtctaagcagcaaagcattcaagaaatggcctggctgcttctaatagcctatgatcagatattggagcaaaggactgacttaaatttggaactattaaatcaaactaaaatctggcctgagaaagcctcctcactcccatacttgagtccttaaggatgaaccataacctaactttgtaggtaggacgactgaaaacctaacttagaaggatgcttctgtagcaataactgagcctcagccaatctcagcagccatacttcagtactcacaggcagcctattgttcaaaccatgttcaaataaggcaaacaccatgctgtaaccaatttggctatttctgtacctcactttggttttctgcatgtcactttcctttttctattcataaggttttttccgaccacatagcatctctggtgttgctctgaatctgctgtgattctagggactgcctgatttgtgaattgtctttttttttttctcctcaattaaattctgttaaatttagtttgtctaaggtttttcttttaccagatctggtgttggaagtgcagtttgaagtaaaactctggtgacctacaggaacaccaggtgaccaggccagttgtgctcactgatcttttgattgtaactggaggttgtagatgggttttctcttggattcagagttccactaatttgtgttctaattggagctctccaagtttatttgagcaatatttaagtggactgggttcaggatcaaatttgaatcaattaactggattgggttctgttagagcctcagacctctactaggcactttttttttttttttttttttgataatgggtttgtctcaatccaaggattctaggaatctaccttctgggactccatctaattttgtatataaaattttaggcccagaatgtgtgcatctttagaaaaacagattaaccttactagagaaaagatggccacaatggggaagttttaatttgtataaaattgtttatttgcaaggcatattagaaaaagggggatcaaaaccccacaaaaacattgggatatagtctttcattggtacatggaagcctctaaaagactaaacgaatgaaaaattccctccttaaaagatactttgcaaaagcaaatgaacagtttaagcaacaggctaaggacatgatgaaagagaactgtactctcactgaactaaccccaactgattcttctctttatccatctctacctacgtactctgagtctactaacctttttgctagatcaacctttcactctgaagatgatgaaaaaggaggaattagatgtacgcctcacaaaggaagaccttctgattatccaggcctgcctgctataaccactttcactccatggtctaaaactgagcttagagctattttagaagacttccctgatctaagagaaaatcctcaaaacttgactaaggagtttagactcctcataggagactatgatccaggactccctgacaaaggttcatatgacaatttattcatatgatatggaggcctggtgaagctcaaaaatggatggcagcagcagaatggaagaaacctgagaaagatattaaaacccccccccccgcaccccccccccgcaccccccccccccacacacacacacacaaagcctcctcatgagaaggcccaacaggagctagaaatattgctgaaaatcccagcctgggcaacatggcaaaagcctgtctatacgaaaaatacagatagttagctgggcatgatggcacatgcctgtagacccagctacttatgaggctgaagtgggaggatcacctgagcctgggagcttgaggctactgtgagccatgactgtgccactgcactccagcctggatagcagagcaagaccctgtctcaaaaaaaaaaaaaaaaaaaggaaaaaaaattgctgaaaatcttttaaattcaaatactaaattttttccacaaaagttgattggtacatcatacaatcttgtaaaccaaaaaaaaaaaaaaagaatgaaccagtgtcagattacagaacttgcttagaaataatgtgaaacattctgggcttaaagtactaacaaggagtatttcctgcagggactgaaatggtattaactactctatttataaatggacttcatcctgaacttagaaatttaattagaaaacgtaaactcggatgggaagttacagccatgactgaattggtggctctagctgaacattttgagaggactgtagagcaagaaaaaacccaaaaggctaacaagcttatgactcttcaattacaacagttacaggggccaagaccaaagggatcttctcattctcattttaaatcacaaccaagaggtattagaccaagaaattcttcaccctaagatgtctgccttattgcaaacaaccaggacagtggaatagggattgtgcccttttatatcagcccaccaatgaccctccctttaggccagcctgtttcaccactagagggagcacaagagaccttagctctcctgaagataatcagcattgaagcggctctgagggatttcacagtatattgctcctcataatacccttaaaagaatatggagaaacagaggttacagtaactggggactcatgtatagtcttggtggataccagagctaccttatctgccactaccataaaacacactttcataagccaacagatccctcagagttaaaaaggctatttctgtggttggggtttcaaatcaaattcaagagtttcccatatctgaacccgtccaattgactttggggcatttttcaaaaaatcacactgttgtactatgtgatagtgctccagtaaatttgctagagggagatttactttcaaagctgaaagggcatagaagactacctattgggtacattgtaaactgcttgggaaatgggcacactaaaatctcagaaatcagcagtaaagaacttgtccatgtaaccaaaaaccacctgtactcccaaaactattgaaattttttaaaataaaaaatttttaaaagtggggagggtgtaaaattttccttggaataagaatcagtttcctgattctcctgaaccagaattgttatgttctctataggcagatattaataggatcgaaactcaggcctgtaatgcctgatcttccaaaaatacctaaatatttatgggcctcttcctcaactgatacaggaagaatttaaagtgtgtcacctattaacctccaaatagaccactctaaacttttgcctaaagtacccaatatccactaaaactagaagcaattcaagggctcttgccaattgtaaaagatttcattagacagggacttataattctatgcaccagcccttataaccctccaatcctactggttaaaataaaccaaatggatgaggttgaagatttgttcaagatttatgggcagttaacaaaattgtagtagcaaggtttcctatagttccaaatcctaatacttcattatccaagatacatgctgattcttaagtggttcacaatattagttctctgctcagcctttttttacaatccagtttataaggagagtctatgcttatttgccttcacttggaaaagtcaacagtacccccagattgtgatgctgcaagggtttaccgaagcctctttgtgttttcccaggcattgcatcaggacttaatgacattatagtttcctcaaaattctactctcattcagtacgtggatgacttactgtatgctctcccactaaagagtactctgaaatggactcagtttaccttttacacaactcacacatcaaggtcacaaagcttcagtagaaaaacttcagttttcaaggggaaaaagtccattatttgggacattatttgatggtgtttccctctcacctaaaaagttaaaaactcttcaaaattttccttggcctgcaaccaaaagataattaagaggttttcttggacttgcaggatattttcttggacttgcaggatattttcttggacttgcaggatattttcttggacttgcaggatatattcttacacttgcaggatataaaattcctgggttctgaatttttccttaatagcctcaccgttgtatgagctcactaaaaaatgctgtaccagagcctttaccttgggatgatagtcatgagcaagcttttagctaaataaaattggccttataacagcctccagctttaggacttccaaattgcactaaactgtttacctaattggcttatgaaagtaataatcaggcatttaggagttcttacccaggaacatggggagaaacataggcccattgcatattatagcctgcaattagacccagtagctaaggtatatcctaactgtttaaaagcagtagcagcagcaaccaggctgaaagaagcttcagctgatgtggttttaggaaatgaacttaatatggaagtcccacatgctaaattccacccaaacccagcattttttagtaagtagactaacatcttatgaaatgctctgtctccctctaatctctatctaaaacactgcaatttacttaaccatgcccctgtattactgctgcctgatgatggtgaagaccacaattgcataagtgtagcatcagaaatagtggcccctcatgttgatttacaagttagtccattggacaatcctgagctaatacttttgttgatgggtcctatgccaaaagctcagaaggaaaatatcagctaggatatgctgttaccaaaatgagttaatagagaagggaatccttcctctattagtcagctctattagtctaagctctataagtcagcttaaccctcgaagatttttgccctcacccgagcttgtcatatagctaaagacaaaccggtaagtgtttagacagatagtagatacgctttaggagtagtacatgattttggcatgatagggaaactctaagggtttctcacttctagtgggatcaccatcaaaaaaggactccaattagataaaccactagattgctgttattgatcgaagctcatacctgcagaactgaacctgaatatcaagggaatgcttagcagatatttatgctaaatcagctagtactgaaactgttcagatatgcaacatgaacgaacttcgtaagattaatccaagccaactaccttacaatgacctatttaataaagaatgcaatgcacctcatttggaaaaacaaaactggtatctaaaaggatataaattcaatgttaagtgcaaacttgcagagggcctagatggctgcctggtctttcccgagtctttgaagcttccattgtcaaaagctttgaactccacaactcatcatggaacagaaaaattcatccaagttgtgaaaaaatacttgtgggatgactgttccaaaattgctagaatatttttttttttttgagatggggtctcactctgtcacccagggtggagtgcagtcgtgcgatcgtggctcactgcaccctccaccttcctggttcaagtgattctcctgcctcagtctcccgagtagctgggactacaggtatatgccaccacgcctggctaattttttttatttttagtagatatggggtttcaccatgttagccaggatggtctcgatctcctgacctcatgatccacctgcctcggcctcccaaagtgctgggattacaggtatgagccactgcacccagcctgctagaatattttataaccaatgttggctagtcaaacccatagtcctggaaaaacgaaagattcaggtggtgtattgtattttcaacacctaatggaccatttgaacaattatacatggacttcattcagttgccaccttcaatgtgggtctcagtatgttcttgtaatagtttccatgttttctggttggttagaggccttcctgtgtaggaaagctgatgctgtgacagtagctaagaaaatattagaaaatgtgttttctttatggagcatccctggaaaaatccccagcaatgggggaattcattttattaggcaagttataaagcagttaaacaaggttttatggacacaatggtactaccattatccctagcacactcagtcttctgaaaaggttgaaaaaacaaatgacatattaaaactgaaattggcaaagttaactgaatcagttgggttgccttggccaaaggtactatcattggatttaatggcagtcagatccactcactaaaaaacagaagtggaccccttatgaaatagtcactagaaggcctatgccccagtagtaaaacctcttgcatctttctctctctgaaattctgatataagtaagtactgcaaggccattataccaagtgtgctttcaccagataaaggaagcttttcaagatccaccaattgaggataatcaaaccttccacagtctagaacctggagattctgtcttctggaaatgacatcagaggaaggctgctcttgacaactctttggaagggactgtgccgagttcttctcaacacctacactgcagtgaagcttcagggccttgaaacttgggtccacacctcacaactcaaaaggacctcttcagactcctggaactgtacatctgctagagactttaaggtaaagctgtctaaggaaaaatctccagagcagatgacattctagttgtggacagctttcccaagatcacagatgaagacttctgtatcatcatgaaagccttacatttttttcttttctcctcatttcctgttgccctaattctttctttttccctacagaaaaatccatgggaccataaccagtggatgcctttagcttgagcatctgctgtagcacagaaccagagtttgtggattattgggtttgttgtttattgccaaaaaaatataaggaaacaattccactaatgccagtgcctctccatgttcccaatgagagtcaccccaaaattccaagggaaggatggaaagctatccttgatattctgaacaccactgctacttgctttcctgcactcactaaaaagaacactttaacttttcctttttttttttttttctttttttgagacagtctcactctgttgccaaggttggagtgcagtggcctgatcttggctcactgcagcctccacctcccaggttcaagggattctcctgcctcagccacccaagtagctgggactacaggcgtgcaccaccgcatccagctgatttttgaattttttgtagagacagggttttgctatgctggccaggcttgtcttgaacctcctggcctcaagtgatctgccagccttggtttcccaaagttctgggattacaggcgtgagccaccacaccctgccttaactgtttcaattaataacctgatcattaccaaagtatagaaaaccaatccaagtgatgactgcaaaagatatattgtgctttcaggcatcatgtactcaagatttgggatttacctatgtgagtacaagtaattgcttgtataatgtcaccagattaaattcaacagggtctctttttaccaaatgttttatatacccttacaacatgctataagaggggcacaaaaaggtcaatttctcaatggattttgttcagcagctatgcagatttattaatgaacaaatctaactgaaccctgctcaaatgcaactaggtagccctgtttttcaactcccaaggacctattttgggtctgtggataatctgcatatttcattctgcctcttcgttggctcagatcttgctatttggtctggctcactcctgcctttcaaatagtttcacctaaaaattctcctaacagctcttatgattggaggccaaaatagtcaataactgaaattagcactagctttgaaatagacaaagataagctagtttccactgaggaaagattccagtggggttcctgggggctcactcttggtggtagtgggatactagttgtatggaatccaaagctaatccatatgtggggtcttggattttatagccaatcaaacatcccagtgtttcagacaggtagacactactctccaaaaggtagatgtggcctggtgcaatggctcatgcctgtaatcccagcactttgggaggccaaggcaggtggatcgcctgaggtcaggagttcgagaccagcctgcccaccatggtgaaaccctgtctctactaagtacaaaaaattagccaggcatggtggcacgtgcctgtagtcccagctacttgggaggctgaggcaggagaattgcttgaacccaggagtcacaggttgcagtgagctgagatcaccccactgcactccagcctgggtgacagagcaagaccctgtctcaagaaaaaaaaaaaaaaaaaaaaacaagaggtagatgttacagttaatggaacatcatacagcttcatatctcctttttactcaagctggggcctgtgtttggtgttgaacaaaatagaatgctgcagttatctctctcctgattttgttactacagaaagcttaatgtaaaggtggctgatactgctgtttccttagacactgacaccaaatacaataaagaagtctctcaagaggaaaacatggtgtgtttacaggagcaactaacagttggtttgtaggcatcctaaatggtggatggcaagcttgggtttcccaaaggtttctagtctttatatgtcttctagtaggtgtccaggttagtatggcttgtgttaccagagcaacaatgaaaatggctacatctttaaatcaggccactttacagtgaactatgatccttaattgctaccacatttcaaacaagaactatgaccaattaaactttactgttgttgaactgcctatgttgcctgaactttgactggtttaagttggtttcatttatttaataagaacacttgttaaggagtgcatcttggtattttgatattattctcttgatagtcataataatagttccctagtgtgctgcatcctctcaagtcttaaatgttttgtatgcagccatacattgagaattgaatggtctcactttgactaggtcagcaagaacatagagaatcattcacctagtgtgaagctgtgacttgtgaacttcatagtgacaccagtaaagacttgtgaactggctgggcatggttgctcacgcctgtaatcccacacttttagaggccaaggcgggcggatcatgaggtcaggagatcaagaccatcctggctaacatggtgaaaccccgtctctactaaaaatatacagaaaaattagctgagcgtggtgatgggcacctgtagtcccagctacttgggaggctgaggcaggagaatggcgtgaacccaggaggcggagctacagtaagccaagatcatgccactgcactccagcctggtgacaaagcgagactttgactcagaaaaaaaaaaaaaaaaaagacttgtgaactccatactgagactaaaaagacttgtgaattccatactgagccaaattacaatagtgagagggtggcatcaatgcctaaagtttcggtctatctctctaaattgagagtctgaccaaaaggggggagttgataaatgaaactcaaatctggcctgaggacgccttcacattcccatatttgagttcttaagggcgaaccgtaacgtagttagtaggtaggcagactgaaaacttaacttaggaggatgcttctttagcaatagctgagtctcagccaatcccactggccatatttcaaccactcacaggcagccaactattcgaatcatgctcagataaggtaaacaccaagctgtaaacaatctggctgtttctgtacctcacttccattttctgtatgtcactttcctttttctgtccacaaatttgctttgacagcacagcatccctggtgtctgtctgtatctgctgtgattctgagggctgcccgatttgcaaattattcatttttcttgctcagttaaactctgtgaaatgtaatttgtctaatggatttcttttaacagcacttataattaaaatggaaagagggtgtaaatatttagaaaacttgcagcctggccatgtgatagacaaggaggaatccaagcagcctgctgagcaactatttgctagagacattagcatatctaaaagggagccaggtgctaatattcaagacagtgggaaaaggcctcagaggcatttcagaaggcctctcctatcacaggcccacaggcctaggaggactgaatggtttcagagaccaggcccagggcaccattgctgtatgtcacctcaggatgctacttcccacatcctagcttctccagctccagctttggctcaaagggcccccggtgcagctcagaccacttctttggagggtacaagccctaagccttgggagcttccatatggttgtttttttttctttttttgagacaatcttgccatgtcacccagtctggaatgtaacggtgcgatcttgactcactgcaacctctgactccagggttcaagcgattctgctgcctcagtatcccaagtatctgggattgcaggcatgcaccatcatgcccagctaattttgtatttttagtagagatggggtttcacagtgttggtcaggctggtctgcaactcctgacctcaggtgatccacgtgtgtcagcctcccagagtactggaattacatgtgtgagccaccatgcccagccttccatatggttttaggtctgcaggcttgcagaacgcaagagtgaaggaggcttgggagcttccacctagatttcagaggatgtatcaaaaagtctgggtgccctgacagaagcctgccacaggggcagaaacccacagagaacctctacaaggacagagccatgggaaaacatagggttggaaccccatacagagtccccactgggacattgcctagtggagctgtgggaatggggccaatgccctccagacagcagaaaggtagagtcaccagcagcttgcaacctcagcgtggaagacccacaggcattcaatcccaacctgtgagagcagccatgtgggctgcacccagcaaagccatagagacagggctgctcaaggccttgaaaggccactccactcaccagtatggagttacggaagatgattttggaagtttcagatttagtgtttgccctgctgggtttcagacatgtgtggggcctcttgcctctttcttttggccaacttctcccttttggaatgggaatgcctacccaatacctgtaacacaattatatcttggaagtatgtaacttgtttttgatataacagcctcataggtggaaggaatttgccttgaggctcagatgaaactatggattctggacttctgagttgatgctggaacaagctgagacattggagaactatcaggaagggatggtttcattttgcaatgtgagatgacatgagatttgggggtaaggggcagaccaatatagtttagatgtttgttctctccaaatcatatgttgaaatatgacccccaatgttagaggtggggcatagtgggaggtgtttcgctcataggggtggattcctcatgaatgggttggtgctttgtccatgataatgaatgagttctggctctattagttcacatgtaagctggttgtttgaaagcacctagcatctctcttgtgtgctgtctcgccatgtgacacatctgctcccccttcagcttccaacatgagtaaaagattcctgaggccctcaccagaagcagatgcctgcactgtgctttttgtacagcctgcaaaaccatgaaccaaatacacctcttttccttataaattacccagtctcaggtattctgttatgatcccctggaagagttatactacttccaggtctagcccatggtaaatcccacactcccctctgaggccaccttcttccctctgcagagaccctggagttagagtggattggttgtgtctctggccccaattcttctcccgaggctgcattccacccttttgctatgtgactttgcagcccttctcactgcagagacaggttcctctccttgagtttggggaagatgcaacacatgcaggggtttgaaaacacatttgtttgtttctgcttttgtttttgctcctctgcaatttccttgaaaccatgcctgaggtagcctgtgggaaaacgaaacagcaccattgacctagtctttcagccaatcccactgcatttgtacaatgcagtctgacaccagaggaactgcccagccaagctcaggcaaaattgctgacttcagactcatgaactaaataaatatttgtttcatttggtggttgttcttatgcaacattatgctggcactagaaaaatgaaacagatgggaatcaaaaagactgaatgaagcagaaacccagaagctaccccacaagcaatcacatgggactcagatgtgaatggacaataagcttttattgcattgaaaggtcattgcagtgaaaggttggggattgcttgctgctacagctgaatggattctattctgaccaatacacacagaaagagatcacagactccctaccttagaagaagggaggtggtagatgaaatgaactgtatgaagagccactagcctggcccacacacagaagaaggactggcccgtcttcttgaagcccatgctctggtagagggccatagcagagagctggatggtgccggtgtccaggataacttcactgtagccctggtcccgggcaaactggaggacagtcctgaccagggcttttgctatcccctgacgacggtgctcactgtccacaaagagatgaaacagctgcaaccgcttctccctcaaggtgggatcatcaacaggcagagctcctaccatgcccaccaccttctcttcagactcagccacccagaagcaggagccacgctcactcaggtaggatttggtaatgtcagacatgtctgtgcacaatgtcatgtccacatactccgtccagggttttttggcaaggaaccacagggcagggaagaggctgatgctgaacacgagggctagaagccaggatccagagaccaggagtagggcgaggggccccccaagtaagagtatgagggttcgaggcagcttcagcaattgccggaaggtggctggggcatgctcggccatcccccgggagagcaagcccacaacccactggcggtcgctctcctggtatttgcggatgtgacaaggagccatggacagacttctgtgtctgaaatctctaagtccaggagacagagctaggcctccctgcacgcctttacgtcagactggggaagagagagaaaatcatgtgagtgcctgcatggctcccagccttgcaggaacagggagacctgctcaagggtgtgtctttccgcgtttgcccatgaggaagcaggcctctgccactgggagaaggtagggtcagaaagacctgcattggaatctggttccatccctttctagctgtgtgaccttaggcatgtcacttaacctctctgagcctccatttcttcaactatagaacaggggagaagaaaacctgccttctagagttgttttgaagattgaataagatgccttctataaagccctggtagatgaactacccaccgctcttcctttttctgtttcctttttctggctctctcagcttctccgtgcattgagggggcacctacctcaggcaggccacacgtgcaacccttttgtccttctccagggaccatacatcgcaaaaattctctgtccaacacaagtttcaggaaaggctccctccagctttattgtaagtttttaggttgctgaagtggcataagagccaagcataaaaaacagcccagcctccagatcccaaggaaggtgcatgctcagagcactgtccttccacccagtcccctcacctgtcaccacaagagccttgagtgtccagggagcttcagctctcagccgctcactggcatccaggagataccgtctggggcttgctcacccctggaaagtagactgcctgccttattgcttggctcctgaatgtttggtaatcatcaaccctagggtcaaagagctgggctgtaacacagcagggagcccagtgtgcattcctctttgtggtcaaagggaacgacctggagggggagactcagggtctggaaccgcctgggttccttgcccttctggaaggcctgccacctctcttgcctgttcaggccccgtgcatctctctgccacctggcacacttagtactctcggtccctgtccacatatacgatccaccctggtccttgtacacatatacgacgagcctgagaactgtaccattcaccctgcaatcagtcaccattggccagaagccgagtccccatgcttggcaacaaggcccttcccagctaggcttctcctcgctgaggtttccctggtccacgaagcatctgttgttggcagttccttgcactcacctcaccaacccccatctccacccattcattgattcagtcaacagttgtgtgtcatgcacttcctgtgtcctggggtcatttcagccatgagcaaggttgacattcggcttgacaggcatggctgtgtgtggcttgtgtgtgttctggctgttggtcagaggctgtgccacacccgttgttaaatattttgcactgcagatgttggggaggcccaaattcatgctcttgtacccgacgtggagctgatcccaaacactgacacatgggtgcttggagatagagaaagttgtattcgatttggccaaagcaagaaggcaggagagcaagatctctcaacttcagttcaacaaagaagcagcagcagaatgtttttatgcagctagagagtgaggaagggggagttcagggggattgagaggaaaagtctgtgtttcctcagtctgagataacaccttgtgcaaccaggcttctcagtgtcagcagctggtcacagtgtccttcaaggcattcattcattctgcaaacttttcctgaccctgaaggaatgtcttcctgctgaacaaagaaacagtacatgagcagtttatcattatgttgtgggaacaaggaatattggaccaaaagcaagtggttaacatgtgcaagccagcaacggtctgatcagaatgttcattatttcagtcactaaaacatggtgtggtgctgaaatctcaaggggcccaattacaaggatgcaacatatacaagataggcaaaagcaaaacctaacagaaaaagcccttttccacaccaacttacatgctattgaagggaaacttcccttccaaagattagctaacctattgatgatcagccacgctgggcccgtcatctaggttaggtagtttggactctattccaagagcaaggggaggacattgatatgcacggaggggaggaggtgtgtgtgtgtgtgtgtgtgcgcacgcaagcatcactctggctgcaggtggacaatggatctgaggaggtaggaatggaagcagctacccctcaaggctcatgccacatccaggcaagagcggggcctccagtacagggatgcaggtgctcactgtacaagagcagctggcccagaggctctggtgggagctaaaactgggcctccctctggttgccaagccatgagccatggcacgaaactgagactggccaaaggaaaaggcaaccttttcttatttgctcaaaggcgttgcttgcctgctaaactctgcatccagtgggctgcatggcttgaggctgtgcctagctctgggttcacaaagaagccgcctgggttagcagaggcccatgagacagcagtggcttcaccagagggaggaagtcaagaaggtgagacatgagccgtatggaggtgcatttggggcagaaatggcaggagttggaatgattcacacagggaggaggatgaggaagggctcagagacgacagccaggcttctggtaggggcattcaggaaaacactggagagagcccagatctggaaaagtcaaggcttcccctaaaggtgctgccctgcagccttcttcagcagaaaccagaagctgggagtcagcagcaggaacccagggccagccagtggaggctgctgagattccagatctttggtacccaacaccacctccgaggaaaagtctaaggagcatcaagtctgggcaggaagtccatggctcatctttagagtgttctcgcaacatttcagtgtcaagcaggagttggcctaggaatcaaaagaggtgagcggtggctccaaagcaccactgagtacttctagtgtgagtctaaccaatattcagtcagaaacctgccggtcacgtggagggggagaggtttgtgctccgtccctgtgtgctgtctctccctccatgctcacccgtggctgtggcttcctcaaaacacagcgacctcacttgacattcaggcgtctcttgctcccaggatttactgtgacttctgcatttttgtagctttcctgataaaagcctgggctttccttgtcggacctgaaagattcatttattcattcaacaaacagtggccgaaggcttgttatgtgctgtgcctggacttggcatgaaggcaccagatgtcagaagcgaggctgctgcccaggaggacacacctgatggggctctgggaccaggacgatggtggagacatcacatccggaataactttgttaggaaggtgaacttgacagttaggacttagttctccttgaagacgtccttcacatcccttgtgagttggattcctaggtattttattctctttgaagcaattgtgaatgggagttcactcatgatttggctctctgtcttttattggtgtacttgtgatttttgcacattgattttgtatcctgagactttgctgaatttgcttgtcagcttaacgagatttttgggctgggatgatggagtttcttttgtgggcatttagtgctataaatttccctctacacactgctttaaatgtgtcccagagattctggtctttgttctcattggtttcaaagaacatctttatttctgccttcatttcattatgtacccagtagtcattcaggagcaggttcagtttccatgtagctgagtggttttgagtgagtttcttaatcctgagttctagtttgactgcaatgtggtctgagagacagtttgttgtaatttctgttcttttacatttgctgaggagtgctttacttccacctatgtggtcaattttggaataagtgcgatgtggtgctgagaagaatgtatattctgttgatttggggtggagacttctgtagatgtctattaggtctgcttggtgcagagctgagttcaattcctggatagccttgttaactttctgtctcgttgatctgtctaaagttgacagtggggtgttaaagtctcccattattattgtggtgggagtttaagtctctttgtaggtctctaaggacttgctttatgaatctgggtgctcctgtattgggtgcatatgtatttaggatagtgagctcttcttgttgaattgatccctttacctttatgtaatggccttctttgtctcttttgatctttgttggtttaaagtctgttttatcagagactaggattgcaacccctgcctttttttgttttccatttgcttggtagatcttcctccatccctttgttttgagcctgtgtgtgtctctgcacgtgtaatgggtctcctgatggtcacactgatgggtcttgactctttatccaatttgccagtctgtgtcttttaattggagcattcagcccatttacatttaaggttaatattgttatgtgtgaatttgatcctgtcattatgatgttagctggttattttgctcattagttgatgaagtttcttcctagcatcgacggtctttacaatttggcatgtttttgcagtggctggtaccggttgttcccttccaggtttagtgcttccttcaggagctcttgtagggcaggcatggtggtgacaaaatctctcagcatttgcttgtctgtaaagaattttatttctccttcacttacgaagcttagtttggctggatatgaaattctgggttgaaaattcttttctttaagaatgttgaatactggcccccactctcttctggattggagtttctgccaagagatcagctgttagtctgatgggcttccctttgtgggtaacccgacctttctctctggctgcccttaacattttgtccttcatttcaactttggtgaatctgacaattatgtgtcttggagttgctcttctcgaggagtatctttgtggcgttctctgtatttcctgaatttgaatgttggcctgccttgctaggttggggaagttctcctggataatatcctgcagagtattttccaacttggttccattctcctcatcactttcaggtacacaaattagatgtagatttggtcttttcacatagtctcatatttcttggaggctttgtttgtttctttttactcttttttctctaaacttctcttctcgcttcatttcattcatttgatcttcaatcactgataccctttcttccagttgatcgaattggctactgaggcttgtgcatttatcacatagttctcatgccatggttttcagctccatcaggtcatttaaggacttctctaccctggttattctagttagccattcgtctaatcttttttcaaactttttagcttctttgcgatgggtttgaactttctgctttagcttcgaaaagtttgattgtctgaagccttcttgtctcaactcgtcaaagtcattctctgtccagctttgttccgttgctggcaaggaggtgtgttcctttggagcgggagaggcgctctgattgttagaatttttagcttttctgctctggtttctccccatctttgtggttttatctacatttggtctttgatgatggtgatgtacagatggggttttggtgtggaggtcctttctgtttgttagttttccttctaacagtcaggaccctcagctgcaggtctgttggagtttgctggagctccactccagaccctgtttgtctgggtatcagcagcggaggctgcagaacagggaatattgctgaacagcaaatgttgctgcctgatcattcctctggaagctttgtctccgaggggtacccagccgtgcgaggtgtcagtctgcccctcctgggggatgcctcccagttagggtactcgggggtcagggacccacttgaggaggcagtctgtccattctcagatctcaaactccatgctgggagaaccactactctcttcaaagctgtcagacagggacatttaagtctgcagaggtttctgctgccttttgttcagctatgccctgcccccagtggtggagtctacagaggcaggcaggcctccttgagctgcggtaggctccacccagttcgtgcttcctggctgctttgtttacctactcaagcctcagcaatgatgggcgcccctctcccagcctcgctgccaccttgcagttcgatctcagactgctgtgctagcaaaaagcgaggcactgtgggcgtgggaccctccaagccaggcgcgggatataatctcctggtgtagtgtttgctaagaccattggaaaagcgcagtattggggtggaagtgatctgattttccaggtgctgtctgttacagcttcccttggctaggaaagggaattccctgaccccttgcacttcctgggtgaggcgatgccttgccctgcttcggctcatgctcagtgggctgcacccactgtcctgcacccactgtctgacaagtcccagtgagatgaacctggtacctcagttggaaatgcagaaatcacccgtcttctgcgtcgcttatgctgggaactgtagactggagctgttcctattcgctcatcttggaactgcccaacactccatccttatctataacccagcattcttctataccccatagaaagcaccccttacactcggacatgcacaggaaggaagctgctaattggagggaagactcactcacactgtccccaggctccactccaaaggtggccagtgcagctctttcacctccattacctccaagtggtgctgtcactcacagtaagcccagaagagcagtctgacctccacatagagccccctcatttccactcctcactgctggctgctggctccacggaccctctaaaaccacccttggtaagatcaccaggggtttcctaactgccaagtaccagtaatgctttatagtcctcaaacatgctgaacgctaagggagttcctgcattcataaagctgcttgcggtacctgggtgctatggtctgaatatgtcccccctaaactcctatgctgaaacctcatccccaaggtgatggtattcagaggtgggatcttgggaggtgattaggtcgtgaggatgaagtcttcacctatgggatcagtgcccttacagaaagacccaaaggagcttgtttgccccttccgccatatgaggatacacaaaaaccgccatttatgaggaacaggtcctcaccagacataaatctactggcactttgatcttggattcccagccttcagagctatgagaaataaatttctgtttacaagctaaatgtaaagtgtttaccagtttatgataattgtgttataacagaccgtatgaactaaggcactggagtcagtccaagagcttagatgtaagggaaataagatcagagcagagatgtgcaagagactggctcctagcagagcaactaagagtcaggcaaataatgtcaactgaggaggcttctgggtccagcagccacccagctgctttaacacatggctcttcatttcctatccccttctctcctggtctgtctttccctctttgatggttctttttcaagctttcattttgagtgttcctcaaatggaagttttcctcaaaacagaaaagttcatatttccttcctaataattaataggaaaaaaatgccaaatggatagaatggactccggataagaatggagaattttttaaagaagaagcaaatatggtttatgaatatattttaaaactgtgcaaaaaagaatatacaaaaaaactcactagaaatcaaataaataaaaatcaaattaatatccaggttttacctatcattgtaaagaattaaaagaatggtatgagctaatataggacaagcacaaagaaatgtgcagacacacacacttttgacggaatactgaaatgggagatccatgctggagaatcattacacagcatgtcaaaatcctttttttaaatcaaaacagagtctcgctccattgctcaggccagagcgcagtggcagagtcataactcactgtaacctcaagcttacaggttcaagtgagcctcggcccttgtcctcctctcaagtagctgggcctacaggcacccaccaccacatctggctaattaaaaaaaaagttttttttagagacggggtcctgctatattgcccaggctggtccctaatccttgggctcaagcagtcttcccacctcagcctcccaaagcactgagatttcaggagtgagccaccctgctcgacctcaaagtcctttgaaaagacttgatcgaaattcaacttctagggttagagctcaagaaagtaactggtcaaatgtgcaaagatgtttgcataaggatgtttatcactgtaaagtttattgtcatagaagcaaccgaaagtgcaacaagaggggactggctgaataaatcctgctctatttctgtagcacagtacctcacagccatgaccaatgctgatgagggtttactgacatgaaaaacattgcccaactatagcaccaagcaagaaaagattataaaacaatatgtttggatttatttttggaaaaatggtattgaaaaatgatatccacaaacaagcatgcagagagaaaagtctgagtggttccaccaaatgttggtagcagttacctctgaaaagaggaattgtgggggattctctgcataaaagataaactctgaaggtctttgcacattctaggcacttggccctgctttcagacagtgaaactgaatcttgggagtctaaagggactcagttatgattgtgagctcctaaaggtaagacccgtgttcggttttattttattatttcaattaatcctattaatgtgcacaattcagtggcatttagtacattcacaatattgtgcaacgaccacccctttcttgttccaaatcatttttatcaccgcaaaaggaaattccttattcattaagtggttcccccttatttccctctctccccagtccctggcaacctaatctgctttctgtctctatggatttatttattgtggatacttcatataaatggaattgtacaatatctgaccttttatgtgtggcttctttcagctgatgttttcaaaattcattcgtattgcatcatgcatcagtacttcattcctttttagggctcaataatattccatgtatgtttatactgcactttgtttatccattcattcattgatggacattaaggttgtttctacgttttggttattgtgaatggtgctgctgtgaacattcaggtacaagcagttatttgaatacctattatcaattctttcgatgtatacctaggagcaaaattgctggttcatattttaatcctgtttaacattttgaggaaatgccaaactgtcttccaaagtgtcagctgtagtttactttcccaccagcagtgaaccttattttactccactgcctgcctcagcactactgcctagaacataaagggaagaagcaatagctgtttttttaccaagaagttattagatgcccagcactgtgagaaagagggcttcccatgttgtgcaatttcatgttaacagccttggagctaaggttggtattattaacatccccatttggcaaatgggaaactgaggtccagaaacctgaggtttcctctccacggccccatatgggaagtgaaagctcaaacctaaggtagctctgactccaaagcctgcactgttttactttttcagtacagcatgctgaccctgcaggcagggatttgacaagtgtttagtgagtctgaaattcacataaagcctcacaagcccagagaagcagctctgtgtggaggcgcataagattcaccagtaaggccccatcacccccatcctgttgccagtggtcaggacacccttgaccaaattcccatatgtgactaaggctctgttccttcttcaagatccagtttagtgctacctgctccgtccacttctgaccacccaaccagatgaatctggtcccagtccctccctccttggaagcctttgcatttctcattaagcacttgtattgctgccatttgttgcttacttaataattaacttatcatagttaattagactagaaattaacagttcaactaccctgataaactattttgtctttctattgcctctatgaacctgattataataaatcattgtattgttggagtcactgttattcccagagctgtcaggtttcagagcagcgtgtcagtgccaccccatgcctgcatccgggaagatcactcctccactggaccagcccagcctggaaaggggccagtgaggcggaaggtggacaatccagggccaatacattctgggagtctcagaggaagagaaaaatcgattcagactcatttaacataggctcctggaaaggatatcatctcccccaatctctcatcaataacccaacatcagatcagtgccctggacttatcatatgaagcagaatgaaagtagacagataggtcatccttggttagatgtccagaaatccgaggatggtggtcctagctcttcagagaggacacgttctttaacctaaccttttaacaaattctctacagaagatatcaggtcccaacatttcaagtagcttcgtagatataggtaatcaaaggactaattatgaaagtgtagatgggtagaggggagcaacaaggatggcacaggaacccatagccctgaggaggagggagagttgttggaacctgaaaggacctgggcagagcaggctgcccttagagcaggcctggggccaaggcacaatcaataccaagcctgcctcacgctctcttccctccactcctcaacttgctgctggctttcagaaaagttaagaacttgccatttctacccctttgccattgttgttgtcttaccataaggcggggagcaatatagtatccagttttctagatatggaagtggaaatcaggtgtatatacccagtatattagtacctattagtattcttattggtattactttctagatgttatgtaactgtagctttggattttctatttaattcaaaagacatataagagttttttttttgctaattccatgttggatttattgtcactacttattaagttataattttaatgtattgtgattagagattgtactgtgttctatttgtgttttaaggatacatagagattttctttgtggctaaatataagtaatccatgggtgttttaaagaaggtagagtttccaaatagagtatgacattccagtcactgtcagattccacacaacatttcagtcagccacagaacatataaatgatagcagtcccatgagattaaaatagtatatttttcctacaccttttctttatgtagatattttagatacacaaatacttaccactgtgttaaaattacctacaatagtcagtagagtaacatgctgtacaggtttgtagcctaggagcaataggctataccttatagcctagatgtgtagtaggctgtaccatctaggtttgagtaagcatacgctgtgatgttcacacaacaatgaaatcacctaacaatgcatttcttaatatacatctattaaatcattttattaattaaattatattcttcctgaatattgattttcttaatctgtcgagaacttcaaagagtatattttaagttaattgaatatagcttttgttaattgaatggttttatatatatatatatatatatattttttttttttttttttttttttttttttgagaaggaatctgcctctgtcacccaggttggagggcagtggcgtgatctcgacttactgcaacctctgcctcctggattcaaacgattctcctgccacagcctcctgagtatcttggactataggtgtgcaccaccacacccggctaagttttgtatttttagtagagatggggtttcaccatgttggccaggatggtctcaaactcctgacctcaagcgttccacccacctcggcttcccaaagtgctgagattacaggcatgagccacagcacccggcctggttatatatatttttattttcggcacataaatattaatgacatgaatattaatgacacttttttcactgtgaatcataccataaatcatataaagtaacttttattttacattttgaatatgttttgccttttattctacttcatccaatacagttttattaaatgtggatttgtaccattgctctttgtccatccttttacttttggcttttctgagtcacttcactcaagtggaagtagcacctacttgaatttaacttttttcccccacccaatttgaaggtctttttttgaagtgagttcaacttaagttcattgttgtaacaaatatgtttggtttaaattttatcatttccctttttgtttttttttccttttctggtaaacttattaagttaatgtttgttaaactaaattccatttcaaacggtgggaaggagtaaaaaacacctaacataaagtttaccatcttaagcattcttaagtgtacaggtcagtaatgttaaatatattcacattgttgtgagacagatctccagaacatttgaatattgcaaacctgaaactctatacccattgaataacaacttcccttgtcctcctcccccagcttctggtaaccaccattctactttctgtctctgtgaatttgtcgataccaagtttggaagataagaaatatcttttaattcctgattttgtgtgataagagaaataaaatatctaccctttagtgactgactcatttcacttagcataagatccttaagattcatccatgttgtagcatgtgacaggatttcctccctttttaagtcaggataattttccgtgggttgtgtgtgccacatttatgtatccattcctcagtggatgggcatctgtgttgcttccacatttgcctattgtgagttgtgctgctgtgagcatgggtatgctgttagctttttaagtccctgcttactgtgcttttggagacatactcagaagagggattactgaatcaaatggtagttctaagtttcacctttggaggaatctcaatactgatttccagagcagttgtgccattttacattgccaccaacagcacacatgagacccattttatctacatcctcaccaatacttgttattttcttttttttttataatgaccgtcctagtgggtgtgaggtgatatttcattgttgttttgatttgcattgctctgatgattggcgatatagagcatcttttcacatgcttgttggccatttgtatatcaactttggagaaatgtctattcaattcctttgcccatttttggtcaggttattgattttgttgtcattgttgaattctgagagttatttgtgtattctgtatatcagaatcatgagttgcaaatattttctcccaatccgtaggttgtcttttactctgttgaatgcatcccctgaggcacaacttaagcctggtggtcccatttgtctatttttgcttttgttgcctgtgcttttggtgtcatattcaagaaagcactgccatattcaatgtcacaaagcctttcctctatgttttcttccaagactttgatagttttaggccttacacataggtctttaatccattttgagttaatttttttacataagactagagtccaacttcattcttttgcatgtgaatgtccaggtttccaagcatcatttgtgaaaaatctgttcttttcccattgagtggtcttggcacccttgtcaaaaatcattttggccagggacagtggctcacacctgtaatcccagcaatttgggaggccgaggtgggtggatcacctgaggtaaggagttcaagaccagcctggccaacatggtgaaaccctgtctctactaaaaatacaaaaaattagctgggtgtggtggcgcacatctgtagtcctagctactcaggaggctgagacaggagaatcacttgaacccaggaggcagaggttgcagagagccaagatcgtgccactgcactccagcctgggcgacagagcaagaccttgcctcaaaaaaaaaaaaaaaatcatttgaccatatgtgagagtttatttgtaggcactttatcatatttcgttggtctattcgtctgtctttatgctactatcacactattttgattattgcacctttggtaatatgtttgggttttcggttgttgttgattattttggtttgtttgttttttgtagagatggggtctcactgtgtttcccagtctgatatcaaatttctgggctcaagtgatcccccagtcttggtctccagaagtcctgagattacaggtctgagacgccgtgcccagccagtaatatgttttaaaatcaggaaatgtgagtcctccaacattgttgttctctttcaaaattgttttggctgttcaggatgtcttatgatttttactgatttcttgccatttccaatcttttttgttcattactatgtaatatatgcttcttattttattttatttttggagattgagtctcgctctgttacccaggctggagtacaggggcatgatcttggctcactgcaacctccacctcccgggttcaagctattctcttgcctcagcctcctgagtagctgggattacaggcatgtgccaccatgcccggctaatttttgtatttttagtagagatggggtttcaccatggtggtcaggctggtcttgaactcctgacctcgtgatctgcctgcctcagcctcccaaagtgctgggattacaggcgtgagccaccatgcccggccataatatatgtttctttgagctgtttttctgataacttagcggccatgtaatctaattaactaatatccttcaaccactttctcaatctatcactctcagacacgaaacagtatctgttgactctatcatatgaaaaattaagaaagtgactgcacttctccccacctgtgcccccacatacagacattcccccaactaaccaataatggttatattttgtggattttgtgtcagctcattgtagtagtattactacattgactagctttacttattcgtggattcttgtaggtttttaagattttatactatgcagccataaaaaatgatgagttcatgtcctttttagggacatggatgaaattggaaatcatcattctcagtaaactatcgcaagaacaagaaaccaaacaccgcatattctcactcataggtgggaattgaacaatgagatcacatggacacaggaaggggaatatcacactctggggactgttgtggggtggggggaggggggaggggtagcattgggagatatacctaatgctagatgacgagttagtgggtgcagcgcaccagcatggcacatgtatacatatgtaactaacctgcacaatgtgcacatgtaccctaaaacttaaagtataattaaaaaaaaattgaacaaaataaaaaaaaaagattttaagtctagttacttttctagggtatgtctcaatgtaggtcaagctctgtttttttattaattgagataaaattcacattccatacaattcttttttagtatataattcagcatgtttttgtatattcagaaagttatacatccttcacccctaattcctgaacatttttgtctccccaaaaagaaaccgtgtgcccattagcagttacctcccattacccttgttcttgcacccccgcctcgccctggcaaccactaatctactttctgtctctatgggtttgcctatatgagacattccacataaatggaattgtaaaatatgtggctttttgtatctagcttctttgacttaacatgatatttttaaggttgtagcgtatatcagtacttcattttttggtttgcagaataaaatccgttacgtggatttacaacattttatttatatattcatgaatggatggatacttgggttgtttgtacttttttactttcacaaataatgctgttataaattgttatagattgtgtacacgtttttgtgtggacataattttttcagttctcttggatatatacgtaggagtagaacagctgggtcatatggtaactctctgtttaacctttgagtaactccccaactgttttccaaagtggctgtgccgcgttatatttccaccaggatcatattagggtttcagtatttccacgtcctcgtcaataattgttattttctgatttttgattataaccatcctaatgagtgtgaagtgtcatctcattgtggttttgatttgcatttctctaatgactaataatgagaagcacctttttaagtgcctattagccatttgaatatcttctttgcagaaatttctattcagatcctatgctcatgtttaaattggcttatttttgttcttttattattgggttcgacgtgttctccatatattctgaacagcagtcccttattcactatgtaatttgaaaacatgtctcccattctttgggatgcttttcactttcgatggtatcatttgcagtacaaaatttttagttttgacaaagtccaatttatctacttttgtcatttgtgtttttcatgttgtgtttaaaactattgcctaacccaacatcacacacaaaaaaagtttacttctttgcttttttctaagagtattataattttagctcttaaattagggtctatgatcattttttagctaatttttgtatgtaatgtgaggcaggggatacagtttcattttttgcatatggatatccagttgaccccgcaccatttgttgcagagactattctttcttccattaaattgtctggggtcctttgccaaaaattaattgaccataaatgtaagagtttatttctagactcttaattctatttcattgatccatatgtctctgcaaatgccaccaccacaccgtcttgttgtggtgttcttgtggtaaattttgatgtgtgagtcctccaactttgtttttcttttataaaattgctttagctatttatgggttctgtgaactttaagatcagcttgccagtctctgaaaaaaaataaaaggcagcatgaatcttggtagggatgtcattgaatctatagttggaattggggagtactgacatcttaaaaatattaagacttctaatctatgaacatgggatctattcccatttagttaagtcttctttcatttctttcaacaatgtttatagtttttacttctttgcagttcggcacatctgtcattaaatgtatttctatatattttcttctttctaatgccattgtaaatgaatttgttttcctaatttcatttctaggttgtttactgctagtgtatagaaatacaactgatttttcttacattgatcatagattgtacaagcttgctgaacttgtttatcagctctaataatttgtgtgtgtatatgtgtgccttaggattttctatatagaataccatgtcatcttcaaatagagatggtttttctttctaatcttatgctattttttctttttctttgctgattgcctttgtttgaacctccagaactatgttgaatagaagtggcaagaatggatgtccttgtcttgttcctaatcttaaaagggaaagcttgacagtcattaagcataatatgagggatgagttatttgtagatgccctttaacaggttgaggaagttcccttccattcctagtttgttgagtgtttttaccatgaaagggttttttattttgccagaagccttttctatttctattgagctgattatatgttttccctttattctattaatatggtgcattatattgatttattcatatgataaaccaaccttgcattcctgagataaatcccacttggttttgatgtgtaatcccgtttctgtcttcttggattcagtgagctagtatttttgtagtattttacatctgtagtcacaagggatattggtctgcagttctgtgatatcttcgtctgcctttgatatcaggataatactggcctacatagaaggaatcaagaagtgatccttctgattatgttttttgtatgagattgtgaataattggtgttacctcttctttaaatatttggcagaacttatcagtgaagcttggtccaagctttacttttggagaagttttctgattattaactcagtcttttctcattataagcctactgagattttttatttcttcttgaatcgattttgatcatttctttatctagaaatttgtctacttaatctaggttgtctaatatcttggtatatgattgttcatagtatcccctcatccattcttaattttagtgatttgagtcttcggtttttccttggtgaatctagctaaagatttcagtttttgttgatgttttcaaagaccaaacttggtttctttaattttctcttgcattttcctaatctctgttttatttatttccattctaacatttagcatttccctccttctacttatttttgttttagttacatagaactttagttacgtagagctcatctttttctaattcctttttaaaataatttcaatttttattatagattaaaggacacatgtgcacatttattacatgggtatattgcttgacactgaggtttggggtataaataatcccatcacccaggtggtgagcatagtacccaatcggtggtttttcagcccattccctcctcctttcctcccatctagaagtcctcactttgtattattctcatctttatgtatattcagtgttcagctcccgcttgtaagtgagaacatgcagtatttggttttctgttcttgcattaattggcttaggataatggcctccagctccatccatgctgctgcaaagggcatgattttattttatttttatgtctgcacggtatttcgtggtgtatatacactacattttctttatccatccactgttggtggccacctaggttgatttcatgtctttgctattatgaatagtgcgggaaagagcatgtgagtacatgagattttttgacagaatgaattcttttccttcgaatatatacccagtagtgggatcgctgggttgaacagtggttctttttcagttctttgagaaatctcccaactgctttatacaatggctgaaccagtttgcattcctaccaacagtgtataagcattcccttttctctgcagccttgactgcatctgttattttttgactttttaataatcagaattctgactggtgtgagatgttatctcattgtggttttgatttgtatttctctgatgaatggtgatgttgagcattttttcatgtttgtcagctgcttgtacatctgcttttgagaagtgtcttcctgttctttgctccccctacttttttttttttttttttttttttgagaaagggtctcactctgtcacctaggcggtagtgcagtggcacgatcttggctcactgcaacctccgcctcccaggttcaagcaattcttgtgcctcagcctcctgagtagctgggattacagctaatttttaaatttttagtagagatgggatttcgccatattggccagctaattttttaaatttttagtagagatggggtttcgccatattggccaggctggtcttgaactcctggcctcaattgatcttcccaccttggcctcccaaagtgctgagattacaggtgtgagccaccgtgcccagcccctttgcccatttttacaaatggaattatttgatttttgctttttaaatttttacatttccttacagattctggacattagagatttgttggatgcataatttcctaatattttctcccattctgtgagttgtctcttgattgatcatttattttactgtacagaagctctttggtttaattaggtaccaatcatcaatttttttattttgttacaattgctattcaggacttagccataaactattttccaaagccaatattgagaagggtatttcctaggttttctgctaggatttttgtagtttgaggtcctccatttaaatctttaatgtaccttgatttttttaaatatagtgagaggtaagggtccagtttcttctgcatatggctagccagttatcccagcaccatttattgaatacagagttctttcttcattgcttatttttgccaattttttgaaggtcagatggttgtaggtgtgcaggtttatttctgagttctctactctgttccattggtctatttgtctgtttttgtaccggtaccatgctgttttggttactgtagccttacagtggagttttaagttgggtaatgtgatgcctttggctttggtgtttttgcttgggattgctttgactatttgggttcttgtttggttccaaatgaattttagaatacatttttctaattctgtgaaaaatgatatgctattttgatagggatagcattgaatctgtaaattgctttgggaagtgtggccattttaacaataatattgattcttctcatccataagcatggaatttttttccatttatttgtcatctctgatttcattcagcaatgttttatagttctccttgtagagatctttcacctccttgattaggtatttcattttttgtggttattgtaaatgggattgtgttcttcatttggttctcagctagaacgttactgatgtagagaaatgctactgattttgtatcctgaaactttaataatttgttcatcaggtccaggaggcttttggtggagtctttagggtattctatgtaactcatatcatcagcaaagagagatagtttgacatcttgttttcctatttggatgcctttcacttctttctcttccataattgctctggctcagactttcagtactagaagtggtgagaatgggcatccttgtcttgttccagttctcaaggggaatacttccaacttctgcctattcagtatgatgttggctctatgttagtcatagaaagctcttattattttgaggtgtgttccttcaatgccttgtctgttaagggtttttatcatgaaggggtgttggatttcatggaagatgttttgtgcatctaccaggctgctctggggtccaaggcctatggaggtcccttgtggacttgagtgttgcctccttatacactctgggcaggcagctccctgtatcagtctatatgcctgggggtcaggaggaatctcccatcccaggattgcacaggtccccgcaggaagtgtagatcccccaggggctctcactcactatggaaaccatttagttgcccatagtaatgtggttgaattctctttaactgccttatacatgtttataagttgctgtttgaatccccttcccaggacatgactggtaattgtgtgtggtttgtattaattttgttccttggagcttggagaagccagagagggagtaggtgattctaggactctgtgcaacctcctgaagtgacatttttctctgcgattgttttaaaactcacaaactgatggctgctttagcaattgcagggtaagggaaatacctagttctatgggacgtgcccttgaggttttgcttttgtacttctttaaggtggctgttggctgctttggtggcttcctagtgtacagtaatattgctgggcctgattttttttctagcaaatcttcataatgcagctaagctattcagatctaagagataattttctagacatttttctgatttctttctggctagaaggagtatatgattaatcttcattcaagctggggcagaaatgctgttttcttttttaaacagggttgcatgtctctagttgagaagtttatctcttaccttagtcaccttttctgtcaaaagtgggctatccgtagggtattttgaatgtaatgactcacctttcaccctctgtatgtatgatcctttgtggagaaagaactgtgtattagctctaaatttgtgatatgagttgagccccttctctggattctgaagattcttttcatgttttgtttgtttgtatatttcagtcatggaagaggagattcattatacctgtctatttcctaaaatccatcacctgttttctcagtgtttctctctctcctatttactcagcttctctgtatctataggctgcttcctcttcactggaaccatgctttagtcattcctcacatggactggggaggacaagtgtgacaggatggcttctgttgatgtttctactgccttacatctttctctttattaccaaatatgtaatcttttattaagtataaagataaaaggatagttaaatataaagagttcaacaacatagaaaataaaaaggccttgtaattcatccgtaattctccccatcctgaaatagtcctgattaacattttatatataatcttccagttttatattttatgattcacataccttgttttattttaaaaaatggaattataccaggtgatttgaaagtcttattttcaacttttgtttgttttgaaactgttcatttaatatatcataatagacatctttctgtgtgaaatacagatttatgtagtcttttttattgctttatgagttccattgtatacttatactgtttaattagttccctaataacagatatttaaatcatttaaaatatttcttttttattattattatactttaagttctagggtacatgtgtacaacgtgcaggtttgttacatatgtatacatgtgccatgttggtgtgctgcatccattaactggtcatttacattaggtatatctccgaatgctatccttcccccctccccccaccccacaacaggccccactgtgtgatgttccccatcctgtgtccaagtgttctcattgttcaattcccacctatgagtgacataggtgtttgtttttctatccttgcgatagtttgctcagaatgatggtttccagcttcatccatgtctctacaaaggacgtgaactcatccttttttatcactgcatagtattccatggtctatatgtgccacattttcttaatccagtctgtcattgatggacatttgggttggttccaggtctttgctattgtgagtagtgccacaataaatatacgtgtgcatgtgtcttgatagtagcatgatttataatcctttgggtatatacccagtaatgggatggctgggtcaaatggtatttctagttctagatccttgaggaatcaccacactgtcttccacaatggttgaactaatttacagtcccaacaacagtgtaaaagtgttcctatttctccatatcctctccagcacctgttgtttcctgactttttaatgatcaccattctaactgttgcgagatggtatctcattgtggttttgatttgcatttctctgatgggcagtgatgatgagcattttttcatgtgtctgttggctgcataaatgtcttcttttgggaagtgtctgttcatatccattgcctagttttgatggggttgtttgatttatttcttgtaaatttgtttacgttcgttgtagattctggatattagccctttgtcagatgggtagattgtaaaaattttctcccattctgtaggttgcctgttcactctgatggtggtttcttttgctctgcagaagctctttggtttaattagatcccatttgtctattttgtcttttgttgttattgcttttggtgttttagtcatgaagtccttgcccatgcccatgtcctgaatggtattgcctaggttttcttctagagtttttatggtggtaagtctgacatttaagtctttaatccatcttgaattaatttttgtataagctgtaaggaagggatccagtttcagctttctatatatgtctagccagttttcccagtaccatttattaaatagggaatcctttccccatttcttgtttttatcaggtttgtcaaaggtcagatggttgtagatgtgtggcattatttctgagggctctgttctgttccattggtctatatctctgttttggttaccagtaccatgctattttggttactgtagccttgtagtatagtttgaagtcaggtagcgtgatgcctccagctttgttcttttggcttaggattgtcttggcaatgcgggctcttttttgattccatatgaactttaaagtaggtttttccaattctacgaagaaagtcgttggtagcttgatggggatggtattgaatctataaattaccttgggcagtatggccattttcacaatattgattcttcctatccatgagcatggaatgttcttccatttgtttgtgtcctcttctatttcattgagcagtggtttgtagttccccttgaagaggtccttcacatcccttgtaagttggattcctaggtattttattctctttgaagcaattgtgaatgggagttcgctcatgatttggctctctgtttgtctgttattggtgtataggaacgcttgtgatttttgcacattgattttgtatcctgagactttgctgaagttgcttatcagcttaaggagatttggggctgaggcaatggagttttctaaatttacaatcatgtcatctgcaaacagggacaatttgacttcctcttttcctaattgaataccctttatttctttctcctgcctgattgccctggccagaacttccaacactgtgttgaataggagtggtgagagggcatctctgtcttgtgccagttttcaaagggaatgcttccagtttttgcccattcagtatgatattggctgtgtgtttgccataaacagctcttattattttgagatatgtcccatcaatacctagtttattgggagtttttaacatgaagggctgttgaattttgttgaaggccttttctgcatatattgagataatcatgtggtttttgtctttggttctgtgtatatgatggattacatttattgatttgcatatgttgaaccagccttgcatcccagggatgaagccaatgtgatcatggtggataagctttttgatgtgctgctggattcagttttccagtattttattgaggatttttgcatcaatgttcatcagggatattggtctaaaattctctttttttgttgtgtctctgccaggcctaggtatcaggatgatgctggccttgtaaaatgagttagggaggattccctctttttctgttgattggaatagtttcagaaggaatggtaccagctcctctttgtacctctgatagaattcaactgtgaatctgtctggtcctggactttttttggttgataggctattaattattgcctcattttcagagcctgttattggtctattcaaggattcaacttcttcctggtttagtcttgggagggtgtatgtgtccaggaatttatccatctcttctagattttctagtttatttacatagaggtgtttatagtattctccgatggtagtttgtatttctgtgggatcggtggtgatatgccctttatcattttttattgcatctatttgattcttctctcttttcttctttattagtcttgctagcggtctatcaattttgctgatcttttcaaaaaaccagctcctggattcattgatttttggaagggttttttgtgtctctatctccttcagttctgctctgatcttagttatttcttgccttctgctagcttttgaatgtatttgctgttgcttctctagtttttttaactgtgacattaggatgtcaattttagatctttcctgctttctcttgtgggcatttagtgctataaatttccctctacacactactttaaatgtgtcccagagattctggtatgttgtgtctttgttctcattggtttcaaagaacatctttatttctgccttcatttcgttatgtacccagtagtctttcagaagcaggttgttcagtttccatgtagttgagcggttttgagtgagcttcttaatcctgagttctaattgggttgcactgtggtctgagagacagtttgttatcatttctgttcttttacatttgctaaggagtgctttacttccacctatgtggtcaattttggaataagtgcgatgtggtgctgagaagactgtatattctgttgatttggggtggagagttctatagatgtctattaggtctgcttggtgcagagctgagttcaattcctggatatccttgttaactttctgtctcgttgatctgtctaatgttgacagtggggtgttaaattctccaattattattgtgtggaagtctaagtctctttgtaggtctctaaggacttgctttatgaatctgggtgctcctgtattgggtgcatatgtatttaggatagttagctcttcttgtttaattgattcttttaccatcatgtaatggccttctttgtctcttttgatctttgttggtttaaagtttgttttatcagagactaggattgcaacccctgcctttttttgttttccatttgcttggtagctcttcctccatgcctttattttgagcctatatgtgtctgtgcacatgagatgggtctcctgaatacagcatactgatgggtcttgactctttatccaatttgccagtctgtgtctttcaattggagcatttaggccatttacatttaaggctaatattgttatgtgtgaatttgatcctgtcattatgatattagctggttattttgctcgctagttgatggagtttcttcctagcattgatgttctttacaatttggcatacgtttgcagtggctggtaccggttgttcctttccatatttagtgcttccttcaggagctcttgtgagacaggcctggtggtgagaaaatctctcagcatttgtttgtctgtaaaggattttatttctccttcacttatgaagcttagtttggctggatatgaaattctaggttgaaaattcttttctttaagaatgttgaatattggcccccactcctttctggcttgtagagtttctgctgagagatcagttgttagtctgatgggcttccctttgtgggtaacctgacctttctgtctggctgcccttaagattttttccttcatttcagctttggtgaatctgacaattatgtgtcttggagttgcttttctcgaggagtatctttgtggcattctctgtatttcctgaatttgaatgttggcctgccttgctaggctggggaagttctcctgggtaatatcctgcagagtgttttccaacttggttccattctcctcatcactttcaggtacaccaatcagacatagatttggtcttttcacatagtcccatatttcttggaggctttgttcatttctttttactcttttttctctaaacttctcacttcatttcattcatttgatcttcaatcactgattctctttcttccacttgattgaatcagctactgaagcttgggcatctctcacatagttcacgtgccatggtttttagctccatcaggtcatttaaggtcttctctatgctgtttattctagttagccattcatctaatcttttttcaaggtttttagcttctttgcaatgggttcgaacatcctccttttgctcagagaagtttgttattaccaatcatctgatgcttacttctgtcaactcgtcaaagtcattctccatccagctttgttccattgctggaaagcagctttgttgctttggaggggaagaggtgctctgatttttagaattttcagctgttctgctctggtttctccccatgtttgtggttttatctacctttggtctttgacgatggtgatgtacagatggggttttggtgcggaggtcctttctgtttgttagttttccttctaacagtcaggaccctcagctgcaggtctgttggagtttgctggagctccactcctgaccctgttcacctgcgtatcaccagcggaggctgcagtacagcaaatattgcagtacagcaaatgttgcagcctgatccttcctctggaagctttgtctcagaggggcacccagctgtatgaggtgtcaagttgtcccctaatgggagatgtctcccagttagggtactcgggtgtcagggacccacttgaagaggcagtctgtccgttctcagatggcaaactccatgctgggagaaccactactcccttcaaagctgtcagacagggatgtttaagactgcagaagtttctgctgccttttgttcagctatgccctgccctagaggtggagtctacagaggcaggcaggccttgttgagctgtggtgggctccacccaattcatgctttccggctgctttgtttacctactcaagcctcagcactggcggacacccctcccccagcctcgctgccaccttgcagtttgatctcagactactgtgctagcagtgagtgaggctctgtgggcatgggaccctccaagccaggcgtggggtataatctcctggtgtgccgtttgcttagactgttggaaaggtacagtgttagggtatgagtgtcctgattttccaagtaccatctgtcacggcttcccttggctagtaaagggaattcccctaccacttgcacttcccggatgaggtgatgccccaccctgcttcggctcacactccatgggctgcacccactgtccaacaagccccattgagatgaacctcgtacctcggttggaaatgcagaaatgacctatcttctgcatccctcatgctgtgagctgtagactggagctattcctattcagctatcttggaaccctccggtggttttgaagttcatcactttttttagctatctccaggcctccttatctcacatgaaaattatatgcaagtgtcacttcagaatttccttctgaagatgcatcagactaatgtttggctagcattctcttcagagtttttccaggcccagtgaaaatagccaggctttttttgtcttaccaccttacaacaaacagcttaagtcctatccaactactacattctcccaacacagatacaaggcagcatgttcacattatctcaagcttcctccaaatacatctcaacagttagaattggattagaaagaggacttgttggcttgcttatcctgtgggtaactgtgacattgactgcaggtaataataacaagatctcttttatttttctaggtggcaaaccatgtgatttcttctgactctatttcctcttctgccagtagtttcctgagctcgaactctactttttgcaacaagcagaatgtacacatgttaaacaagggcacacaagcaggtaattacttgaatctgaactttttcattgaaatacattgaaatggctcttaaacatataagatactcaacctcaatcatagtaaaggacatgaagttaaaactatatccaactgccaattttcatcttatcagattggcgtaaattcaagtgtgatggcaagtttgtgggcaagagtgtagggaagtgtgttcccttgtatattccagtgggagtagaagttggtttactgtgaaagacaatttgacaggtcctgtcaaaattactttcactcagcatttttacctttgaaatgtctgctatagatatactatgaatatgtggattttaacctatagatatacttgcatatgtgcaaaatagtgtacaaaattaaccactgaaacattgttttttatagcagaagattaaaatgaatttaggtattcctcaatagctgaatgattacataaattattgtatatctggataatgaatgaaattctacatagaatgaggaagctctctctttactaacgtggaaagatctccaaggcatataactgattttaagaaaaggtacagaacagtgtatggcatactacaatatgagtttttttaaataaaagaaataaaggagggaagagaattgcttaaatgtgcaaaatgaattctctggaaccatatggggttgtgaacagagtaaatggagaccagaagtgggaaggaggatttttagctattgcctttctatacttttggtttcataaaataaaaataaataaactttcttgatttgtttcttcccctcaaatcctgtctttacttctgtcaacctcttccatacctgggtgactaccaaaaggactctaagtatttattgtctttctgccttgggatccaggtggaaattctttaccctttgaacccatattcattcttctttccctctcatacctaaaatgacttacaaataaaaccctttcttttttcttctccctctttttccctcctactctcccctgtccttccttcttttcctctctcttcccatcactccatcccacacaaagggattgtatttttgaaacattaaaaaggttcacatactcacttgaataaacctgtcaactcagcctcaaggttactcccagagacacctgtgatccttcccctcaggtaacttggagattgtgaacggtgccgaaaaacacactcgagccaactccaagttccagcgaggctaaattggaagaggacagtgatgtgacttcttggtcagaagaaaaacatgaagagaaaatgctctttaccagttatcctgaggacagaaagttaaaaaagaacaagaagaattcccatgaaggtcagtttctcattccagatcttgtagtagagaaactagtgaatttcaagtcccctgcaatgctgactctgtgtttccaagtgattctatgtgacccccacctacccccagtcaccaccttgtcagattttcgaagtccagcatggcagttacacagtcatccctgcagtgaaaccaaactcaagggcaccctgtggccgctgacagctgagacccctgagagcctgtattatatgcatctccttgatgaaagccaggtggggctgtaaaaagtgaaaattctgttttacttctaaaaactatttcctgtaggagtttcctggtttgttcctgtggaaaatgtggagtctagataaaaagaaggaaaacatgctcaagactcatgaccctggcatctcccggttggaaccagtaaccaagaccaagccgtggagggagccactgtgggagcggaactggcaggggcagcacctggacagtcggggctacctggcaggcccaggcagagaggatggcagaaacccactgaagctgtttgtgagagcaaccctgcaggtgcagtgacgtttacttaactttagccctacatgtagggagaagaagggtaaggcgcagagaagctggctctgtgacttggcgagctgaggtgtaggcctgagacgctcttttccagcacctccgcagttcacctgttttcacacgtgaggactgagtttctcatcatctgtcaaaggctgccttactcttagccatagatggtgcatcactgtcaggatctggagacaagggcacaggagggaggatttgtggctctgctcattgggtttgtgggtccctgtgtgtggagggcccagaggcctgatgcttgtgcagcctcatgcatgttcctccatgtccgcagctcctgtttctgctccatgtcggatttaaaggaaaccaagtctcttctgatgtgtccctctggggataaaggaaaagttattaatgatgtatttgtttgaatagatctttaaaatagcagcatgggcagagctgtattgcgttgatgtttcagagagttgtaatcgccatagtcttagttcctggcctatgctgaaggcatgtctttgatccctgtgggttccaagctgcagctctccgccatagagaggtgtcagaggtttcttcaactctaggtattttctcggcatttgaatcaggcttccccagacctcttgggtacgtggtgtgtttccagccatatggagagtagattgcatcattaatctgaggctgggtattttctctctctctctcttttttttttttttttttaaggaatcgcttcagtttcacagacctgacttcatctcccacattggggagcggataaagcgtctgaagttaatagtccaggagagaaagctgcagagcatgttaaagagcgagcgggatgcgctattcgacattgacagggaacggcagggccaccagaatcgcatgcgcccactacccaagagaggtacgccctgcccgttcactttcctgtgagtggaatagagaaggcaaggtctgctgctgtgctgcagagccctgctaaaggccagcccaggccagttacctgggcagacagcaaccttttgcttgccaagactcaaaccttcttagctaacagaacctccccaccttagccgtcagcacattcatgatccaagtaagcccagttactctagccctgtcactgcatcttaaaccagctctgtctgtgagcaagttagttccaaaagtatattgatttttcctgaaaagatggggctgattccaggcttgcctacctcttaggatggtaataatgataataataaacacatagtccttacatcttgcccaggcactgttcacattagcgcttacagcactctcagtaggtactattaatatatctactttatagtgagaaaactgaatcaaagggagattaactacctctcccaaggtgacatactcaggtgtgctgctctggagtctgcattcttaacaattatggtaagcagatcttgataaaataatgaaagctgtgaaaactacaaagtactatctaattctttcatcaagccttacctggaaactggccagttttttaattcaaagcctagtctttgctacagagtgttaggtccttagggccttaggctgctgtcctgttaccctagtctaaccctggcttgccttggtcattgctccccactcagtcttgccagctcagggtaggggcaccaagtcctagcagctccctctcccagctcttgcaccacaccctctgggttaagtcactgtccactgaaaaccctttcttctcttccttagtcttcctggctgtccagaagaacaagcctatcagcaagaaggaaatgattcagaggtccaaacggtaagaccaagaaaacaagagtttgtgtacaagtgttaaccaggccaccaagtggtcaggagctctggcttgcacccagaataaaggcattatgctcaaatttaaacattatgagaaagttgtgagagtcatttctcacttatggcactgaaaaaaaaagtagcacatcatggtatgaatgactcatatgcaaaagatgaaaaacttctcattaatttgcatatcttaggctcctctttattaacctaaatgtaaataaagaatattttaggccaggtgcggtggctcacgcctgtaatcccagcactttgggaggtcaaggtggataaatcacttgaggtcaggagttcgagaccagcctggccaacatggtgaaaccccgtctctactaaaaatacaaaaagtagccgggcgtggtggtgcacgcctgtaatcccaaccactcagaaagctgagccgggaggatcctttgaacctgggaggcagaggttgcagtgagcttagatggcactactacactccagtctgggtgacagagcgagactccatctcaaaaaaaaaagattattttaaaataaaattaaatatgtatttgggttattataccttttatcttagcaatcccatttcttggaattgatcccatagggtgagaaagaacagtgttctccagaacatattaagttaaacttttttaaaaaattaaattttcgaagtatgtcaacactgtttccatttgtggtctttaaaagtaagtatttgtgcctatgtagacgtgtatacttttatatgcatagaatatttctggaagacagaaaaacctgataatactgattgcctttggaaaggagaactgatgtaggatgtagtagattttttgactttttgaatgttgtgtcatgaggaacgaacattagttactcataaattaattcatttgagtgttggatgtggtggtacatttctgtaatcctacctactcaggagtcttaggtgagagaatctcttaagcccaggaatttgagactgcagtgagctatgatcacaccattacgctctggcctgggtaacagactgagactctgtatctaaaaaataataaataatattttaaaaaattaattcatttcagatattgatatattgatcatgggaatgccagagaataagttaaggttgacttttttaggtgttcattagagacttgctttaatgagaatagtttcttagttggcataatgcttctgaagtaaaggtactttaaaacagtttatcttacggactttaagcattcctcttgaaatcttgtttttactctttctagtcagtctttataggcaatccaaagggatgctttggatgctttagtccagtggttctcagagagtggtctgtggagtcctggaagtcgctgagaccctttcaggcaatttgcaaggtcaaaactaatttcagaatgacaccaggatgttctgtgccttttttgctgtgttggctatttgcactgatgatgcaagagtactgggagaggagtaaaaccattggtgtcttaccactattcaagacggtggcaccaaaccgtactagtctaataggcattgtatcctgcacagcctcccgccaggagtgtgatggaagaacaaggaagcagtgtaaatggaggtaaacgggaagcacttcctttgcaccgtgaaagatgatgactgtttcaaggaaaagcacttatgccatggtttgtgtcgtgagctgaaccagctgcctttgtcatggaacatgacttttaattgaaagagtaactgacagaaaaccaattattctgacttgtgtttagcagacattttcttgaaaatgaagaagtgactctctgacttcaggaaaatgtctgacagtatctgttgccaaagaaaatgtgagttttcaagccaacaatagaattctagaaaacttgtattcaccaccatgggcttgatgacatcttagtacttagacctttctgacgagatagcagtgacattaacaaatgtgacgtttttcatgttatctaaatacatttgtcaacatttggaagatctgcacaactccctggaccaggattttccaaatgattgttgctttttgttacaaaatcagggaatagatagaagattcaaatagtacaagatagactgatggatttttatgtaacagaataggaaaagtttgctgacatgctttcagattccaccttgcaactaatttttaagaaactaccacttgtcagccaggcacagtggctcacgcctcataaaatgagttggaatgaagtttttctttcttattctctagaagaatgtaatgtaatttattgcttaaataattaggagaattcaccagtgaaacccatctgggcctggattttcttttgtgggattcatttttttcaataactattcagatttcagtttttcttttatgccaaggtttagtaagttgtgttttttacgtaatttgttcatttcctagaaatttacaaattgatgatccaatgttataatatccttttgttatctttttttttttttttttttgagacggagtctcgctctgtcgccctcaggctggagtgcagtggcacgacctcggatcactgaaagctccacctcccaggttcacaccatcctcctgcctcagcctcccgagtaggtgggactacagacatccgccaccacgtctgactaattttttgtatgtttagtggagacagggtttcactgtgttagtcaggatgttctcgatctcctgacctcgtgatcagccctcttcggcctcccaaagtgctgggtttacaggcatgagcccccgcacctggccctttgttatctttttaatgtctggacgttctaggatctgtagtgatgttccgtttttattcctgatattatttttgcctcctgtcatttttacctgatcactctttccaaggggtatataaatttcactagtattgtcaaataacccactttgggttttattgatttttctctatcgtatattggtcttatattgattttttgttgtttattttggggccgtagcaggagccacagccagctccacatagttcagagggcctggcaagtatggaggaagacccttgctttcccctggaggtgctgagagtttaattcccgaggaagtaaggggattatttccctgtattggcaaaggttctagtttttgagtagaactagaggacctcacttctcttgaaggagaagtagagaggctcctcctcattcccttccctacaagtccccacgtgactgattcttcctctccaggggcttctagaattagcaacattgttccctttgatcctttggctgattacatatcctgcatttcttctgtagggctgggtgttgatagagggccataagacattatacataaggtattttatcccatttaccttgtttcttacaaaataagtcccagttggagaattgtagtattaatgtatgtaagtaactcatgttcagaccatctctcttgattccgtagggaacactggggccatatggtattacagtaatatatcatttgctttttggtcatggatatgggtatccaaatagtttccagtgctggaggaggcactgtaacgggctctcctccagtattgagacctggttccccatattctagggtctttgcccagaaggctgattccaccctccaagaagcttccactggggattagtgatgacacaaatcctgtaactcttagcctgtaggatatttctggtcctttcagcttgctgctacacgcaggccactatggagtggaggtgctgggaagctaggagaggacaataggggttgcctctccctggatcatgttcagtctgggtagcttccctggaaatctcatggagattccacagtagttccggatccagcttgagtggtgggaggtatgtaaatcaatcaagtaagcaaggtgttctttctggagagggtgcacactctgctcatgtaaagtctacatcactgtattttggttccaggaattcccacccaaactgccccattctaaattaggcctcttcaaatcaataacagttcttctgtgactgctggaatatggaagcccaatattttagggattaccacagactaaggagaagggaatccagacttcacatgcattcaggccacaaagaaacacaagtattggcaaaagtgacaagcattcagcctacagatataccagacagggacaaagtcttaaagatgagagtcctcgtctttatattagggcttcccctgttaaaatggatggagacatctctcaactcctagacctgaaggggagtcctgcccattcccaacagtcctggatcccttgagctaggtcctaaacctgacaacccagagtcctaataatcaaaaccaaaaccactcttttagtcagttcacagaaccaccaccacttactgcctcaaaattgcaccaaatgaaaggtccaagcagccacttctgctttcctggtgggctggggggatggggttggcatgcctgaggcccttcaccaatctccctcttggcaacttaacccactcatgcttcctcagactgctgcttcgcctgtaagcagcctataagggaggtcgagtcagggctcagtccatagtcccatctggatcaaccagatttgtttcccaggccctcccaccccactgcctccaaaaaaaaagcggggtttgtttgcctggtgagtaacaaaagtcgctgagaacacagactttgatcaataggagttttattacttgtcacaagtaggaagagctctgggaatattcgtcaaagcagtgtctcctaagagaaaatgacaggaaggctttatagagtgatcgagaggggagaaggtgcatcatcacatgaagaggaggggtcccagtgacacagatggagggagtcatcgtgccaccacataggacgcatgctatggtaatgaaactatagctctcccagggtgcaggatttagcattgtaatgaggaaagttcactgtaagtgagttcatctataagttgctggggtctgtcaggagcaggttccaactgactaggtgaccacatttcacacagggtttgagacaaaaccgtctgcaaggcagaaggctgtaaaacgggctaattgctcaaattcattaaattccttcactccctgggggcccgccctgtcttgtctatatagccagtccttaggaagtgaggccaagctgaactgttgacacagtctatgtctttacgagtctgggagctgggtgattttacctctgatgctagacttatttttactggttttgaagccttgcttacagccctttcccagtttctcacgaaatactcatgaaaggggatggtggggagtgggcatggggaaaagggaatgatattaaaattaaagctaacatcattggcctctagggggcactcatggctcatctccatagcccttggctcttgcagctgcccaagatgagagtcctgatctaaggaaactccaccaccaccaaggctggggtggtggcaatgggggcattattttccaaacctgactaggctacattttaaggggatcatagtcacagagaacatagatgtggactattaattttctttgcctgagcagccgtagccctatgtgctcctctccagcctttcagggagctatgatgggccaaaaaatgctcagtagcccaagccatctcctccatagacactggagtaaaatctctgcctatgggtgtgtgtgtcttgtcttactctatcctggatttgtttcctccaatgctggtggctttactttagatagtctgattgttgcagagatgagacccaaggctccactctggagaaaatagagccctcttgagaggtcagcccaacttgctagacttctgcatggggcttggggttcaatgttccagcctgtccccaaaaagtcatggccaaattcacatattcctttgatccctgatggtgtctcatcacacagttcgtctggcctcaccattgctccactaagtccaggaacctcaaggaactatgagacaggtagggctagacttaacaaaatggctatcacagtcttcatttcatgagacagaggtgaactgagaaaaggtggaaggtgcttcagagacttctctgtattcatccctaacttaggcagagagccttggccacacaggaaactggggaagacccctctcttactcaggagtcccccacactggtgccatcttatgacaggcaggcatcagcttcagagccagtcaaacagttaggaatagcaaacattgctccagaatttgttggggttttttttcccctgaatttgatagtaagctccacataggcaagaatgacaaccatcttgttctccttgtttctctggagtctaacacaacatgtagcacgtggttggcccaataagaatttgtcgaatgggggccagatgtggtggctcatgcctgtaatcccagcactttgggaggctgaggtgggagagtcgtttgaggcctggagttcaagatcaacctgttcaacatagtgagacccctatcttcttttttttttttttttttttaaagtggagtttgttgaatggcacacagaaaataaacaatccaaatgacagatcagaggtgctggaaaagaccagggagatctaatcgttaaatcacgtcatctaaatattaagaggagacatttggacatctgatagaatttggcattgaataagtgataaatacacagaaaactgaacaacggcaaaaagaaaagtatcagttctaagggaaaagatacaaatcaaaagccttcaggaaaggataagtcatcatggcttactgtatagcttagcttaaaataacacagaatagtgaagtagcccaaagggccatctaaccacactgggaagctgagcaggggaggagtgcgtatatgcatggaggagacttgtcttcaccctcctcagcagctgacagcaggcaggctagacctggacaatggagcaggagtcacacagcctgtgaaagaagtgctggggaatgtaggggctgctgtttcacatgacagagccattgaaccctggctgtttataatagttacatacataattttaatagaaataaaaaccaaaaagaaaaaagacttaaacatgaaaggcaaaaccattacaatttttagaggaaaatataagagagtaagaacagaaaaatgtcttaaggcacaaagtgctaaccataaagaaaaagattgataaattcatcttgataaattttttgtttatcaaaaggcaccataaagacagtgaaaagacaaggcacaaaatgggagaagataattgcagcacatctgaccagcaaagaatttgtatccagaatatataaagaacttctatgagtcggttttttaaaaacacaatttatatttaagtctctttaaaacaaatagacaattcatagaaatatggtgatatggtttggctgtgtccccacccaaatctcatcttgaattgtagcttccataatttccacatgttgtgggagggacccagtgggaggtaattgaatcatgggggcagatttttcccatgttcttgtgttagtgaataagtctcatgagagctgatggttttataaagagcagtgcccctgcacaccctctcttgcctaccaccacataagatgtgcctttgctcctccttcacgttctgctgtgattggtccgcatccaaatgtcatcttgaattgtagctcccataatcctcatgtgttgtgggagggacctggtgggaggtaattgaatcatgggggcagatttttcccattttcttgtgatagtgaataagtctcatgagagctgagggttttataaaaggcagttcccttgcacaagctttcttgcctaccatcatgtaagatatgcctttttcattataagttacccagtcttggatatttcttcacagtggtatgaaaatggactaatacacatgggctaaactcatgagcaggcaactttatagaaaaacacaaatagcccataaacataaaatgtagattgagttcattattaattagggtaatgcatgttatggatagaataaaatacctttttacattcactggattggcacaaagttttgtctttgtgccactctaaatgttgacagggatgttgatcaactggaattcacacactgcttgaggaagcttgcattcactctataattcagcattctgaaaagtgctcaccaataatcagcccaggaaggttcacaaggacatcttcaccaaatatgtcctttcaccctagcaaagaactagaaacaactcaagtgtcttttgacaagagaatgagtaaatggcaagtggtatgtcacgcaaaagaattctagacagaagagaaaattaaggaacatcaaacttagtgaatctttgagacgatgttgagtaggaaaaaaaattcagaagaatatattgtatgatacttttatcataaggtttaaaagcaagccaaggtaaacatgtgcagggacacctagggacccatgtcattttaggatcaaacagatagatggacagatgatagatagacagacagatggatttttttaactcaaaatagtggttacatccttagggagctgggattggagaagagacacttagctttgaaagtattgtcaaatatagtgacctttctagttcatttgggtgctgggttcaggggtattcattttattatgcaccataatttatgtgagacattttattatatcaaatattttctaatcttacagtaagcagtttggtaaacagattcataactgcatataatgtgtaggtcttgtgaacaatgctgctgtgaatatcaggacccaactgcacttgtctctcac

SEQ ID NO: 118 - DNA, 59733 bp, Homo sapiens
ccccataaaaaaatccctcagtgtcttctctaacccttcttatactccttgtgagttttagagccacctaaactcttcttttttcccaatacatggagacaaaatttacataacatacagttagccattttcaagtatacagttccctgccatttggtacattcacagtgttttgcaagcaacacccatatcaagccccaaaacattttcattacccaggaaggaaacctgtcgtcatggaaccgtcactcctcacatccccttcccctcaaaccctggcaaccccaaaccgttcttgacagcctcctttggcatttcctcattttggtgtcagatctcacagcagaatttcttacctattatatccagtgcctcagtgtgaagttccggtttaacttcttgttaccacgagcccactatcttgccccaataataccctcccccaattcacaaacacacaagcattccctcctacagctttgggcctcctatctgagtccttcaggaaagaagtgcttgtaactcccttggcagtgagtgtagacttggtccaaggaagatgagcaccagtcagggcagctggtccctcttctctccctggccatcagcaaatcagcactgcccatcgatgcccaggcaatgggagcgtcgaccagcagaggacacacctgaatttctctgcctcatgggagggtggctgctgtgttgcatttaggaagaagctgtgcaagattcatactgttttgctaatgttaatcttgtgggcataataaacgtcgtacccacacttatttttctagatcagacaagattgggtgtgttcagggtggtatggccatagaccccacacttttttttttttttgagacggagtttcgctctcgcccaggctggagtgcagaggtgcaatctcgactcacagcaacctccgcctcccggattcaagccattctcctgcctcagcctccagagtagctgggattacaggcatgcgccaccacgcctggctaattttgtatttttagtagagatggggtttctccatgttggtcaggccggtctcgagctccggacctcaggtgatccgcctgcctcggcctcacaaagtggtgggattacaggcgtgagccaccgcgcctggccgaccccacacttagttttaatacacttctaggcaaggctgctgcactggtctggggatcacactttgagtagcaaaggactaaattgcaataactgccggggggggagaaaaaaaacaggatgaactgcttcctcctggctcagcagctagggagtcactgaactaacaaggggatggggtggggataagaatgttccaggcaaaaggaacaacatgcccaaaggcctcaagcagaaagagagcttcaggtattgaagaagtagaagtagctctgtgtggctggggagtgggcataagatggagcagaagaatgccaagtcctattcctgggtctgaatttccaggagcagaagccctgtcccctctagaaggtggatatagtctggatatttgtcttcaaatctcatgttgaaatgtgacccccagtgttagaggttggacctagtaggaggtgtttagatcataagaactggatccctcctgagtggtttggtgccctccctatgattgattgctctattagttcatgtgagagctggttgtttaaaaaagcgtggcatctctctggttccctctcttgccatgtgacacaactgctcccccttcacccttccccatgagtaaaagcttcctgagaccctcaccagaggcacatgccagcagtgtgattcttgtacagcctgaaaaactgtgagtcaaataaacctctttacattataaattacccagtctcagatatttctttatagcaatgcaaaatagactatcacagaaagttggtacggaggtgtagggcgttgctataaagatatccgaaaatgtggaagtggctttggaactgggtatgaggcagcggttggaaagagtctggagggcccagaagacagatgagaaaaggtttggaccttcttagagatttgtaatgtcgttgtaaccaaaatgtggacagaaatatgtacagtaaaggccagcctgatgaggtctcagatggaaatgaggaagttatggggaactggagcaaagatcacccttgttatgccctagcaaagaacttggctgcattgtatctatgtcctagggctttgtggaaggctgaacttaagagtaatgacttagggtatctggtagaagaaatgtctaagcagcaaagcattcaagaaatggcctggctgcttctaatagcctatgatcagatattggagcaaaggactgacttaaatttggaactattaaatcaaactaaaatctggcctgagaaagcctcctcactcccatacttgagtccttaaggatgaaccataacctaactttgtaggtaggacgactgaaaacctaacttagaaggatgcttctgtagcaataactgagcctcagccaatctcagcagccatacttcagtactcacaggcagcctattgttcaaaccatgttcaaataaggcaaacaccatgctgtaaccaatttggctatttctgtacctcactttggttttctgcatgtcactttcctttttctattcataaggttttttccgaccacatagcatctctggtgttgctctgaatctgctgtgattctagggactgcctgatttgtgaattgtctttttttttttctcctcaattaaattctgttaaatttagtttgtctaaggtttttcttttaccagatctggtgttggaagtgcagtttgaagtaaaactctggtgacctacaggaacaccaggtgaccaggccagttgtgctcactgatcttttgattgtaactggaggttgtagatgggttttctcttggattcagagttccactaatttgtgttctaattggagctctccaagtttatttgagcaatatttaagtggactgggttcaggatcaaatttgaatcaattaactggattgggttctgttagagcctcagacctctactaggcactttttttttttttttttttttgataatgggtttgtctcaatccaaggattctaggaatctaccttctgggactccatctaattttgtatataaaattttaggcccagaatgtgtgcatctttagaaaaacagattaaccttactagagaaaagatggccacaatggggaagttttaatttgtataaaattgtttatttgcaaggcatattagaaaaagggggatcaaaaccccacaaaaacattgggatatagtctttcattggtacatggaagcctctaaaagactaaacgaatgaaaaattccctccttaaaagatactttgcaaaagcaaatgaacagtttaagcaacaggctaaggacatgatgaaagagaactgtactctcactgaactaaccccaactgattcttctctttatccatctctacctacgtactctgagtctactaacctttttgctagatcaacctttcactctgaagatgatgaaaaaggaggaattagatgtacgcctcacaaaggaagaccttctgattatccaggcctgcctgctataaccactttcactccatggtctaaaactgagcttagagctattttagaagacttccctgatctaagagaaaatcctcaaaacttgactaaggagtttagactcctcataggagactatgatccaggactccctgacaaaggttcatatgacaatttattcatatgatatggaggcctggtgaagctcaaaaatggatggcagcagcagaatggaagaaacctgagaaagatattaaaacccccccccccgcaccccccccccgcaccccccccccccacacacacacacacaaagcctcctcatgagaaggcccaacaggagctagaaatattgctgaaaatcccagcctgggcaacatggcaaaagcctgtctatacgaaaaatacagatagttagctgggcatgatggcacatgcctgtagacccagctacttatgaggctgaagtgggaggatcacctgagcctgggagcttgaggctactgtgagccatgactgtgccactgcactccagcctggatagcagagcaagaccctgtctcaaaaaaaaaaaaaaaaaaaggaaaaaaaattgctgaaaatcttttaaattcaaatactaaattttttccacaaaagttgattggtacatcatacaatcttgtaaaccaaaaaaaaaaaaaaagaatgaaccagtgtcagattacagaacttgcttagaaataatgtgaaacattctgggcttaaagtactaacaaggagtatttcctgcagggactgaaatggtattaactactctatttataaatggacttcatcctgaacttagaaatttaattagaaaacgtaaactcggatgggaagttacagccatgactgaattggtggctctagctgaacattttgagaggactgtagagcaagaaaaaacccaaaaggctaacaagcttatgactcttcaattacaacagttacaggggccaagaccaaagggatcttctcattctcattttaaatcacaaccaagaggtattagaccaagaaattcttcaccctaagatgtctgccttattgcaaacaaccaggacagtggaatagggattgtgcccttttatatcagcccaccaatgaccctccctttaggccagcctgtttcaccactagagggagcacaagagaccttagctctcctgaagataatcagcattgaagcggctctgagggatttcacagtatattgctcctcataatacccttaaaagaatatggagaaacagaggttacagtaactggggactcatgtatagtcttggtggataccagagctaccttatctgccactaccataaaacacactttcataagccaacagatccctcagagttaaaaaggctatttctgtggttggggtttcaaatcaaattcaagagtttcccatatctgaacccgtccaattgactttggggcatttttcaaaaaatcacactgttgtactatgtgatagtgctccagtaaatttgctagagggagatttactttcaaagctgaaagggcatagaagactacctattgggtacattgtaaactgcttgggaaatgggcacactaaaatctcagaaatcagcagtaaagaacttgtccatgtaaccaaaaaccacctgtactcccaaaactattgaaattttttaaaataaaaaatttttaaaagtggggagggtgtaaaattttccttggaataagaatcagtttcctgattctcctgaaccagaattgttatgttctctataggcagatattaataggatcgaaactcaggcctgtaatgcctgatcttccaaaaatacctaaatatttatgggcctcttcctcaactgatacaggaagaatttaaagtgtgtcacctattaacctccaaatagaccactctaaacttttgcctaaagtacccaatatccactaaaactagaagcaattcaagggctcttgccaattgtaaaagatttcattagacagggacttataattctatgcaccagcccttataaccctccaatcctactggttaaaataaaccaaatggatgaggttgaagatttgttcaagatttatgggcagttaacaaaattgtagtagcaaggtttcctatagttccaaatcctaatacttcattatccaagatacatgctgattcttaagtggttcacaatattagttctctgctcagcctttttttacaatccagtttataaggagagtctatgcttatttgccttcacttggaaaagtcaacagtacccccagattgtgatgctgcaagggtttaccgaagcctctttgtgttttcccaggcattgcatcaggacttaatgacattatagtttcctcaaaattctactctcattcagtacgtggatgacttactgtatgctctcccactaaagagtactctgaaatggactcagtttaccttttacacaactcacacatcaaggtcacaaagcttcagtagaaaaacttcagttttcaaggggaaaaagtccattatttgggacattatttgatggtgtttccctctcacctaaaaagttaaaaactcttcaaaattttccttggcctgcaaccaaaagataattaagaggttttcttggacttgcaggatattttcttggacttgcaggatattttcttggacttgcaggatattttcttggacttgcaggatatattcttacacttgcaggatataaaattcctgggttctgaatttttccttaatagcctcaccgttgtatgagctcactaaaaaatgctgtaccagagcctttaccttgggatgatagtcatgagcaagcttttagctaaataaaattggccttataacagcctccagctttaggacttccaaattgcactaaactgtttacctaattggcttatgaaagtaataatcaggcatttaggagttcttacccaggaacatggggagaaacataggcccattgcatattatagcctgcaattagacccagtagctaaggtatatcctaactgtttaaaagcagtagcagcagcaaccaggctgaaagaagcttcagctgatgtggttttaggaaatgaacttaatatggaagtcccacatgctaaattccacccaaacccagcattttttagtaagtagactaacatcttatgaaatgctctgtctccctctaatctctatctaaaacactgcaatttacttaaccatgcccctgtattactgctgcctgatgatggtgaagaccacaattgcataagtgtagcatcagaaatagtggcccctcatgttgatttacaagttagtccattggacaatcctgagctaatacttttgttgatgggtcctatgccaaaagctcagaaggaaaatatcagctaggatatgctgttaccaaaatgagttaatagagaagggaatccttcctctattagtcagctctattagtctaagctctataagtcagcttaaccctcgaagatttttgccctcacccgagcttgtcatatagctaaagacaaaccggtaagtgtttagacagatagtagatacgctttaggagtagtacatgattttggcatgatagggaaactctaagggtttctcacttctagtgggatcaccatcaaaaaaggactccaattagataaaccactagattgctgttattgatcgaagctcatacctgcagaactgaacctgaatatcaagggaatgcttagcagatatttatgctaaatcagctagtactgaaactgttcagatatgcaacatgaacgaacttcgtaagattaatccaagccaactaccttacaatgacctatttaataaagaatgcaatgcacctcatttggaaaaacaaaactggtatctaaaaggatataaattcaatgttaagtgcaaacttgcagagggcctagatggctgcctggtctttcccgagtctttgaagcttccattgtcaaaagctttgaactccacaactcatcatggaacagaaaaattcatccaagttgtgaaaaaatacttgtgggatgactgttccaaaattgctagaatatttttttttttttgagatggggtctcactctgtcacccagggtggagtgcagtcgtgcgatcgtggctcactgcaccctccaccttcctggttcaagtgattctcctgcctcagtctcccgagtagctgggactacaggtatatgccaccacgcctggctaattttttttatttttagtagatatggggtttcaccatgttagccaggatggtctcgatctcctgacctcatgatccacctgcctcggcctcccaaagtgctgggattacaggtatgagccactgcacccagcctgctagaatattttataaccaatgttggctagtcaaacccatagtcctggaaaaacgaaagattcaggtggtgtattgtattttcaacacctaatggaccatttgaacaattatacatggacttcattcagttgccaccttcaatgtgggtctcagtatgttcttgtaatagtttccatgttttctggttggttagaggccttcctgtgtaggaaagctgatgctgtgacagtagctaagaaaatattagaaaatgtgttttctttatggagcatccctggaaaaatccccagcaatgggggaattcattttattaggcaagttataaagcagttaaacaaggttttatggacacaatggtactaccattatccctagcacactcagtcttctgaaaaggttgaaaaaacaaatgacatattaaaactgaaattggcaaagttaactgaatcagttgggttgccttggccaaaggtactatcattggatttaatggcagtcagatccactcactaaaaaacagaagtggaccccttatgaaatagtcactagaaggcctatgccccagtagtaaaacctcttgcatctttctctctctgaaattctgatataagtaagtactgcaaggccattataccaagtgtgctttcaccagataaaggaagcttttcaagatccaccaattgaggataatcaaaccttccacagtctagaacctggagattctgtcttctggaaatgacatcagaggaaggctgctcttgacaactctttggaagggactgtgccgagttcttctcaacacctacactgcagtgaagcttcagggccttgaaacttgggtccacacctcacaactcaaaaggacctcttcagactcctggaactgtacatctgctagagactttaaggtaaagctgtctaaggaaaaatctccagagcagatgacattctagttgtggacagctttcccaagatcacagatgaagacttctgtatcatcatgaaagccttacatttttttcttttctcctcatttcctgttgccctaattctttctttttccctacagaaaaatccatgggaccataaccagtggatgcctttagcttgagcatctgctgtagcacagaaccagagtttgtggattattgggtttgttgtttattgccaaaaaaatataaggaaacaattccactaatgccagtgcctctccatgttcccaatgagagtcaccccaaaattccaagggaaggatggaaagctatccttgatattctgaacaccactgctacttgctttcctgcactcactaaaaagaacactttaacttttcctttttttttttttttctttttttgagacagtctcactctgttgccaaggttggagtgcagtggcctgatcttggctcactgcagcctccacctcccaggttcaagggattctcctgcctcagccacccaagtagctgggactacaggcgtgcaccaccgcatccagctgatttttgaattttttgtagagacagggttttgctatgctggccaggcttgtcttgaacctcctggcctcaagtgatctgccagccttggtttcccaaagttctgggattacaggcgtgagccaccacaccctgccttaactgtttcaattaataacctgatcattaccaaagtatagaaaaccaatccaagtgatgactgcaaaagatatattgtgctttcaggcatcatgtactcaagatttgggatttacctatgtgagtacaagtaattgcttgtataatgtcaccagattaaattcaacagggtctctttttaccaaatgttttatatacccttacaacatgctataagaggggcacaaaaaggtcaatttctcaatggattttgttcagcagctatgcagatttattaatgaacaaatctaactgaaccctgctcaaatgcaactaggtagccctgtttttcaactcccaaggacctattttgggtctgtggataatctgcatatttcattctgcctcttcgttggctcagatcttgctatttggtctggctcactcctgcctttcaaatagtttcacctaaaaattctcctaacagctcttatgattggaggccaaaatagtcaataactgaaattagcactagctttgaaatagacaaagataagctagtttccactgaggaaagattccagtggggttcctgggggctcactcttggtggtagtgggatactagttgtatggaatccaaagctaatccatatgtggggtcttggattttatagccaatcaaacatcccagtgtttcagacaggtagacactactctccaaaaggtagatgtggcctggtgcaatggctcatgcctgtaatcccagcactttgggaggccaaggcaggtggatcgcctgaggtcaggagttcgagaccagcctgcccaccatggtgaaaccctgtctctactaagtacaaaaaattagccaggcatggtggcacgtgcctgtagtcccagctacttgggaggctgaggcaggagaattgcttgaacccaggagtcacaggttgcagtgagctgagatcaccccactgcactccagcctgggtgacagagcaagaccctgtctcaagaaaaaaaaaaaaaaaaaaaaacaagaggtagatgttacagttaatggaacatcatacagcttcatatctcctttttactcaagctggggcctgtgtttggtgttgaacaaaatagaatgctgcagttatctctctcctgattttgttactacagaaagcttaatgtaaaggtggctgatactgctgtttccttagacactgacaccaaatacaataaagaagtctctcaagaggaaaacatggtgtgtttacaggagcaactaacagttggtttgtaggcatcctaaatggtggatggcaagcttgggtttcccaaaggtttctagtctttatatgtcttctagtaggtgtccaggttagtatggcttgtgttaccagagcaacaatgaaaatggctacatctttaaatcaggccactttacagtgaactatgatccttaattgctaccacatttcaaacaagaactatgaccaattaaactttactgttgttgaactgcctatgttgcctgaactttgactggtttaagttggtttcatttatttaataagaacacttgttaaggagtgcatcttggtattttgatattattctcttgatagtcataataatagttccctagtgtgctgcatcctctcaagtcttaaatgttttgtatgcagccatacattgagaattgaatggtctcactttgactaggtcagcaagaacatagagaatcattcacctagtgtgaagctgtgacttgtgaacttcatagtgacaccagtaaagacttgtgaactggctgggcatggttgctcacgcctgtaatcccacacttttagaggccaaggcgggcggatcatgaggtcaggagatcaagaccatcctggctaacatggtgaaaccccgtctctactaaaaatatacagaaaaattagctgagcgtggtgatgggcacctgtagtcccagctacttgggaggctgaggcaggagaatggcgtgaacccaggaggcggagctacagtaagccaagatcatgccactgcactccagcctggtgacaaagcgagactttgactcagaaaaaaaaaaaaaaaaaagacttgtgaactccatactgagactaaaaagacttgtgaattccatactgagccaaattacaatagtgagagggtggcatcaatgcctaaagtttcggtctatctctctaaattgagagtctgaccaaaaggggggagttgataaatgaaactcaaatctggcctgaggacgccttcacattcccatatttgagttcttaagggcgaaccgtaacgtagttagtaggtaggcagactgaaaacttaacttaggaggatgcttctttagcaatagctgagtctcagccaatcccactggccatatttcaaccactcacaggcagccaactattcgaatcatgctcagataaggtaaacaccaagctgtaaacaatctggctgtttctgtacctcacttccattttctgtatgtcactttcctttttctgtccacaaatttgctttgacagcacagcatccctggtgtctgtctgtatctgctgtgattctgagggctgcccgatttgcaaattattcatttttcttgctcagttaaactctgtgaaatgtaatttgtctaatggatttcttttaacagcacttataattaaaatggaaagagggtgtaaatatttagaaaacttgcagcctggccatgtgatagacaaggaggaatccaagcagcctgctgagcaactatttgctagagacattagcatatctaaaagggagccaggtgctaatattcaagacagtgggaaaaggcctcagaggcatttcagaaggcctctcctatcacaggcccacaggcctaggaggactgaatggtttcagagaccaggcccagggcaccattgctgtatgtcacctcaggatgctacttcccacatcctagcttctccagctccagctttggctcaaagggcccccggtgcagctcagaccacttctttggagggtacaagccctaagccttgggagcttccatatggttgtttttttttctttttttgagacaatcttgccatgtcacccagtctggaatgtaacggtgcgatcttgactcactgcaacctctgactccagggttcaagcgattctgctgcctcagtatcccaagtatctgggattgcaggcatgcaccatcatgcccagctaattttgtatttttagtagagatggggtttcacagtgttggtcaggctggtctgcaactcctgacctcaggtgatccacgtgtgtcagcctcccagagtactggaattacatgtgtgagccaccatgcccagccttccatatggttttaggtctgcaggcttgcagaacgcaagagtgaaggaggcttgggagcttccacctagatttcagaggatgtatcaaaaagtctgggtgccctgacagaagcctgccacaggggcagaaacccacagagaacctctacaaggacagagccatgggaaaacatagggttggaaccccatacagagtccccactgggacattgcctagtggagctgtgggaatggggccaatgccctccagacagcagaaaggtagagtcaccagcagcttgcaacctcagcgtggaagacccacaggcattcaatcccaacctgtgagagcagccatgtgggctgcacccagcaaagccatagagacagggctgctcaaggccttgaaaggccactccactcaccagtatggagttacggaagatgattttggaagtttcagatttagtgtttgccctgctgggtttcagacatgtgtggggcctcttgcctctttcttttggccaacttctcccttttggaatgggaatgcctacccaatacctgtaacacaattatatcttggaagtatgtaacttgtttttgatataacagcctcataggtggaaggaatttgccttgaggctcagatgaaactatggattctggacttctgagttgatgctggaacaagctgagacattggagaactatcaggaagggatggtttcattttgcaatgtgagatgacatgagatttgggggtaaggggcagaccaatatagtttagatgtttgttctctccaaatcatatgttgaaatatgacccccaatgttagaggtggggcatagtgggaggtgtttcgctcataggggtggattcctcatgaatgggttggtgctttgtccatgataatgaatgagttctggctctattagttcacatgtaagctggttgtttgaaagcacctagcatctctcttgtgtgctgtctcgccatgtgacacatctgctcccccttcagcttccaacatgagtaaaagattcctgaggccctcaccagaagcagatgcctgcactgtgctttttgtacagcctgcaaaaccatgaaccaaatacacctcttttccttataaattacccagtctcaggtattctgttatgatcccctggaagagttatactacttccaggtctagcccatggtaaatcccacactcccctctgaggccaccttcttccctctgcagagaccctggagttagagtggattggttgtgtctctggccccaattcttctcccgaggctgcattccacccttttgctatgtgactttgcagcccttctcactgcagagacaggttcctctccttgagtttggggaagatgcaacacatgcaggggtttgaaaacacatttgtttgtttctgcttttgtttttgctcctctgcaatttccttgaaaccatgcctgaggtagcctgtgggaaaacgaaacagcaccattgacctagtctttcagccaatcccactgcatttgtacaatgcagtctgacaccagaggaactgcccagccaagctcaggcaaaattgctgacttcagactcatgaactaaataaatatttgtttcatttggtggttgttcttatgcaacattatgctggcactagaaaaatgaaacagatgggaatcaaaaagactgaatgaagcagaaacccagaagctaccccacaagcaatcacatgggactcagatgtgaatggacaataagcttttattgcattgaaaggtcattgcagtgaaaggttggggattgcttgctgctacagctgaatggattctattctgaccaatacacacagaaagagatcacagactccctaccttagaagaagggaggtggtagatgaaatgaactgtatgaagagccactagcctggcccacacacagaagaaggactggcccgtcttcttgaagcccatgctctggtagagggccatagcagagagctggatggtgccggtgtccaggataacttcactgtagccctggtcccgggcaaactggaggacagtcctgaccagggcttttgctatcccctgacgacggtgctcactgtccacaaagagatgaaacagctgcaaccgcttctccctcaaggtgggatcatcaacaggcagagctcctaccatgcccaccaccttctcttcagactcagccacccagaagcaggagccacgctcactcaggtaggatttggtaatgtcagacatgtctgtgcacaatgtcatgtccacatactccgtccagggttttttggcaaggaaccacagggcagggaagaggctgatgctgaacacgagggctagaagccaggatccagagaccaggagtagggcgaggggccccccaagtaagagtatgagggttcgaggcagcttcagcaattgccggaaggtggctggggcatgctcggccatcccccgggagagcaagcccacaacccactggcggtcgctctcctggtatttgcggatgtgacaaggagccatggacagacttctgtgtctgaaatctctaagtccaggagacagagctaggcctccctgcacgcctttacgtcagactggggaagagagagaaaatcatgtgagtgcctgcatggctcccagccttgcaggaacagggagacctgctcaagggtgtgtctttccgcgtttgcccatgaggaagcaggcctctgccactgggagaaggtagggtcagaaagacctgcattggaatctggttccatccctttctagctgtgtgaccttaggcatgtcacttaacctctctgagcctccatttcttcaactatagaacaggggagaagaaaacctgccttctagagttgttttgaagattgaataagatgccttctataaagccctggtagatgaactacccaccgctcttcctttttctgtttcctttttctggctctctcagcttctccgtgcattgagggggcacctacctcaggcaggccacacgtgcaacccttttgtccttctccagggaccatacatcgcaaaaattctctgtccaacacaagtttcaggaaaggctccctccagctttattgtaagtttttaggttgctgaagtggcataagagccaagcataaaaaacagcccagcctccagatcccaaggaaggtgcatgctcagagcactgtccttccacccagtcccctcacctgtcaccacaagagccttgagtgtccagggagcttcagctctcagccgctcactggcatccaggagataccgtctggggcttgctcacccctggaaagtagactgcctgccttattgcttggctcctgaatgtttggtaatcatcaaccctagggtcaaagagctgggctgtaacacagcagggagcccagtgtgcattcctctttgtggtcaaagggaacgacctggagggggagactcagggtctggaaccgcctgggttccttgcccttctggaaggcctgccacctctcttgcctgttcaggccccgtgcatctctctgccacctggcacacttagtactctcggtccctgtccacatatacgatccaccctggtccttgtacacatatacgacgagcctgagaactgtaccattcaccctgcaatcagtcaccattggccagaagccgagtccccatgcttggcaacaaggcccttcccagctaggcttctcctcgctgaggtttccctggtccacgaagcatctgttgttggcagttccttgcactcacctcaccaacccccatctccacccattcattgattcagtcaacagttgtgtgtcatgcacttcctgtgtcctggggtcatttcagccatgagcaaggttgacattcggcttgacaggcatggctgtgtgtggcttgtgtgtgttctggctgttggtcagaggctgtgccacacccgttgttaaatattttgcactgcagatgttggggaggcccaaattcatgctcttgtacccgacgtggagctgatcccaaacactgacacatgggtgcttggagatagagaaagttgtattcgatttggccaaagcaagaaggcaggagagcaagatctctcaacttcagttcaacaaagaagcagcagcagaatgtttttatgcagctagagagtgaggaagggggagttcagggggattgagaggaaaagtctgtgtttcctcagtctgagataacaccttgtgcaaccaggcttctcagtgtcagcagctggtcacagtgtccttcaaggcattcattcattctgcaaacttttcctgaccctgaaggaatgtcttcctgctgaacaaagaaacagtacatgagcagtttatcattatgttgtgggaacaaggaatattggaccaaaagcaagtggttaacatgtgcaagccagcaacggtctgatcagaatgttcattatttcagtcactaaaacatggtgtggtgctgaaatctcaaggggcccaattacaaggatgcaacatatacaagataggcaaaagcaaaacctaacagaaaaagcccttttccacaccaacttacatgctattgaagggaaacttcccttccaaagattagctaacctattgatgatcagccacgctgggcccgtcatctaggttaggtagtttggactctattccaagagcaaggggaggacattgatatgcacggaggggaggaggtgtgtgtgtgtgtgtgtgtgcgcacgcaagcatcactctggctgcaggtggacaatggatctgaggaggtaggaatggaagcagctacccctcaaggctcatgccacatccaggcaagagcggggcctccagtacagggatgcaggtgctcactgtacaagagcagctggcccagaggctctggtgggagctaaaactgggcctccctctggttgccaagccatgagccatggcacgaaactgagactggccaaaggaaaaggcaaccttttcttatttgctcaaaggcgttgcttgcctgctaaactctgcatccagtgggctgcatggcttgaggctgtgcctagctctgggttcacaaagaagccgcctgggttagcagaggcccatgagacagcagtggcttcaccagagggaggaagtcaagaaggtgagacatgagccgtatggaggtgcatttggggcagaaatggcaggagttggaatgattcacacagggaggaggatgaggaagggctcagagacgacagccaggcttctggtaggggcattcaggaaaacactggagagagcccagatctggaaaagtcaaggcttcccctaaaggtgctgccctgcagccttcttcagcagaaaccagaagctgggagtcagcagcaggaacccagggccagccagtggaggctgctgagattccagatctttggtacccaacaccacctccgaggaaaagtctaaggagcatcaagtctgggcaggaagtccatggctcatctttagagtgttctcgcaacatttcagtgtcaagcaggagttggcctaggaatcaaaagaggtgagcggtggctccaaagcaccactgagtacttctagtgtgagtctaaccaatattcagtcagaaacctgccggtcacgtggagggggagaggtttgtgctccgtccctgtgtgctgtctctccctccatgctcacccgtggctgtggcttcctcaaaacacagcgacctcacttgacattcaggcgtctcttgctcccaggatttactgtgacttctgcatttttgtagctttcctgataaaagcctgggctttccttgtcggacctgaaagattcatttattcattcaacaaacagtggccgaaggcttgttatgtgctgtgcctggacttggcatgaaggcaccagatgtcagaagcgaggctgctgcccaggaggacacacctgatggggctctgggaccaggacgatggtggagacatcacatccggaataactttgttaggaaggtgaacttgacagttaggacttagttctccttgaagacgtccttcacatcccttgtgagttggattcctaggtattttattctctttgaagcaattgtgaatgggagttcactcatgatttggctctctgtcttttattggtgtacttgtgatttttgcacattgattttgtatcctgagactttgctgaatttgcttgtcagcttaacgagatttttgggctgggatgatggagtttcttttgtgggcatttagtgctataaatttccctctacacactgctttaaatgtgtcccagagattctggtctttgttctcattggtttcaaagaacatctttatttctgccttcatttcattatgtacccagtagtcattcaggagcaggttcagtttccatgtagctgagtggttttgagtgagtttcttaatcctgagttctagtttgactgcaatgtggtctgagagacagtttgttgtaatttctgttcttttacatttgctgaggagtgctttacttccacctatgtggtcaattttggaataagtgcgatgtggtgctgagaagaatgtatattctgttgatttggggtggagacttctgtagatgtctattaggtctgcttggtgcagagctgagttcaattcctggatagccttgttaactttctgtctcgttgatctgtctaaagttgacagtggggtgttaaagtctcccattattattgtggtgggagtttaagtctctttgtaggtctctaaggacttgctttatgaatctgggtgctcctgtattgggtgcatatgtatttaggatagtgagctcttcttgttgaattgatccctttacctttatgtaatggccttctttgtctcttttgatctttgttggtttaaagtctgttttatcagagactaggattgcaacccctgcctttttttgttttccatttgcttggtagatcttcctccatccctttgttttgagcctgtgtgtgtctctgcacgtgtaatgggtctcctgatggtcacactgatgggtcttgactctttatccaatttgccagtctgtgtcttttaattggagcattcagcccatttacatttaaggttaatattgttatgtgtgaatttgatcctgtcattatgatgttagctggttattttgctcattagttgatgaagtttcttcctagcatcgacggtctttacaatttggcatgtttttgcagtggctggtaccggttgttcccttccaggtttagtgcttccttcaggagctcttgtagggcaggcatggtggtgacaaaatctctcagcatttgcttgtctgtaaagaattttatttctccttcacttacgaagcttagtttggctggatatgaaattctgggttgaaaattcttttctttaagaatgttgaatactggcccccactctcttctggattggagtttctgccaagagatcagctgttagtctgatgggcttccctttgtgggtaacccgacctttctctctggctgcccttaacattttgtccttcatttcaactttggtgaatctgacaattatgtgtcttggagttgctcttctcgaggagtatctttgtggcgttctctgtatttcctgaatttgaatgttggcctgccttgctaggttggggaagttctcctggataatatcctgcagagtattttccaacttggttccattctcctcatcactttcaggtacacaaattagatgtagatttggtcttttcacatagtctcatatttcttggaggctttgtttgtttctttttactcttttttctctaaacttctcttctcgcttcatttcattcatttgatcttcaatcactgataccctttcttccagttgatcgaattggctactgaggcttgtgcatttatcacatagttctcatgccatggttttcagctccatcaggtcatttaaggacttctctaccctggttattctagttagccattcgtctaatcttttttcaaactttttagcttctttgcgatgggtttgaactttctgctttagcttcgaaaagtttgattgtctgaagccttcttgtctcaactcgtcaaagtcattctctgtccagctttgttccgttgctggcaaggaggtgtgttcctttggagcgggagaggcgctctgattgttagaatttttagcttttctgctctggtttctccccatctttgtggttttatctacatttggtctttgatgatggtgatgtacagatggggttttggtgtggaggtcctttctgtttgttagttttccttctaacagtcaggaccctcagctgcaggtctgttggagtttgctggagctccactccagaccctgtttgtctgggtatcagcagcggaggctgcagaacagggaatattgctgaacagcaaatgttgctgcctgatcattcctctggaagctttgtctccgaggggtacccagccgtgcgaggtgtcagtctgcccctcctgggggatgcctcccagttagggtactcgggggtcagggacccacttgaggaggcagtctgtccattctcagatctcaaactccatgctgggagaaccactactctcttcaaagctgtcagacagggacatttaagtctgcagaggtttctgctgccttttgttcagctatgccctgcccccagtggtggagtctacagaggcaggcaggcctccttgagctgcggtaggctccacccagttcgtgcttcctggctgctttgtttacctactcaagcctcagcaatgatgggcgcccctctcccagcctcgctgccaccttgcagttcgatctcagactgctgtgctagcaaaaagcgaggcactgtgggcgtgggaccctccaagccaggcgcgggatataatctcctggtgtagtgtttgctaagaccattggaaaagcgcagtattggggtggaagtgatctgattttccaggtgctgtctgttacagcttcccttggctaggaaagggaattccctgaccccttgcacttcctgggtgaggcgatgccttgccctgcttcggctcatgctcagtgggctgcacccactgtcctgcacccactgtctgacaagtcccagtgagatgaacctggtacctcagttggaaatgcagaaatcacccgtcttctgcgtcgcttatgctgggaactgtagactggagctgttcctattcgctcatcttggaactgcccaacactccatccttatctataacccagcattcttctataccccatagaaagcaccccttacactcggacatgcacaggaaggaagctgctaattggagggaagactcactcacactgtccccaggctccactccaaaggtggccagtgcagctctttcacctccattacctccaagtggtgctgtcactcacagtaagcccagaagagcagtctgacctccacatagagccccctcatttccactcctcactgctggctgctggctccacggaccctctaaaaccacccttggtaagatcaccaggggtttcctaactgccaagtaccagtaatgctttatagtcctcaaacatgctgaacgctaagggagttcctgcattcataaagctgcttgcggtacctgggtgctatggtctgaatatgtcccccctaaactcctatgctgaaacctcatccccaaggtgatggtattcagaggtgggatcttgggaggtgattaggtcgtgaggatgaagtcttcacctatgggatcagtgcccttacagaaagacccaaaggagcttgtttgccccttccgccatatgaggatacacaaaaaccgccatttatgaggaacaggtcctcaccagacataaatctactggcactttgatcttggattcccagccttcagagctatgagaaataaatttctgtttacaagctaaatgtaaagtgtttaccagtttatgataattgtgttataacagaccgtatgaactaaggcactggagtcagtccaagagcttagatgtaagggaaataagatcagagcagagatgtgcaagagactggctcctagcagagcaactaagagtcaggcaaataatgtcaactgaggaggcttctgggtccagcagccacccagctgctttaacacatggctcttcatttcctatccccttctctcctggtctgtctttccctctttgatggttctttttcaagctttcattttgagtgttcctcaaatggaagttttcctcaaaacagaaaagttcatatttccttcctaataattaataggaaaaaaatgccaaatggatagaatggactccggataagaatggagaattttttaaagaagaagcaaatatggtttatgaatatattttaaaactgtgcaaaaaagaatatacaaaaaaactcactagaaatcaaataaataaaaatcaaattaatatccaggttttacctatcattgtaaagaattaaaagaatggtatgagctaatataggacaagcacaaagaaatgtgcagacacacacacttttgacggaatactgaaatgggagatccatgctggagaatcattacacagcatgtcaaaatcctttttttaaatcaaaacagagtctcgctccattgctcaggccagagcgcagtggcagagtcataactcactgtaacctcaagcttacaggttcaagtgagcctcggcccttgtcctcctctcaagtagctgggcctacaggcacccaccaccacatctggctaattaaaaaaaaagttttttttagagacggggtcctgctatattgcccaggctggtccctaatccttgggctcaagcagtcttcccacctcagcctcccaaagcactgagatttcaggagtgagccaccctgctcgacctcaaagtcctttgaaaagacttgatcgaaattcaacttctagggttagagctcaagaaagtaactggtcaaatgtgcaaagatgtttgcataaggatgtttatcactgtaaagtttattgtcatagaagcaaccgaaagtgcaacaagaggggactggctgaataaatcctgctctatttctgtagcacagtacctcacagccatgaccaatgctgatgagggtttactgacatgaaaaacattgcccaactatagcaccaagcaagaaaagattataaaacaatatgtttggatttatttttggaaaaatggtattgaaaaatgatatccacaaacaagcatgcagagagaaaagtctgagtggttccaccaaatgttggtagcagttacctctgaaaagaggaattgtgggggattctctgcataaaagataaactctgaaggtctttgcacattctaggcacttggccctgctttcagacagtgaaactgaatcttgggagtctaaagggactcagttatgattgtgagctcctaaaggtaagacccgtgttcggttttattttattatttcaattaatcctattaatgtgcacaattcagtggcatttagtacattcacaatattgtgcaacgaccacccctttcttgttccaaatcatttttatcaccgcaaaaggaaattccttattcattaagtggttcccccttatttccctctctccccagtccctggcaacctaatctgctttctgtctctatggatttatttattgtggatacttcatataaatggaattgtacaatatctgaccttttatgtgtggcttctttcagctgatgttttcaaaattcattcgtattgcatcatgcatcagtacttcattcctttttagggctcaataatattccatgtatgtttatactgcactttgtttatccattcattcattgatggacattaaggttgtttctacgttttggttattgtgaatggtgctgctgtgaacattcaggtacaagcagttatttgaatacctattatcaattctttcgatgtatacctaggagcaaaattgctggttcatattttaatcctgtttaacattttgaggaaatgccaaactgtcttccaaagtgtcagctgtagtttactttcccaccagcagtgaaccttattttactccactgcctgcctcagcactactgcctagaacataaagggaagaagcaatagctgtttttttaccaagaagttattagatgcccagcactgtgagaaagagggcttcccatgttgtgcaatttcatgttaacagccttggagctaaggttggtattattaacatccccatttggcaaatgggaaactgaggtccagaaacctgaggtttcctctccacggccccatatgggaagtgaaagctcaaacctaaggtagctctgactccaaagcctgcactgttttactttttcagtacagcatgctgaccctgcaggcagggatttgacaagtgtttagtgagtctgaaattcacataaagcctcacaagcccagagaagcagctctgtgtggaggcgcataagattcaccagtaaggccccatcacccccatcctgttgccagtggtcaggacacccttgaccaaattcccatatgtgactaaggctctgttccttcttcaagatccagtttagtgctacctgctccgtccacttctgaccacccaaccagatgaatctggtcccagtccctccctccttggaagcctttgcatttctcattaagcacttgtattgctgccatttgttgcttacttaataattaacttatcatagttaattagactagaaattaacagttcaactaccctgataaactattttgtctttctattgcctctatgaacctgattataataaatcattgtattgttggagtcactgttattcccagagctgtcaggtttcagagcagcgtgtcagtgccaccccatgcctgcatccgggaagatcactcctccactggaccagcccagcctggaaaggggccagtgaggcggaaggtggacaatccagggccaatacattctgggagtctcagaggaagagaaaaatcgattcagactcatttaacataggctcctggaaaggatatcatctcccccaatctctcatcaataacccaacatcagatcagtgccctggacttatcatatgaagcagaatgaaagtagacagataggtcatccttggttagatgtccagaaatccgaggatggtggtcctagctcttcagagaggacacgttctttaacctaaccttttaacaaattctctacagaagatatcaggtcccaacatttcaagtagcttcgtagatataggtaatcaaaggactaattatgaaagtgtagatgggtagaggggagcaacaaggatggcacaggaacccatagccctgaggaggagggagagttgttggaacctgaaaggacctgggcagagcaggctgcccttagagcaggcctggggccaaggcacaatcaataccaagcctgcctcacgctctcttccctccactcctcaacttgctgctggctttcagaaaagttaagaacttgccatttctacccctttgccattgttgttgtcttaccataaggcggggagcaatatagtatccagttttctagatatggaagtggaaatcaggtgtatatacccagtatattagtacctattagtattcttattggtattactttctagatgttatgtaactgtagctttggattttctatttaattcaaaagacatataagagttttttttttgctaattccatgttggatttattgtcactacttattaagttataattttaatgtattgtgattagagattgtactgtgttctatttgtgttttaaggatacatagagattttctttgtggctaaatataagtaatccatgggtgttttaaagaaggtagagtttccaaatagagtatgacattccagtcactgtcagattccacacaacatttcagtcagccacagaacatataaatgatagcagtcccatgagattaaaatagtatatttttcctacaccttttctttatgtagatattttagatacacaaatacttaccactgtgttaaaattacctacaatagtcagtagagtaacatgctgtacaggtttgtagcctaggagcaataggctataccttatagcctagatgtgtagtaggctgtaccatctaggtttgagtaagcatacgctgtgatgttcacacaacaatgaaatcacctaacaatgcatttcttaatatacatctattaaatcattttattaattaaattatattcttcctgaatattgattttcttaatctgtcgagaacttcaaagagtatattttaagttaattgaatatagcttttgttaattgaatggttttatatatatatatatatatatattttttttttttttttttttttttttttttgagaaggaatctgcctctgtcacccaggttggagggcagtggcgtgatctcgacttactgcaacctctgcctcctggattcaaacgattctcctgccacagcctcctgagtatcttggactataggtgtgcaccaccacacccggctaagttttgtatttttagtagagatggggtttcaccatgttggccaggatggtctcaaactcctgacctcaagcgttccacccacctcggcttcccaaagtgctgagattacaggcatgagccacagcacccggcctggttatatatatttttattttcggcacataaatattaatgacatgaatattaatgacacttttttcactgtgaatcataccataaatcatataaagtaacttttattttacattttgaatatgttttgccttttattctacttcatccaatacagttttattaaatgtggatttgtaccattgctctttgtccatccttttacttttggcttttctgagtcacttcactcaagtggaagtagcacctacttgaatttaacttttttcccccacccaatttgaaggtctttttttgaagtgagttcaacttaagttcattgttgtaacaaatatgtttggtttaaattttatcatttccctttttgtttttttttccttttctggtaaacttattaagttaatgtttgttaaactaaattccatttcaaacggtgggaaggagtaaaaaacacctaacataaagtttaccatcttaagcattcttaagtgtacaggtcagtaatgttaaatatattcacattgttgtgagacagatctccagaacatttgaatattgcaaacctgaaactctatacccattgaataacaacttcccttgtcctcctcccccagcttctggtaaccaccattctactttctgtctctgtgaatttgtcgataccaagtttggaagataagaaatatcttttaattcctgattttgtgtgataagagaaataaaatatctaccctttagtgactgactcatttcacttagcataagatccttaagattcatccatgttgtagcatgtgacaggatttcctccctttttaagtcaggataattttccgtgggttgtgtgtgccacatttatgtatccattcctcagtggatgggcatctgtgttgcttccacatttgcctattgtgagttgtgctgctgtgagcatgggtatgctgttagctttttaagtccctgcttactgtgcttttggagacatactcagaagagggattactgaatcaaatggtagttctaagtttcacctttggaggaatctcaatactgatttccagagcagttgtgccattttacattgccaccaacagcacacatgagacccattttatctacatcctcaccaatacttgttattttcttttttttttataatgaccgtcctagtgggtgtgaggtgatatttcattgttgttttgatttgcattgctctgatgattggcgatatagagcatcttttcacatgcttgttggccatttgtatatcaactttggagaaatgtctattcaattcctttgcccatttttggtcaggttattgattttgttgtcattgttgaattctgagagttatttgtgtattctgtatatcagaatcatgagttgcaaatattttctcccaatccgtaggttgtcttttactctgttgaatgcatcccctgaggcacaacttaagcctggtggtcccatttgtctatttttgcttttgttgcctgtgcttttggtgtcatattcaagaaagcactgccatattcaatgtcacaaagcctttcctctatgttttcttccaagactttgatagttttaggccttacacataggtctttaatccattttgagttaatttttttacataagactagagtccaacttcattcttttgcatgtgaatgtccaggtttccaagcatcatttgtgaaaaatctgttcttttcccattgagtggtcttggcacccttgtcaaaaatcattttggccagggacagtggctcacacctgtaatcccagcaatttgggaggccgaggtgggtggatcacctgaggtaaggagttcaagaccagcctggccaacatggtgaaaccctgtctctactaaaaatacaaaaaattagctgggtgtggtggcgcacatctgtagtcctagctactcaggaggctgagacaggagaatcacttgaacccaggaggcagaggttgcagagagccaagatcgtgccactgcactccagcctgggcgacagagcaagaccttgcctcaaaaaaaaaaaaaaaatcatttgaccatatgtgagagtttatttgtaggcactttatcatatttcgttggtctattcgtctgtctttatgctactatcacactattttgattattgcacctttggtaatatgtttgggttttcggttgttgttgattattttggtttgtttgttttttgtagagatggggtctcactgtgtttcccagtctgatatcaaatttctgggctcaagtgatcccccagtcttggtctccagaagtcctgagattacaggtctgagacgccgtgcccagccagtaatatgttttaaaatcaggaaatgtgagtcctccaacattgttgttctctttcaaaattgttttggctgttcaggatgtcttatgatttttactgatttcttgccatttccaatcttttttgttcattactatgtaatatatgcttcttattttattttatttttggagattgagtctcgctctgttacccaggctggagtacaggggcatgatcttggctcactgcaacctccacctcccgggttcaagctattctcttgcctcagcctcctgagtagctgggattacaggcatgtgccaccatgcccggctaatttttgtatttttagtagagatggggtttcaccatggtggtcaggctggtcttgaactcctgacctcgtgatctgcctgcctcagcctcccaaagtgctgggattacaggcgtgagccaccatgcccggccataatatatgtttctttgagctgtttttctgataacttagcggccatgtaatctaattaactaatatccttcaaccactttctcaatctatcactctcagacacgaaacagtatctgttgactctatcatatgaaaaattaagaaagtgactgcacttctccccacctgtgcccccacatacagacattcccccaactaaccaataatggttatattttgtggattttgtgtcagctcattgtagtagtattactacattgactagctttacttattcgtggattcttgtaggtttttaagattttatactatgcagccataaaaaatgatgagttcatgtcctttttagggacatggatgaaattggaaatcatcattctcagtaaactatcgcaagaacaagaaaccaaacaccgcatattctcactcataggtgggaattgaacaatgagatcacatggacacaggaaggggaatatcacactctggggactgttgtggggtggggggaggggggaggggtagcattgggagatatacctaatgctagatgacgagttagtgggtgcagcgcaccagcatggcacatgtatacatatgtaactaacctgcacaatgtgcacatgtaccctaaaacttaaagtataattaaaaaaaaattgaacaaaataaaaaaaaaagattttaagtctagttacttttctagggtatgtctcaatgtaggtcaagctctgtttttttattaattgagataaaattcacattccatacaattcttttttagtatataattcagcatgtttttgtatattcagaaagttatacatccttcacccctaattcctgaacatttttgtctccccaaaaagaaaccgtgtgcccattagcagttacctcccattacccttgttcttgcacccccgcctcgccctggcaaccactaatctactttctgtctctatgggtttgcctatatgagacattccacataaatggaattgtaaaatatgtggctttttgtatctagcttctttgacttaacatgatatttttaaggttgtagcgtatatcagtacttcattttttggtttgcagaataaaatccgttacgtggatttacaacattttatttatatattcatgaatggatggatacttgggttgtttgtacttttttactttcacaaataatgctgttataaattgttatagattgtgtacacgtttttgtgtggacataattttttcagttctcttggatatatacgtaggagtagaacagctgggtcatatggtaactctctgtttaacctttgagtaactccccaactgttttccaaagtggctgtgccgcgttatatttccaccaggatcatattagggtttcagtatttccacgtcctcgtcaataattgttattttctgatttttgattataaccatcctaatgagtgtgaagtgtcatctcattgtggttttgatttgcatttctctaatgactaataatgagaagcacctttttaagtgcctattagccatttgaatatcttctttgcagaaatttctattcagatcctatgctcatgtttaaattggcttatttttgttcttttattattgggttcgacgtgttctccatatattctgaacagcagtcccttattcactatgtaatttgaaaacatgtctcccattctttgggatgcttttcactttcgatggtatcatttgcagtacaaaatttttagttttgacaaagtccaatttatctacttttgtcatttgtgtttttcatgttgtgtttaaaactattgcctaacccaacatcacacacaaaaaaagtttacttctttgcttttttctaagagtattataattttagctcttaaattagggtctatgatcattttttagctaatttttgtatgtaatgtgaggcaggggatacagtttcattttttgcatatggatatccagttgaccccgcaccatttgttgcagagactattctttcttccattaaattgtctggggtcctttgccaaaaattaattgaccataaatgtaagagtttatttctagactcttaattctatttcattgatccatatgtctctgcaaatgccaccaccacaccgtcttgttgtggtgttcttgtggtaaattttgatgtgtgagtcctccaactttgtttttcttttataaaattgctttagctatttatgggttctgtgaactttaagatcagcttgccagtctctgaaaaaaaataaaaggcagcatgaatcttggtagggatgtcattgaatctatagttggaattggggagtactgacatcttaaaaatattaagacttctaatctatgaacatgggatctattcccatttagttaagtcttctttcatttctttcaacaatgtttatagtttttacttctttgcagttcggcacatctgtcattaaatgtatttctatatattttcttctttctaatgccattgtaaatgaatttgttttcctaatttcatttctaggttgtttactgctagtgtatagaaatacaactgatttttcttacattgatcatagattgtacaagcttgctgaacttgtttatcagctctaataatttgtgtgtgtatatgtgtgccttaggattttctatatagaataccatgtcatcttcaaatagagatggtttttctttctaatcttatgctattttttctttttctttgctgattgcctttgtttgaacctccagaactatgttgaatagaagtggcaagaatggatgtccttgtcttgttcctaatcttaaaagggaaagcttgacagtcattaagcataatatgagggatgagttatttgtagatgccctttaacaggttgaggaagttcccttccattcctagtttgttgagtgtttttaccatgaaagggttttttattttgccagaagccttttctatttctattgagctgattatatgttttccctttattctattaatatggtgcattatattgatttattcatatgataaaccaaccttgcattcctgagataaatcccacttggttttgatgtgtaatcccgtttctgtcttcttggattcagtgagctagtatttttgtagtattttacatctgtagtcacaagggatattggtctgcagttctgtgatatcttcgtctgcctttgatatcaggataatactggcctacatagaaggaatcaagaagtgatccttctgattatgttttttgtatgagattgtgaataattggtgttacctcttctttaaatatttggcagaacttatcagtgaagcttggtccaagctttacttttggagaagttttctgattattaactcagtcttttctcattataagcctactgagattttttatttcttcttgaatcgattttgatcatttctttatctagaaatttgtctacttaatctaggttgtctaatatcttggtatatgattgttcatagtatcccctcatccattcttaattttagtgatttgagtcttcggtttttccttggtgaatctagctaaagatttcagtttttgttgatgttttcaaagaccaaacttggtttctttaattttctcttgcattttcctaatctctgttttatttatttccattctaacatttagcatttccctccttctacttatttttgttttagttacatagaactttagttacgtagagctcatctttttctaattcctttttaaaataatttcaatttttattatagattaaaggacacatgtgcacatttattacatgggtatattgcttgacactgaggtttggggtataaataatcccatcacccaggtggtgagcatagtacccaatcggtggtttttcagcccattccctcctcctttcctcccatctagaagtcctcactttgtattattctcatctttatgtatattcagtgttcagctcccgcttgtaagtgagaacatgcagtatttggttttctgttcttgcattaattggcttaggataatggcctccagctccatccatgctgctgcaaagggcatgattttattttatttttatgtctgcacggtatttcgtggtgtatatacactacattttctttatccatccactgttggtggccacctaggttgatttcatgtctttgctattatgaatagtgcgggaaagagcatgtgagtacatgagattttttgacagaatgaattcttttccttcgaatatatacccagtagtgggatcgctgggttgaacagtggttctttttcagttctttgagaaatctcccaactgctttatacaatggctgaaccagtttgcattcctaccaacagtgtataagcattcccttttctctgcagccttgactgcatctgttattttttgactttttaataatcagaattctgactggtgtgagatgttatctcattgtggttttgatttgtatttctctgatgaatggtgatgttgagcattttttcatgtttgtcagctgcttgtacatctgcttttgagaagtgtcttcctgttctttgctccccctacttttttttttttttttttttttttgagaaagggtctcactctgtcacctaggcggtagtgcagtggcacgatcttggctcactgcaacctccgcctcccaggttcaagcaattcttgtgcctcagcctcctgagtagctgggattacagctaatttttaaatttttagtagagatgggatttcgccatattggccagctaattttttaaatttttagtagagatggggtttcgccatattggccaggctggtcttgaactcctggcctcaattgatcttcccaccttggcctcccaaagtgctgagattacaggtgtgagccaccgtgcccagcccctttgcccatttttacaaatggaattatttgatttttgctttttaaatttttacatttccttacagattctggacattagagatttgttggatgcataatttcctaatattttctcccattctgtgagttgtctcttgattgatcatttattttactgtacagaagctctttggtttaattaggtaccaatcatcaatttttttattttgttacaattgctattcaggacttagccataaactattttccaaagccaatattgagaagggtatttcctaggttttctgctaggatttttgtagtttgaggtcctccatttaaatctttaatgtaccttgatttttttaaatatagtgagaggtaagggtccagtttcttctgcatatggctagccagttatcccagcaccatttattgaatacagagttctttcttcattgcttatttttgccaattttttgaaggtcagatggttgtaggtgtgcaggtttatttctgagttctctactctgttccattggtctatttgtctgtttttgtaccggtaccatgctgttttggttactgtagccttacagtggagttttaagttgggtaatgtgatgcctttggctttggtgtttttgcttgggattgctttgactatttgggttcttgtttggttccaaatgaattttagaatacatttttctaattctgtgaaaaatgatatgctattttgatagggatagcattgaatctgtaaattgctttgggaagtgtggccattttaacaataatattgattcttctcatccataagcatggaatttttttccatttatttgtcatctctgatttcattcagcaatgttttatagttctccttgtagagatctttcacctccttgattaggtatttcattttttgtggttattgtaaatgggattgtgttcttcatttggttctcagctagaacgttactgatgtagagaaatgctactgattttgtatcctgaaactttaataatttgttcatcaggtccaggaggcttttggtggagtctttagggtattctatgtaactcatatcatcagcaaagagagatagtttgacatcttgttttcctatttggatgcctttcacttctttctcttccataattgctctggctcagactttcagtactagaagtggtgagaatgggcatccttgtcttgttccagttctcaaggggaatacttccaacttctgcctattcagtatgatgttggctctatgttagtcatagaaagctcttattattttgaggtgtgttccttcaatgccttgtctgttaagggtttttatcatgaaggggtgttggatttcatggaagatgttttgtgcatctaccaggctgctctggggtccaaggcctatggaggtcccttgtggacttgagtgttgcctccttatacactctgggcaggcagctccctgtatcagtctatatgcctgggggtcaggaggaatctcccatcccaggattgcacaggtccccgcaggaagtgtagatcccccaggggctctcactcactatggaaaccatttagttgcccatagtaatgtggttgaattctctttaactgccttatacatgtttataagttgctgtttgaatccccttcccaggacatgactggtaattgtgtgtggtttgtattaattttgttccttggagcttggagaagccagagagggagtaggtgattctaggactctgtgcaacctcctgaagtgacatttttctctgcgattgttttaaaactcacaaactgatggctgctttagcaattgcagggtaagggaaatacctagttctatgggacgtgcccttgaggttttgcttttgtacttctttaaggtggctgttggctgctttggtggcttcctagtgtacagtaatattgctgggcctgattttttttctagcaaatcttcataatgcagctaagctattcagatctaagagataattttctagacatttttctgatttctttctggctagaaggagtatatgattaatcttcattcaagctggggcagaaatgctgttttcttttttaaacagggttgcatgtctctagttgagaagtttatctcttaccttagtcaccttttctgtcaaaagtgggctatccgtagggtattttgaatgtaatgactcacctttcaccctctgtatgtatgatcctttgtggagaaagaactgtgtattagctctaaatttgtgatatgagttgagccccttctctggattctgaagattcttttcatgttttgtttgtttgtatatttcagtcatggaagaggagattcattatacctgtctatttcctaaaatccatcacctgttttctcagtgtttctctctctcctatttactcagcttctctgtatctataggctgcttcctcttcactggaaccatgctttagtcattcctcacatggactggggaggacaagtgtgacaggatggcttctgttgatgtttctactgccttacatctttctctttattaccaaatatgtaatcttttattaagtataaagataaaaggatagttaaatataaagagttcaacaacatagaaaataaaaaggccttgtaattcatccgtaattctccccatcctgaaatagtcctgattaacattttatatataatcttccagttttatattttatgattcacataccttgttttattttaaaaaatggaattataccaggtgatttgaaagtcttattttcaacttttgtttgttttgaaactgttcatttaatatatcataatagacatctttctgtgtgaaatacagatttatgtagtcttttttattgctttatgagttccattgtatacttatactgtttaattagttccctaataacagatatttaaatcatttaaaatatttcttttttattattattatactttaagttctagggtacatgtgtacaacgtgcaggtttgttacatatgtatacatgtgccatgttggtgtgctgcatccattaactggtcatttacattaggtatatctccgaatgctatccttcccccctccccccaccccacaacaggccccactgtgtgatgttccccatcctgtgtccaagtgttctcattgttcaattcccacctatgagtgacataggtgtttgtttttctatccttgcgatagtttgctcagaatgatggtttccagcttcatccatgtctctacaaaggacgtgaactcatccttttttatcactgcatagtattccatggtctatatgtgccacattttcttaatccagtctgtcattgatggacatttgggttggttccaggtctttgctattgtgagtagtgccacaataaatatacgtgtgcatgtgtcttgatagtagcatgatttataatcctttgggtatatacccagtaatgggatggctgggtcaaatggtatttctagttctagatccttgaggaatcaccacactgtcttccacaatggttgaactaatttacagtcccaacaacagtgtaaaagtgttcctatttctccatatcctctccagcacctgttgtttcctgactttttaatgatcaccattctaactgttgcgagatggtatctcattgtggttttgatttgcatttctctgatgggcagtgatgatgagcattttttcatgtgtctgttggctgcataaatgtcttcttttgggaagtgtctgttcatatccattgcctagttttgatggggttgtttgatttatttcttgtaaatttgtttacgttcgttgtagattctggatattagccctttgtcagatgggtagattgtaaaaattttctcccattctgtaggttgcctgttcactctgatggtggtttcttttgctctgcagaagctctttggtttaattagatcccatttgtctattttgtcttttgttgttattgcttttggtgttttagtcatgaagtccttgcccatgcccatgtcctgaatggtattgcctaggttttcttctagagtttttatggtggtaagtctgacatttaagtctttaatccatcttgaattaatttttgtataagctgtaaggaagggatccagtttcagctttctatatatgtctagccagttttcccagtaccatttattaaatagggaatcctttccccatttcttgtttttatcaggtttgtcaaaggtcagatggttgtagatgtgtggcattatttctgagggctctgttctgttccattggtctatatctctgttttggttaccagtaccatgctattttggttactgtagccttgtagtatagtttgaagtcaggtagcgtgatgcctccagctttgttcttttggcttaggattgtcttggcaatgcgggctcttttttgattccatatgaactttaaagtaggtttttccaattctacgaagaaagtcgttggtagcttgatggggatggtattgaatctataaattaccttgggcagtatggccattttcacaatattgattcttcctatccatgagcatggaatgttcttccatttgtttgtgtcctcttctatttcattgagcagtggtttgtagttccccttgaagaggtccttcacatcccttgtaagttggattcctaggtattttattctctttgaagcaattgtgaatgggagttcgctcatgatttggctctctgtttgtctgttattggtgtataggaacgcttgtgatttttgcacattgattttgtatcctgagactttgctgaagttgcttatcagcttaaggagatttggggctgaggcaatggagttttctaaatttacaatcatgtcatctgcaaacagggacaatttgacttcctcttttcctaattgaataccctttatttctttctcctgcctgattgccctggccagaacttccaacactgtgttgaataggagtggtgagagggcatctctgtcttgtgccagttttcaaagggaatgcttccagtttttgcccattcagtatgatattggctgtgtgtttgccataaacagctcttattattttgagatatgtcccatcaatacctagtttattgggagtttttaacatgaagggctgttgaattttgttgaaggccttttctgcatatattgagataatcatgtggtttttgtctttggttctgtgtatatgatggattacatttattgatttgcatatgttgaaccagccttgcatcccagggatgaagccaatgtgatcatggtggataagctttttgatgtgctgctggattcagttttccagtattttattgaggatttttgcatcaatgttcatcagggatattggtctaaaattctctttttttgttgtgtctctgccaggcctaggtatcaggatgatgctggccttgtaaaatgagttagggaggattccctctttttctgttgattggaatagtttcagaaggaatggtaccagctcctctttgtacctctgatagaattcaactgtgaatctgtctggtcctggactttttttggttgataggctattaattattgcctcattttcagagcctgttattggtctattcaaggattcaacttcttcctggtttagtcttgggagggtgtatgtgtccaggaatttatccatctcttctagattttctagtttatttacatagaggtgtttatagtattctccgatggtagtttgtatttctgtgggatcggtggtgatatgccctttatcattttttattgcatctatttgattcttctctcttttcttctttattagtcttgctagcggtctatcaattttgctgatcttttcaaaaaaccagctcctggattcattgatttttggaagggttttttgtgtctctatctccttcagttctgctctgatcttagttatttcttgccttctgctagcttttgaatgtatttgctgttgcttctctagtttttttaactgtgacattaggatgtcaattttagatctttcctgctttctcttgtgggcatttagtgctataaatttccctctacacactactttaaatgtgtcccagagattctggtatgttgtgtctttgttctcattggtttcaaagaacatctttatttctgccttcatttcgttatgtacccagtagtctttcagaagcaggttgttcagtttccatgtagttgagcggttttgagtgagcttcttaatcctgagttctaattgggttgcactgtggtctgagagacagtttgttatcatttctgttcttttacatttgctaaggagtgctttacttccacctatgtggtcaattttggaataagtgcgatgtggtgctgagaagactgtatattctgttgatttggggtggagagttctatagatgtctattaggtctgcttggtgcagagctgagttcaattcctggatatccttgttaactttctgtctcgttgatctgtctaatgttgacagtggggtgttaaattctccaattattattgtgtggaagtctaagtctctttgtaggtctctaaggacttgctttatgaatctgggtgctcctgtattgggtgcatatgtatttaggatagttagctcttcttgtttaattgattcttttaccatcatgtaatggccttctttgtctcttttgatctttgttggtttaaagtttgttttatcagagactaggattgcaacccctgcctttttttgttttccatttgcttggtagctcttcctccatgcctttattttgagcctatatgtgtctgtgcacatgagatgggtctcctgaatacagcatactgatgggtcttgactctttatccaatttgccagtctgtgtctttcaattggagcatttaggccatttacatttaaggctaatattgttatgtgtgaatttgatcctgtcattatgatattagctggttattttgctcgctagttgatggagtttcttcctagcattgatgttctttacaatttggcatacgtttgcagtggctggtaccggttgttcctttccatatttagtgcttccttcaggagctcttgtgagacaggcctggtggtgagaaaatctctcagcatttgtttgtctgtaaaggattttatttctccttcacttatgaagcttagtttggctggatatgaaattctaggttgaaaattcttttctttaagaatgttgaatattggcccccactcctttctggcttgtagagtttctgctgagagatcagttgttagtctgatgggcttccctttgtgggtaacctgacctttctgtctggctgcccttaagattttttccttcatttcagctttggtgaatctgacaattatgtgtcttggagttgcttttctcgaggagtatctttgtggcattctctgtatttcctgaatttgaatgttggcctgccttgctaggctggggaagttctcctgggtaatatcctgcagagtgttttccaacttggttccattctcctcatcactttcaggtacaccaatcagacatagatttggtcttttcacatagtcccatatttcttggaggctttgttcatttctttttactcttttttctctaaacttctcacttcatttcattcatttgatcttcaatcactgattctctttcttccacttgattgaatcagctactgaagcttgggcatctctcacatagttcacgtgccatggtttttagctccatcaggtcatttaaggtcttctctatgctgtttattctagttagccattcatctaatcttttttcaaggtttttagcttctttgcaatgggttcgaacatcctccttttgctcagagaagtttgttattaccaatcatctgatgcttacttctgtcaactcgtcaaagtcattctccatccagctttgttccattgctggaaagcagctttgttgctttggaggggaagaggtgctctgatttttagaattttcagctgttctgctctggtttctccccatgtttgtggttttatctacctttggtctttgacgatggtgatgtacagatggggttttggtgcggaggtcctttctgtttgttagttttccttctaacagtcaggaccctcagctgcaggtctgttggagtttgctggagctccactcctgaccctgttcacctgcgtatcaccagcggaggctgcagtacagcaaatattgcagtacagcaaatgttgcagcctgatccttcctctggaagctttgtctcagaggggcacccagctgtatgaggtgtcaagttgtcccctaatgggagatgtctcccagttagggtactcgggtgtcagggacccacttgaagaggcagtctgtccgttctcagatggcaaactccatgctgggagaaccactactcccttcaaagctgtcagacagggatgtttaagactgcagaagtttctgctgccttttgttcagctatgccctgccctagaggtggagtctacagaggcaggcaggccttgttgagctgtggtgggctccacccaattcatgctttccggctgctttgtttacctactcaagcctcagcactggcggacacccctcccccagcctcgctgccaccttgcagtttgatctcagactactgtgctagcagtgagtgaggctctgtgggcatgggaccctccaagccaggcgtggggtataatctcctggtgtgccgtttgcttagactgttggaaaggtacagtgttagggtatgagtgtcctgattttccaagtaccatctgtcacggcttcccttggctagtaaagggaattcccctaccacttgcacttcccggatgaggtgatgccccaccctgcttcggctcacactccatgggctgcacccactgtccaacaagccccattgagatgaacctcgtacctcggttggaaatgcagaaatgacctatcttctgcatccctcatgctgtgagctgtagactggagctattcctattcagctatcttggaaccctccggtggttttgaagttcatcactttttttagctatctccaggcctccttatctcacatgaaaattatatgcaagtgtcacttcagaatttccttctgaagatgcatcagactaatgtttggctagcattctcttcagagtttttccaggcccagtgaaaatagccaggctttttttgtcttaccaccttacaacaaacagcttaagtcctatccaactactacattctcccaacacagatacaaggcagcatgttcacattatctcaagcttcctccaaatacatctcaacagttagaattggattagaaagaggacttgttggcttgcttatcctgtgggtaactgtgacattgactgcaggtaataataacaagatctcttttatttttctaggtggcaaaccatgtgatttcttctgactctatttcctcttctgccagtagtttcctgagctcgaactctactttttgcaacaagcagaatgtacacatgttaaacaagggcacacaagcaggtaattacttgaatctgaactttttcattgaaatacattgaaatggctcttaaacatataagatactcaacctcaatcatagtaaaggacatgaagttaaaactatatccaactgccaattttcatcttatcagattggcgtaaattcaagtgtgatggcaagtttgtgggcaagagtgtagggaagtgtgttcccttgtatattccagtgggagtagaagttggtttactgtgaaagacaatttgacaggtcctgtcaaaattactttcactcagcatttttacctttgaaatgtctgctatagatatactatgaatatgtggattttaacctatagatatacttgcatatgtgcaaaatagtgtacaaaattaaccactgaaacattgttttttatagcagaagattaaaatgaatttaggtattcctcaatagctgaatgattacataaattattgtatatctggataatgaatgaaattctacatagaatgaggaagctctctctttactaacgtggaaagatctccaaggcatataactgattttaagaaaaggtacagaacagtgtatggcatactacaatatgagtttttttaaataaaagaaataaaggagggaagagaattgcttaaatgtgcaaaatgaattctctggaaccatatggggttgtgaacagagtaaatggagaccagaagtgggaaggaggatttttagctattgcctttctatacttttggtttcataaaataaaaataaataaactttcttgatttgtttcttcccctcaaatcctgtctttacttctgtcaacctcttccatacctgggtgactaccaaaaggactctaagtatttattgtctttctgccttgggatccaggtggaaattctttaccctttgaacccatattcattcttctttccctctcatacctaaaatgacttacaaataaaaccctttcttttttcttctccctctttttccctcctactctcccctgtccttccttcttttcctctctcttcccatcactccatcccacacaaagggattgtatttttgaaacattaaaaaggttcacatactcacttgaataaacctgtcaactcagcctcaaggttactcccagagacacctgtgatccttcccctcaggtaacttggagattgtgaacggtgccgaaaaacacactcgagccaactccaagttccagcgaggctaaattggaagaggacagtgatgtgacttcttggtcagaagaaaaacatgaagagaaaatgctctttaccagttatcctgaggacagaaagttaaaaaagaacaagaagaattcccatgaaggtcagtttctcattccagatcttgtagtagagaaactagtgaatttcaagtcccctgcaatgctgactctgtgtttccaagtgattctatgtgacccccacctacccccagtcaccaccttgtcagattttcgaagtccagcatggcagttacacagtcatccctgcagtgaaaccaaactcaagggcaccctgtggccgctgacagctgagacccctgagagcctgtattatatgcatctccttgatgaaagccaggtggggctgtaaaaagtgaaaattctgttttacttctaaaaactatttcctgtaggagtttcctggtttgttcctgtggaaaatgtggagtctagataaaaagaaggaaaacatgctcaagactcatgaccctggcatctcccggttggaaccagtaaccaagaccaagccgtggagggagccactgtgggagcggaactggcaggggcagcacctggacagtcggggctacctggcaggcccaggcagagaggatggcagaaacccactgaagctgtttgtgagagcaaccctgcaggtgcagtgacgtttacttaactttagccctacatgtagggagaagaagggtaaggcgcagagaagctggctctgtgacttggcgagctgaggtgtaggcctgagacgctcttttccagcacctccgcagttcacctgttttcacacgtgaggactgagtttctcatcatctgtcaaaggctgccttactcttagccatagatggtgcatcactgtcaggatctggagacaagggcacaggagggaggatttgtggctctgctcattgggtttgtgggtccctgtgtgtggagggcccagaggcctgatgcttgtgcagcctcatgcatgttcctccatgtccgcagctcctgtttctgctccatgtcggatttaaaggaaaccaagtctcttctgatgtgtccctctggggataaaggaaaagttattaatgatgtatttgtttgaatagatctttaaaatagcagcatgggcagagctgtattgcgttgatgtttcagagagttgtaatcgccatagtcttagttcctggcctatgctgaaggcatgtctttgatccctgtgggttccaagctgcagctctccgccatagagaggtgtcagaggtttcttcaactctaggtattttctcggcatttgaatcaggcttccccagacctcttgggtacgtggtgtgtttccagccatatggagagtagattgcatcattaatctgaggctgggtattttctctctctctctcttttttttttttttttttaaggaatcgcttcagtttcacagacctgacttcatctcccacattggggagcggataaagcgtctgaagttaatagtccaggagagaaagctgcagagcatgttaaagagcgagcgggatgcgctattcgacattgacagggaacggcagggccaccagaatcgcatgcgcccactacccaagagaggtacgccctgcccgttcactttcctgtgagtggaatagagaaggcaaggtctgctgctgtgctgcagagccctgctaaaggccagcccaggccagttacctgggcagacagcaaccttttgcttgccaagactcaaaccttcttagctaacagaacctccccaccttagccgtcagcacattcatgatccaagtaagcccagttactctagccctgtcactgcatcttaaaccagctctgtctgtgagcaagttagttccaaaagtatattgatttttcctgaaaagatggggctgattccaggcttgcctacctcttaggatggtaataatgataataataaacacatagtccttacatcttgcccaggcactgttcacattagcgcttacagcactctcagtaggtactattaatatatctactttatagtgagaaaactgaatcaaagggagattaactacctctcccaaggtgacatactcaggtgtgctgctctggagtctgcattcttaacaattatggtaagcagatcttgataaaataatgaaagctgtgaaaactacaaagtactatctaattctttcatcaagccttacctggaaactggccagttttttaattcaaagcctagtctttgctacagagtgttaggtccttagggccttaggctgctgtcctgttaccctagtctaaccctggcttgccttggtcattgctccccactcagtcttgccagctcagggtaggggcaccaagtcctagcagctccctctcccagctcttgcaccacaccctctgggttaagtcactgtccactgaaaaccctttcttctcttccttagtcttcctggctgtccagaagaacaagcctatcagcaagaaggaaatgattcagaggtccaaacggtaagaccaagaaaacaagagtttgtgtacaagtgttaaccaggccaccaagtggtcaggagctctggcttgcacccagaataaaggcattatgctcaaatttaaacattatgagaaagttgtgagagtcatttctcacttatggcactgaaaaaaaaagtagcacatcatggtatgaatgactcatatgcaaaagatgaaaaacttctcattaatttgcatatcttaggctcctctttattaacctaaatgtaaataaagaatattttaggccaggtgcggtggctcacgcctgtaatcccagcactttgggaggtcaaggtggataaatcacttgaggtcaggagttcgagaccagcctggccaacatggtgaaaccccgtctctactaaaaatacaaaaagtagccgggcgtggtggtgcacgcctgtaatcccaaccactcagaaagctgagccgggaggatcctttgaacctgggaggcagaggttgcagtgagcttagatggcactactacactccagtctgggtgacagagcgagactccatctcaaaaaaaaaagattattttaaaataaaattaaatatgtatttgggttattataccttttatcttagcaatcccatttcttggaattgatcccatagggtgagaaagaacagtgttctccagaacatattaagttaaacttttttaaaaaattaaattttcgaagtatgtcaacactgtttccatttgtggtctttaaaagtaagtatttgtgcctatgtagacgtgtatacttttatatgcatagaatatttctggaagacagaaaaacctgataatactgattgcctttggaaaggagaactgatgtaggatgtagtagattttttgactttttgaatgttgtgtcatgaggaacgaacattagttactcataaattaattcatttgagtgttggatgtggtggtacatttctgtaatcctacctactcaggagtcttaggtgagagaatctcttaagcccaggaatttgagactgcagtgagctatgatcacaccattacgctctggcctgggtaacagactgagactctgtatctaaaaaataataaataatattttaaaaaattaattcatttcagatattgatatattgatcatgggaatgccagagaataagttaaggttgacttttttaggtgttcattagagacttgctttaatgagaatagtttcttagttggcataatgcttctgaagtaaaggtactttaaaacagtttatcttacggactttaagcattcctcttgaaatcttgtttttactctttctagtcagtctttataggcaatccaaagggatgctttggatgctttagtccagtggttctcagagagtggtctgtggagtcctggaagtcgctgagaccctttcaggcaatttgcaaggtcaaaactaatttcagaatgacaccaggatgttctgtgccttttttgctgtgttggctatttgcactgatgatgcaagagtactgggagaggagtaaaaccattggtgtcttaccactattcaagacggtggcaccaaaccgtactagtctaataggcattgtatcctgcacagcctcccgccaggagtgtgatggaagaacaaggaagcagtgtaaatggaggtaaacgggaagcacttcctttgcaccgtgaaagatgatgactgtttcaaggaaaagcacttatgccatggtttgtgtcgtgagctgaaccagctgcctttgtcatggaacatgacttttaattgaaagagtaactgacagaaaaccaattattctgacttgtgtttagcagacattttcttgaaaatgaagaagtgactctctgacttcaggaaaatgtctgacagtatctgttgccaaagaaaatgtgagttttcaagccaacaatagaattctagaaaacttgtattcaccaccatgggcttgatgacatcttagtacttagacctttctgacgagatagcagtgacattaacaaatgtgacgtttttcatgttatctaaatacatttgtcaacatttggaagatctgcacaactccctggaccaggattttccaaatgattgttgctttttgttacaaaatcagggaatagatagaagattcaaatagtacaagatagactgatggatttttatgtaacagaataggaaaagtttgctgacatgctttcagattccaccttgcaactaatttttaagaaactaccacttgtcagccaggcacagtggctcacgcctcataaaatgagttggaatgaagtttttctttcttattctctagaagaatgtaatgtaatttattgcttaaataattaggagaattcaccagtgaaacccatctgggcctggattttcttttgtgggattcatttttttcaataactattcagatttcagtttttcttttatgccaaggtttagtaagttgtgttttttacgtaatttgttcatttcctagaaatttacaaattgatgatccaatgttataatatccttttgttatctttttttttttttttttttgagacggagtctcgctctgtcgccctcaggctggagtgcagtggcacgacctcggatcactgaaagctccacctcccaggttcacaccatcctcctgcctcagcctcccgagtaggtgggactacagacatccgccaccacgtctgactaattttttgtatgtttagtggagacagggtttcactgtgttagtcaggatgttctcgatctcctgacctcgtgatcagccctcttcggcctcccaaagtgctgggtttacaggcatgagcccccgcacctggccctttgttatctttttaatgtctggacgttctaggatctgtagtgatgttccgtttttattcctgatattatttttgcctcctgtcatttttacctgatcactctttccaaggggtatataaatttcactagtattgtcaaataacccactttgggttttattgatttttctctatcgtatattggtcttatattgattttttgttgtttattttggggccgtagcaggagccacagccagctccacatagttcagagggcctggcaagtatggaggaagacccttgctttcccctggaggtgctgagagtttaattcccgaggaagtaaggggattatttccctgtattggcaaaggttctagtttttgagtagaactagaggacctcacttctcttgaaggagaagtagagaggctcctcctcattcccttccctacaagtccccacgtgactgattcttcctctccaggggcttctagaattagcaacattgttccctttgatcctttggctgattacatatcctgcatttcttctgtagggctgggtgttgatagagggccataagacattatacataaggtattttatcccatttaccttgtttcttacaaaataagtcccagttggagaattgtagtattaatgtatgtaagtaactcatgttcagaccatctctcttgattccgtagggaacactggggccatatggtattacagtaatatatcatttgctttttggtcatggatatgggtatccaaatagtttccagtgctggaggaggcactgtaacgggctctcctccagtattgagacctggttccccatattctagggtctttgcccagaaggctgattccaccctccaagaagcttccactggggattagtgatgacacaaatcctgtaactcttagcctgtaggatatttctggtcctttcagcttgctgctacacgcaggccactatggagtggaggtgctgggaagctaggagaggacaataggggttgcctctccctggatcatgttcagtctgggtagcttccctggaaatctcatggagattccacagtagttccggatccagcttgagtggtgggaggtatgtaaatcaatcaagtaagcaaggtgttctttctggagagggtgcacactctgctcatgtaaagtctacatcactgtattttggttccaggaattcccacccaaactgccccattctaaattaggcctcttcaaatcaataacagttcttctgtgactgctggaatatggaagcccaatattttagggattaccacagactaaggagaagggaatccagacttcacatgcattcaggccacaaagaaacacaagtattggcaaaagtgacaagcattcagcctacagatataccagacagggacaaagtcttaaagatgagagtcctcgtctttatattagggcttcccctgttaaaatggatggagacatctctcaactcctagacctgaaggggagtcctgcccattcccaacagtcctggatcccttgagctaggtcctaaacctgacaacccagagtcctaataatcaaaaccaaaaccactcttttagtcagttcacagaaccaccaccacttactgcctcaaaattgcaccaaatgaaaggtccaagcagccacttctgctttcctggtgggctggggggatggggttggcatgcctgaggcccttcaccaatctccctcttggcaacttaacccactcatgcttcctcagactgctgcttcgcctgtaagcagcctataagggaggtcgagtcagggctcagtccatagtcccatctggatcaaccagatttgtttcccaggccctcccaccccactgcctccaaaaaaaaagcggggtttgtttgcctggtgagtaacaaaagtcgctgagaacacagactttgatcaataggagttttattacttgtcacaagtaggaagagctctgggaatattcgtcaaagcagtgtctcctaagagaaaatgacaggaaggctttatagagtgatcgagaggggagaaggtgcatcatcacatgaagaggaggggtcccagtgacacagatggagggagtcatcgtgccaccacataggacgcatgctatggtaatgaaactatagctctcccagggtgcaggatttagcattgtaatgaggaaagttcactgtaagtgagttcatctataagttgctggggtctgtcaggagcaggttccaactgactaggtgaccacatttcacacagggtttgagacaaaaccgtctgcaaggcagaaggctgtaaaacgggctaattgctcaaattcattaaattccttcactccctgggggcccgccctgtcttgtctatatagccagtccttaggaagtgaggccaagctgaactgttgacacagtctatgtctttacgagtctgggagctgggtgattttacctctgatgctagacttatttttactggttttgaagccttgcttacagccctttcccagtttctcacgaaatactcatgaaaggggatggtggggagtgggcatggggaaaagggaatgatattaaaattaaagctaacatcattggcctctagggggcactcatggctcatctccatagcccttggctcttgcagctgcccaagatgagagtcctgatctaaggaaactccaccaccaccaaggctggggtggtggcaatgggggcattattttccaaacctgactaggctacattttaaggggatcatagtcacagagaacatagatgtggactattaattttctttgcctgagcagccgtagccctatgtgctcctctccagcctttcagggagctatgatgggccaaaaaatgctcagtagcccaagccatctcctccatagacactggagtaaaatctctgcctatgggtgtgtgtgtcttgtcttactctatcctggatttgtttcctccaatgctggtggctttactttagatagtctgattgttgcagagatgagacccaaggctccactctggagaaaatagagccctcttgagaggtcagcccaacttgctagacttctgcatggggcttggggttcaatgttccagcctgtccccaaaaagtcatggccaaattcacatattcctttgatccctgatggtgtctcatcacacagttcgtctggcctcaccattgctccactaagtccaggaacctcaaggaactatgagacaggtagggctagacttaacaaaatggctatcacagtcttcatttcatgagacagaggtgaactgagaaaaggtggaaggtgcttcagagacttctctgtattcatccctaacttaggcagagagccttggccacacaggaaactggggaagacccctctcttactcaggagtcccccacactggtgccatcttatgacaggcaggcatcagcttcagagccagtcaaacagttaggaatagcaaacattgctccagaatttgttggggttttttttcccctgaatttgatagtaagctccacataggcaagaatgacaaccatcttgttctccttgtttctctggagtctaacacaacatgtagcacgtggttggcccaataagaatttgtcgaatgggggccagatgtggtggctcatgcctgtaatcccagcactttgggaggctgaggtgggagagtcgtttgaggcctggagttcaagatcaacctgttcaacatagtgagacccctatcttcttttttttttttttttttttaaagtggagtttgttgaatggcacacagaaaataaacaatccaaatgacagatcagaggtgctggaaaagaccagggagatctaatcgttaaatcacgtcatctaaatattaagaggagacatttggacatctgatagaatttggcattgaataagtgataaatacacagaaaactgaacaacggcaaaaagaaaagtatcagttctaagggaaaagatacaaatcaaaagccttcaggaaaggataagtcatcatggcttactgtatagcttagcttaaaataacacagaatagtgaagtagcccaaagggccatctaaccacactgggaagctgagcaggggaggagtgcgtatatgcatggaggagacttgtcttcaccctcctcagcagctgacagcaggcaggctagacctggacaatggagcaggagtcacacagcctgtgaaagaagtgctggggaatgtaggggctgctgtttcacatgacagagccattgaaccctggctgtttataatagttacatacataattttaatagaaataaaaaccaaaaagaaaaaagacttaaacatgaaaggcaaaaccattacaatttttagaggaaaatataagagagtaagaacagaaaaatgtcttaaggcacaaagtgctaaccataaagaaaaagattgataaattcatcttgataaattttttgtttatcaaaaggcaccataaagacagtgaaaagacaaggcacaaaatgggagaagataattgcagcacatctgaccagcaaagaatttgtatccagaatatataaagaacttctatgagtcggttttttaaaaacacaatttatatttaagtctctttaaaacaaatagacaattcatagaaatatggtgatatggtttggctgtgtccccacccaaatctcatcttgaattgtagcttccataatttccacatgttgtgggagggacccagtgggaggtaattgaatcatgggggcagatttttcccatgttcttgtgttagtgaataagtctcatgagagctgatggttttataaagagcagtgcccctgcacaccctctcttgcctaccaccacataagatgtgcctttgctcctccttcacgttctgctgtgattggtccgcatccaaatgtcatcttgaattgtagctcccataatcctcatgtgttgtgggagggacctggtgggaggtaattgaatcatgggggcagatttttcccattttcttgtgatagtgaataagtctcatgagagctgagggttttataaaaggcagttcccttgcacaagctttcttgcctaccatcatgtaagatatgcctttttcattataagttacccagtcttggatatttcttcacagtggtatgaaaatggactaatacacatgggctaaactcatgagcaggcaactttatagaaaaacacaaatagcccataaacataaaatgtagattgagttcattattaattagggtaatgcatgttatggatagaataaaatacctttttacattcactggattggcacaaagttttgtctttgtgccactctaaatgttgacagggatgttgatcaactggaattcacacactgcttgaggaagcttgcattcactctataattcagcattctgaaaagtgctcaccaataatcagcccaggaaggttcacaaggacatcttcaccaaatatgtcctttcaccctagcaaagaactagaaacaactcaagtgtcttttgacaagagaatgagtaaatggcaagtggtatgtcacgcaaaagaattctagacagaagagaaaattaaggaacatcaaacttagtgaatctttgagacgatgttgagtaggaaaaaaaattcagaagaatatattgtatgatacttttatcataaggtttaaaagcaagccaaggtaaacatgtgcagggacacctagggacccatgtcattttaggatcaaacagatagatggacagatgatagatagacagacagatggatttttttaactcaaaatagtggttacatccttagggagctgggattggagaagagacacttagctttgaaagtattgtcaaatatagtgacctttctagttcatttgggtgctgggttcaggggtattcattttattatgcaccataatttatgtgagacattttattatatcaaatattttctaatcttacagtaagcagtttggtaaacagattcataactgcatataatgtgtaggtcttgtgaacaatgctgctgtgaatatcaggacccaactgcacttgtctctcactgccttttgtaagcctgctcaattggggagttcttccccttatactggagatgagaactcaggtaatgcctcgactgttcggatcactgtcaggggattacatgttctaccgtgctgacttttcactgaaagcccagtctccactcaataagtaaaagtgtaataatcgaaactcccaatttgagttccacttaaaatcttctctcttcccctgccagacctctctgcaccatctaggggagcatagtcccctctgtccctgcctgacagggctctcctcctcagcagcacagggaggtgtctgacccatctgtgtgtgtgtgtctatgtggtggggatggggaccatagcttggcatcctgccctctcaccctggcagttcattgtctcaagctgactttcttgggtgttttcatggcttcttctgaggcctccctctggaatattggatcgtaactccagcaatgcaagcaataggttttcctccagcttctggtcctcctcctcctcctcctcctccccaaacctggtttctagcagtcactccactgagactcagagtcttcttggcccagtgccagcctcttgcatgtcccaaaccttgtcctcaggaaacacttatgcatcctatgctggggtgaactcttaagagtgcaggatcacctcatggccacagcctagctaggccctgaaacccacactctgggtttgtcagacgtgagtcagccccaggccactgaacctctcccactgcagggaatccctgtcaagtggtgaaagccagcatctagacctggagtcacaggcacctgtagcataactcctcctgaaatggaggtttttctttagagattggtccatatcccttatccctggacttctgagaagggtggacaacctgtggactggacttgagtctggaatttagagaagtgtccatagtagggctgccagatgaggcaaacacaaatacaggatgcccaattaaatttgaatttcagataaatgatttttaatgtttgattctgtcccatgctaaaaattgcccactgtttatgataagtttaaatttattggtccattctgtactttatcaaggacacacgcaggaggaacagtagcacaaaggcttcccggtgccttgtgggtgaaagaaaggcttccagggaaaggagagaaacacccagggatcccggtgacgtcgggaagcagcacccagaccatgtaaggacaccgcctgcagggggagactcaaggcctgggaaggttttctaatctgtgccttgagtcgggtggggggattttctgggaaaggaaaaccagacacagtaggacaaatattgtatagtttcacttatatgaaattgtcagaataggcaagttcgtagagacagaatgtagaacagggctttccgggggctggaggagaagacaaggagttcttgcctagtgggtacagagtttctgtttgaaatgatgaaaaacttctggaaatagattgtggtgacagttacacaccattgtgaacataattagtaccactgaactgtacacgttaaaatggttagttgtatgttttatgtattttgccataataaaaactagggggaaaaaaaggaaggggagattgtctcaggctggctgactttccctgcatgtacgcacatcttcacatgtgcacacatgtaaaacaaaaatgaagcaaaaaaagaaattctaatttaaccagtaagcaatatgtaaaaggaaatctgaatgtcattacaattttaccaggttcagaataaaataccatccttcaaaatgaacaaattacttattagccgaagaaaggtgaaaggaagtttggaattaacagtctagattttctcactgattggtccaagtcactgacctctaaaattatcttagatcatgccctccctccttcctactttctggaaaacaatcagtctcctaccc

SEQ ID NO: 119 - DNA, 82655 bp, Homo sapiens
agataaggttagggtgttgggtaaatggctatggtgaggtcaactcctaccttcctctgactcacagcctcctccctcaccctcctgactgggctccctcactgaagcctcagctgaagattccaagtcaacactttattttgcagggcttctgctaatgtttctgaaagataacatcactgccaatcataacaccacttactgtatacctgctttgtgtcaggctgggatctaaatactttacatgtcttacaatcttattcagccctcacaataagccaacgagctaggtggatcaatacccctattttatattttttttactttgagacacggtctcaccctgtcaaccaggctggaatgcagtggtgcaaccttggctcaccgcaacctctgcctcccaggctcaggcagtcctcctatctcagcctctcaagtagctagaattacaggtatgtgccaccacgcccagctaatttttaacacaccccctttttttttttttttttttgagacaggagtcttgctctgtcacccaggttggagtgcagtggtgcaatctcagatcactgcaacctccacctcccaggttcaagtgattctcttgcctcacctcccaggttcaagtgattctcctgcctcagcctcccgagtagctaggactacaggcgtgtgccaccacatgcagctaatttttttatttttagtagagatggggttttgtcatgttgaccaggctggtcttgaactcctgaccccaggtgatctgcccacctcggcctcccaaagtgttgggattacaagcgtgagccaccacgcccagccaacacctctattttctaagggaagaaatgaagtctcagagaggttgagcaacttgtttaaagttgcaccgctgctactgcagctgggagatcccaaggttctggccgactccagagttcatgttcttaaggtccagtgtgtccagctgtgaatgctaaaactcccaaactcaaagtcaaggatctagtggaagcagggatgacctccataagcagcccaaacccagctctctggggcaaattcttttttttttctttttttttgagatggagtcttgctctgtcacccaggctggggtgcagtgatgtgatctcagctcactgctgactacacctcccaggtttaagcgattctctgcctcagcctcttgagtagctgggactacaggggcaagtaactctatcaggggtggggccaagaattatgaattcaaattgcttattctataaaccatactttcgtgttctaaacaaggtttagatagtggccacccttgtgtattaaaaatggtagcattctaaacccacataactatccaccatgttccacagaacatttctgtcactgtagaaagttctattggatggcaccgctctaaatgggaagatggacaggaaaggggcatgaagggaaccaggagactagttgaaaccggaataatatgccatatatacatttgtttaatgaaaagaaaacaatgttactgggttctagctggatattgttggaaaaacctctgaatttgagatcttttatctctgtcaaacagattaaggagtgttagagaggcattaaagacatagtcgcaccaaactgagactttctcccttttttttagagctagggtcttgctctgtcacccaagctggggtgcagtggcacctgtaacctcaaaccagtttgctgtaacctcaaactcaaaaaaaagactcaagggatcctcccacctcagccttccaaatagctgggactacaggtgcccattgagaaggagtcttgctctgttgcccaggctggagtgcagtggtgtgatcttggctcactgcaacctccacctcccgggttcaagtgattctcctgcctcagcctcccaagtaactgggattacagatgtgcaccaccacgcccagctaatttttgtatttttagtagagatgaggtttcaccatgttggtcaggctggtctcgaactcctgacctcaagtgatctgcccaccttggtctcccaaagtgctgggaatacaggcatgagccaccgtgcttggctaacacctggttaagttttaaactctttgtacagacagggtctccctatgttgccaacgccggtctcgaactcctggcctcaagcaatcctcccgcctcagcctcttaaagtgctgggattagaggcgtgagccagtgctcccagccatttgcttaattaggaggattgaaaacgaatagagaaaggaataacttttccagtctgcaattccatgttccttaatggtttttgctgccctgactgtgatcttgcttcctgccccacatattcaggcacggatcgagttcagctttgcaccccagcactctacagaagaaggcaccgaggcattgagaatggaggtcacctgtccacggtcacacagccggctagtggcagagccaggacccagacatggttcttcctagtggagatgagacaaaagacagatggacggctcccacctcacggagtttacattccaggaaggatggcgcaagctttaaacaattttcacctgattcattagttggccacaaacaggttgaatgcaagaagcttagggagttggccgggcacagtggctcacgcctgtaatcccagcactttgggaggccaaggcagatggatcacgaggtcaggagattgagaccatcctggctaacacggtgaaaccccgtctctactaaaaatacaaaaaattagccgggcgtggtggcaggtgcctgtagtcccagctattcgggaggctgaggcaggagaatggcatgaacctgggaggcagagcttgcagtgagctgacattgtgccattgcactccagcctgggcgacacagcgagactccatctcaaaaaaaaaaaaaaaaaaaaaaaaaacttagggagctaaagagcgcgtggtcagaggccctagtgtaggttagaggcttgggttgctcccctgaagaaggaatgcttaagccaaaactaaaatttcagtaggtattggcctggcgaagagaggagaaagaacattctagactaaaggaccagcctgtgtgaaggctgttagtgggaaggcagcttggcattgtagggacagtaggtgcctgaggtatacagagggaggggatggccggtggttcaagcagaggctggtgagggagacctcttgttcccctagtgatgctgatgtacccctttgctgtgtctccacccggccccaaaatgcggcttctcttggcacagacatgtccagggcttacctttcatttctgatgaccccaaagtgagtgttacagggtcctctctctttttggcttcctcccagaacacctgccctgatgtgttctgtggataaatgacatcttccaccaaggcgaggagactgttgatgtccatcaagttcactgagtcccagcccaaggcgggggatggcaccttgagagctttgaagagggagctgacgattcttgacacatcctggtggggaaaggggccataagccaaggtgaggggtgcagcacaggggtcaagagcacacgccctgggcctggcaacctgtgtagggacccctgctctgcccactgagatgtgatagtgacctccctgagcttccatttgtcagctcttgaatccctcttctagggtttgaactcattccaggctgtactcctcaaagcgtggcacacagtaggtgctcaatgaaagcttactgaatgcatcaacgcagagcggggagtctcgtccatgggcttccagcctgggagtctaccatgaaggcataattctttgcacacagtagatactcaaaaagtatgtgggtgtatgcgtgtgtgcacatgtgcatgtgtatgtacatgtctgtgtgtctctctgtgtatgtgtgtgcatgtatgcatatgtgcacctgtgtgtttgtgtgtgcatgtgtgtacagatgcatgggtgcatgcatgttgcatgtgtatgtgtgtcttcagttgatgaattttggcacctcacgttgccaggcaacacagggctgctgggtctcaagccccaggcctcacccccacttctgctgaggctacagcaccccccaggctagctgaggttgaggacctgccttggtcactgcctcaggtgtcagaaggccgtcctccatgggctgtggggagggagtcaggttgggggacccccggtcccattttccagtgttctgctccttcgcgacccggggacgggtgttctgaaagatctgaacaatcaggaggttgatggggaacatgaggatggagctctccaggccaatcatcacctcctgccaggtgaattcaattttacctggggaaagggaaggaagggatcaaagggagaggccaccgcccggagcccagtcccttctgccccttgtggaagctggctgtgcagtgaagggttaaccctgcccaacgcctgggaggtcaccgctcagcccttggaagttcccaactgctaagaatgtctttgtttccctagggtcttgggtcacaccggatggtctgtgctaatgatgagatttaggtgggggcctagaccatatgatgtcagcttgacctctagaggggctggaggcgaagggcagccaagtgggtgtcagccatgcctatatgttggagccccagtaaaagctctgaatagtggctgggcatggtggctcatgcctgtaatcccagcactttggaaggtcaaggtgggtggattacctgaggtcaggagttggaggccagcctggccaacatggtgaaaccccttctctactaaaaatacaaaaattagctgggcatagtggtgggtgcctgtaattccagctactcgggaggctgaggcaggagaattgcttgaatccgggaagcagaggttgcattaagccgagatcataccactgcatttcagtttggatgacaagagcaaaactctgtctcaaaaaaaaaaaaaattgtgaattgcaaggctggagtgagtccccctggttggcaatactccatgtgcactgtcacacatcctcaggagaagtcagcaccatccacgactccactgggagaggatgctggaagctatgtgcctggtctcttctggcccctgctccatgtgtctcttccctttgctggttttaatctgtatcctttctgtgttttttgttcttttggtttgtttgtttattttttttttttttgagatggaattttgcatttttttacccaggctggagtgcaatggtgagatctcagctcactgcaatctccgcctcctgggtttaagtgattttcctgcctcagcctcctgaatagctggaactacaggtgtgcaccaccacacccggctaattttgtatttttagtagagatgggttttcaccatgttagccaggcttgtctcaaattcctgacctcaggtgatccacctgccttcgcctcccagagtgctgggattacaggcgtgagccaccgtgccagctgtatcctttcactgcagtaaaccataactatgagtacaatgggttctgtaagtcctgctagtggatcactgaactggagggcggtcttggggactctggaatggcagtggcattgctggagcagtgaaggctcaggtccaccagccactaaccctgacctccatgacactgggaattacccaagtccatcttttgctcagctgggtccttggggaccccccagaacatgatgctggtcagcatggtgcacagcagcagggagaagcagcaggacaccctctggacgcgggtgaagctgctgcgagcgcagcggctgaagatcgaataccagatgtgtccatcctggaagcccgcggaagtcttcatgaaaaacaggtggctgcaggcaggcagggagagagggacaggcatttagggagacaggaatgggggaaactggtctctgtgggtcgttcttgggatgagaagcaggaagagcggcagagatttgtttctaagattgttcacactttttttttttttttttttcagataatgtcttgtgtcttgctctgtcacccaggctggagtgcaatggcacgatctcggctcactgcaacctctgcctcccagattcaagcaactctcctgcctcaaactcccaggtagctgggattacaggtgcccacaaccacgcctggctaattttttgtatttttagtagagacatggtttcaccacattggccaggctggtttcacactcctgatctcaagtgatctggccgccttggcctcccaaagcgctgggattacaggtgtgagccaccgcgcctagccacatttttttttcggatggagtcttgctcttgccaggcaggagtgcagtggcatgatcttggcttactgcaacctctgcctctggggttcaagtgattctcctgcctcagcctcccaagtatctgggactacaggtgtgagctattttttttttttgtatttttagtaaagacggggtatcaccatgttggccaggatggtctcgatttcttgaccccttgatccacccgcctgagcctcccaaagtgctggtattacaggcatgagccaccgtccccggctccccccccaatttttttttttttttttaatagaagaaacacagcatcttagcagcatcacttagagttaacaatgaaggctctggaagtcagattagaattacagacggccctcttcccagctgtgtgacctcgggcacgttactttgttctttgtaccttagatgacttgtctgtaaattggggcaagtaataataacagaacctacctcactggattgttgaaaggaataaaagtgatgattctgtaaagcatttggggcagtagctggcatataggtcaatattcaatcagtgtcagcattgttatttttgctgtaattttaatataataatatagctaaaatactattagttttgttacagttagatcattggagtacagtggttaaaaatcccaggcatgacggagtgcagtggctcattcctgtaatcccacgactttagcagggcaaggagagagggttgcttgtggtcaggagttcaagaccagcctggccaatgtggtgaaaccccgtctctaataaaagtacaaaaattagccaggcatggtggcatgcacctgtaatctcagctacttgagtggctgaagcaggagaattgcttgaactcaggaggcagaggtcacagtgagccaatatcgtgccaccatactccaacctgggtgacagagactctgttcaaaaaaaaaaaaaaaaaaaaaaatcccaggcatggccaagcacagtggctcacacctgtaaccccaaaactttgggaggctgatacggaggatcccttgagcccaggagtttgagaccagtctgggcaatatggtgaaaccccatctctacaaaaacagttgggcatggtggtgtatgtctacagtttcagctactcaggaggctgaggtaggaggatctcttgagaaggtcgagaccatcctaggcaacatagcaaagattcgtctctacttaaaaaaaaaaaaaaaaaagaaaaagaaagtgaggcatcgtggtgcatgcctgcagtcccagctgctcaagaggctgaggtgagaggattgcttgacccaggggggtagaggttgcagtgagctgtgatcgtgccactgcactccagcctgggtggcggaacaagaccttatcttaaaaataaagaaaacaaaaataaagtacctgaattgttttctgtcctgctccgtggccacaggaaacaccttatcgaggacgcaatctccaacattgatggatagccaggagttgcacaggaaataccacttccggtccatcaccaggtcatagaccagcacccggctcacatacctggagaagggacccagagttttgaggataaggtggagcaggggaggagacttcactggacatcaccaaggtaacagttttgcaaacatgaacccaaagaacaagagctcctcagaaaaagaaaccatatttttctttgttcttggtgccttaattaaaattcgcgtcacataaggaggtcagctactgtagagagccaactctgggaagctgccatgtttccacaaagatgctgcaaaaggatgcattcggagaccattaacctgtacacatggcaccaagctcagggccagcgtccaggcatgagcaagtaaagccaaattgtgtaaagtgtgcatgttcaggcaggtgcaggctggggtacgcagaacatggtcctctcttgcgtttctttctttctttttttaaattttagacagaatcttgctctgtcacccaggctggagtgcgatggagtgatcttggctcactgtaacttccgcctcccaggttcaagcgattctcctgcctcagcctcccgagtagctgggattacaggcatgcaccaccacacccggctaattttgtatttttagtagagacagggtttctccatgttggtcaggctggtgtcgaactcctgacctcaggtgatccacccacctcggcctcccaaagtgctgggattacaggcgtgagccaccgcgcctggcctcctctcttgcgtttctaaccaaagaatcaccgtctatcttgggctgaggactttgtgggtatcttctaacctgatttaggtctttgaggtatggggaagaattgaaattatcttgcctatcctgtgatgtcagatcgagcagcagttttccctgttgctatacagccaacaagaacagcaatgatggctgggtgtagtggctcacgtctgcaattgcagcactttgggaggccaaggtgggcagatcacttgaggtcaggagtttgaaaccagcctggccaacatggtaaaacctcatctctactaaaaatacaaataaataaataaataaattagctgggcatggtggcgtatgcctgtaataccagctactcaagaggccgaggcaggagaatgacttaaacccaggaagcagaggttgcggtgagccgagattgtgccatcactccagcctgggtgacagagtgagactctgtctcaaaaaaaaaaaaaaaaaaaagaacagtagggatagcaatagccgctcttcactgagaatttactacatagcgggggctatgctaagatgctcttgatatgcattttctcatttcaggaagggcagccccgtaggaatgcaaaagccacctatgtcaaggtcacaggcttttctggggcagctgacatccagtgatgcagtacctacagggatcaagacctgggtatttcaacccaacttgggacagctccagagctccccagtggtggaccacactgttgctgggctgcatcacagcttgacttttctgccatcctgcctccttccctctgttcccaggtgctggtcccagggccctgtaataaacaccctgcatatgcaactccatctgagagcctgcttcccgggagcaacctacagcggccacgcttaaaatattaatgcttaatcccataggtgaattaaagtgctattgtttttctaaagccgccagctactgatgggtggtcagactggacaccactcatctgggtcactcattttggcctcagaatgcagagaaccttgctccaaacttgccagctgtgtgaccttgggcaagtcacaggttgatgctgcaaaagggccaagggtggggctagcactgaagatggggctagctgtagcttccagtccttttcctagctaccgatccagtttgtgtggaccatgaaccagtgggcttttctgaccctcagtttcctcatctgtgaaacagagatcattctatgtgtcttgcggaggcttgcgaagatcaggaaggaggcaaatgtacagtgcccagccctgggcctgtcactctgtagattctcaaggtttgtctgcccccaactcaccacgatggccggtcccctgagttgtcatgccacagccggaggctccgcagttctcccagggggaacagggtggagaggaggaaggcatccactgctcctcgctcaaaaaccggagtgtcgggatcagccaggtggtggggctctctctctccatccaggccatacagggtgacagtcacctgaaatccagagaccagaagtggccaactccacagtggcatagcagggctgggtgggatgtgctgattaatcagtggatcttgcataggcaggtacctttgaggacgtggctgcccctcgtcggtgtcctgtgtagactgtcaccaggtagtggtactgagcaaagggatcattgtcttccagcactgtgaccttcacctgaagagaaggacagcattaggaaggccttgctcagtgggttcctgcatcacccaccagccaagaaggagctgatgatttgtgataatcatgaattgggcaaagcaaaattacatgtgccatttattcatcccctcgggtgagaactgttctttataaaagcagggtttcaagtgcaaaacgctcggaaaataaaaaaacacaaagtacatttttttcttcttccttttttttttttgttttcagacagggtctcgctctgctgcctaggctcgagtacagtgccgtgatcttagctcactgccatctctgcctcccgggttcaagtgattctcctgcctcagcctccagagtagctgggactacaggcgtgtgccaccatgcctggctaatttttgtatttttagttagagacgaggtttcaccatgttggccaggctggtctcaaactcctaacctcaagtgatctgcccacctcggcctcccaaagtgctgggattacaggcgtgagccaccacgcccggccccaaagtacattctttatgagatatgacccccatgtagtccaattggaaatgaacttgataagctgagaacattgaatgtttgacctggtgaaccatacatactctgtacatgtataatttctcataacatttggaaccaggtggtgtttttgagggaatttaaaagaaatgaaacgttaagatagtttagcgacaaatgaactcatggagataggaagtagaatgatggtcagcagaggctgggaaaggtagtgggggcgggaatgggggggaagatgaggtggttaatgggtacaaaattagaaagaatgagtaagatgtctgccgggcgcggtggcttacacctgtaatcccagcactttgggaggccaaggcgggtggatcccttgaggttaggagttacagaccagcctgaccaatgtggtgaaaccctgcctctactaaaaacacaaaaattagctgggcgtggtggctggcacctgtaatcctagctactcgggaggctgaggcaggagaattgcttgaacccaggaggtggaagttgcgtgagctgagatcacgtcgctgcactctagcctgtgtgacagagcaagactccaggtcaaaaaaaaaaaaaaaaaaagaatgaataagatgaataagatctagtattttataccacaacagggtgactacagtcaataataattgtacatttaaaaataattaaaagagtataatcggattgtttgtgacacaaaggataaatgctcgaggagatggataccccaattatcccaatgtgattattacaccctgcatgcctgtatcaaaatgtcccatatatctcatatgtatatatacctaccatgtgcccataagaattaacaaaaatttttaaagagtttggcaaaaagaaaagaaaaagaaattagccagagttagccagagttggccagaggctatagtcgactctgaatgcgctgcccagatccccctcccacgcagggttcgttgcctcagttaatggggtaaaaaatgcaacacctacctctgttgagattgtgcccccttggggcagccagcacccaatgaccaataggcggagtgtctgggtgtggtcaagacctgggtatctcaacccgacttgggacagctccggtgctccccagggtctgggccgggctgtcactgggctacatcacagctcagcttctctctctgcgcatgctgcctccttccctcccttcccaggtgcaggtcccaggcccccttaataaacaccctgcacactctgcatgctcacctttgcatcggagtctgcttcctgggaaccaacctacagcagaggcacttcaagtattaatgcttaatctcttgggtgaatcaaagacagcagtatcaatgctgaaacattatcttattaaatttaacccacatgaaatcctgagtgatgttgcttcgggggaaggggtaggaacggatagagtttcacagctctgtgacaatgcaaccttgcattcattcattacctcttcttcagatagccataaatattggctgaaggcctactatgtatgtgtcaggcatactgcatacattggaaaacaattgttttttttgagatgaagtcttgttctgttgtccaggctggagtgcagtggcataatcttagctcactgcaacctccacctcccaggttcaagtgattctcctgcttcagcctcctgagtagctgggattacaggtgcatgccaccacgcccaactaatttttgtatttttagtagagatggggtttcaccatgttggccaggctggtcaactcctgaccgcaggtgatccgtccaccttggcctgccaaagtgctgggattacaggcgtgagccaccgcgcccggttggaaaaaatcttaagtagacaaataccctcttctcgtgaagcctaatattatttgaaaacaatggagttttctccaggacggtgtacgcagcgccaatggttctcagcctcaccttggcctgatcctgagcgtccttcctcctcgcccagatcaccaccagcacgtagaccacacacaggcagcccacggtggtcacgaccacagggttgtcctcaaaggtggcaaagagctcagcagtctggtggatgttgatggcattggacatcaccaggaacgtgcttccgaagaaagtgaggtggttgcagaggcagtgtgtctggtaggggctggtccgaggccccacctacaacccataaaggggctgtcagtggagacgctcgggaagctcaaccccggctcgctcgagcccaggggaggagaacggtgttcgctttgaagagtgcacactctgctggggtgtgtggtgggaagaccgctgggagaccagcttcaaaagccccttttgatctttttttttttttttttttttgagatggagtctcacctgttgccaggctggagtgtagtggcgagatctcggatcaatgcaatctccacctcccgggttcaagcaattctcctgcctcagcctcccgagtagctgggactacaggcatgcaccaccacacccagctatttttttttgtatttttagttgagacggggtttcaccatgttggccaggatggtctcaatctgctgacctcatgatccgcccgcctcagcctcctaaagtgctgggattacaggagtgagccactgtgtttggccaatattttttatttaattaaaatatggagataatattatttatatttttgtgtccatcattctcagtggacaactgtgtatatgttgccagtctgctttcctttttttttctttttcttcttctgagacgggatctcactctgtcggccaggctggagtgcagtgacacaatcttggctcactgctgcaacctctgcctgctgggttgaagcaattctcatgcctgtgtcccccaagaagctgagattacaggcaagcgccaccacacccggttaatttgggtattttcagtagagacggggtttcgccatgttggccaggcaggtctcaaacaggctgatctcaagtgatctgcttgcgtcagcctcccaaagtgctgggattgcaggcgtgtaccacagtgtgattcgcgtctgcaatctgagcttcttgggaggctgaagcacaagaattgcttgaaccccagaggcagaggttgtagtgagctgagatcacgccactgtactccagcatgggcgacagagaccctgtctcaaaaaaatacatatatatggcaagtaaatttgagatctcctttgtccctcttcccctataggcaaccaggatcacaaatttggcattcacccccgtggtgcacctggtgctcattcacaggacaaatatttgtggggtgctaattctacatccagcaacaggctaggtgctgagaggacactggtgtgactaactcatcccagtttgccagggcctttcctgcttttcaaacagaaagtcctgagtcccaggagctccttcagtcctgggcaacccgggacagttggtcagcttatgccgaaaagcaaaataacctgggggaaccacaggaagaaaaagaagaaaaagagaaggacacaggtttgagtcctaagctggcattgtggcacaaagaaggtgtgatggcacttacacaggtggtgccttgtggtgcaggacaacatggccgggcagcaaggggaccggagtgaaccagggcaggggctgccatctgtgcctgtgcttcacacccacatggccacccccaatcccccgcgagctcacagtcaccccctagggccttctggtgggtaaagaagatggtttgtttgtttgagacagagtcttgctctgtcgcccaggctggagtgcagtggcatcatctcggctcaccgcaacctccacctcccaggttcaagcgattctcctgcctcagcctcctgagtagctgggactacaggtgcccaccaccacacccggttaatttttgtatctttagtagaaatggggtttcaccatgttggccaggctgctcttgaactcctgacctcaagtgatccacccgcctcggcctcccaaagtgctgggattacaggcttgagccaccgtgcctggccctacatgtaagatttgggacaagtcagttgagtttcctgagcctttgttttgtcccctgtaaaatgagagtcacagctgtcttggagatgattgtgcagatctgatgagccgatgtaagcaaagcatggagctctgcacctggcacagaactaagggctgagctatgagttcattctcttggaaatgacaccctggcctcccttaacaacctagaggcagcaggccttcctgagtcattcgtcgcctgggtcaatgaccatttgttctcagtgatgaacaaagcacattgttcctgttgcactgggggctcccagtgcatggagggagacagacgtcatttaaatgatctcatgcgtagaggtgaaatgacccctctgcttagcgctatggatgaggagcactggggttggatgctctggatgtgtgtgctctgggggttcacaataggaaatctgacttagggagttaagaacagttttctcgaggaagcaatgcttaggctgaagcgaggatgaggcgggtatcctaggcaccaggaacagcaaaggccccacggagaggctcaagatgctgtgccagaggcaccaaaagggaaccctacatgagctgggcacagcccaccaagctgcctcatctccttcacttcgctctccttacctggcatcctgagtcgtcccaagtctcctggacctcatcccagaacacacagtgagacaggaaggtggtgatgccaaccgtgaggtccctgccgggggctggctccaggtcagactcagggaccacagtcaaatagtagaccccttctccaaaacgcaggtcctgtgggctcaggatccacgtgggcagctcatctgtaggaaagggggttccaggtcagcctgaagcctccttgagatgggcgttaagatcatgggagagggtgactgagccacttggcagggaagcagaccctgccggttttcccccacccctgatgtcctacaagcactctctcctcctgagaccaggagcatagaagaaggggcactccccagtcagggtgcacagctgactcaggcagacaagggctcaaacacagattctgccccttattggctgtatgagctcagaccagttccttttccttaacctctttgttcttatctggaaagtagagattttttttttttttttgagacagagtctcgctttgtcatccagggtggagtgcagtggtgtgatctcagctcactgcaacctctgcctcctgggttcaagctattcttgtgcctcagcctcctgagtacctgggattacaggtgtgcaccacctcgcccagctactttttgtattttcagtagatatggggtttcgccatgttggccaggctggtcttgaactcctgacctcaagtgatctgcccggcttggcctcccaaaatgctaggattacaggcgtgagccaccacacttggctgaaagtggaaatttcaatagttccccctgccaagggttgtcatgaggattgcaatgaggtcagtcctatatgagcttgtaaacttctttggggcatatagtaagtgctcacctaatgttggcaaatagtaacaccaataaaaaataagccactgaatgtgtggggtggtttttttctttgcttttcttcctgtggcttctgatttccaagtgaagctgatcataccccaggcagcagctcaggaaatggtcacaggcctacctggagccaccattggtacgaggtgagtttgggcatcgtagctgctcttgttggggtggtagccatagcccaggctaagcgtgagtgcaatgtctggtctccagtgcagctggatccccaaggttgcctcccctgaagtcacgttcacccacaaagcttcaggactggtcaggttcaacacggtcggctggctgtgtctttgtgaatgccggggcagcaggatctgtgatcagaaacaatcctattgaaggtgtgccaggaaggcaatgccagcccgtgggcatcaggactgctgtgtagagctgtgtggcctgagcacctgggaacagaaatccaggccgggctttgctcattgtattagtttcctaaggcttctatcacaaatgaccactgtgggaagcttaagacaatatacagttgttatcttttagttctaaaggctggaagtgcaaaatcagtttcccagggctaggggagaacatacttccctgcctttttcagcttctggtggccgcctgcattccttggctcatggccccttcctcgcattactccagcctcttgcttctggcatcaagtcacctttttgtcttctggagtcacctccctttctgcctcccttttataaggacccctgggaagacgcggagcccaccagataacccaggataatctccccagctcaggatgggcaagactcaagcacatctgcaaaatcccttttgcagttttgttgggtttttgtttttagacagggcctggctctgttacccaggctggagtgcaatggcatgaccaaagctcactataaccttgaagtctcgggctcatgtgatcctcccactttagcctcccaaagtgatgggattacaggtgtgagctaccacacctgacctcccttttgcatttaaggtgacatattcacaggctccagggatgagaacacagacatcactaaaattgttattgaattaggcattgatgagaaaattgtagaagactagaatagaatcattaaaattttgaaaaaatgtatttaggttgcaccatggtatgtttacgtttttgtttaaagaaaatctaactggacattttattttttatttatttttttgagatggagtcttgctctgttgcccaggctggagtgcaacggtgcgatcatggctcactgcaaactctgcctcccaagttcaagtgattctccagcctcagccttctgagtagctgggactacaggtgcctgccatcacgcccagccagttttgtgtttttagtagagacggagttttactgaacacaaatgagcaaatgcacgagaaagtgctatgcaaactgttttactgttggccaggctggtctcaaactcctgatctcaggtgatcgactcgccttagcctcccaaagtgttgggattgcaggtgtaagcccttgtgcccagcctaactggacattttagaggctatgtagtgggaatggtttatgtaacgaagataactaaaattccaaacaacagatttatataaccaggaaaactctggttatatacccaaggattggtgaatgaacatgcatttgtagttttaagttaagtacaatgattaagctagggtaaggacctttttttgtttgttgttcttttgttttttgtttttgagatggattctcactctgtcgccaggctggagtgcagtggcacgatcttggctcactgtaatctccgcctcccgggttccggccattctcctgccttagcctcccaagtagctgggattacaggcccgcactaccacactcagctaatttttgtattttttttagtatagacagggtttcgccacggtggccgggatggtcttgatctcctgacctggtgatccactcgcctcagcctcccaaagtgctgggattacaggcatgcgccagtgcgcccagcctgttgctgttattttttaaaccaatcttggttcactgcagcctcgacctcctgggcttaagcaatccttctgcctcagcctcctgagtagctaggaccacaggtgcatgccatcacacctgactaatttttgtattttttgtacagatggtgttgcacattgttgccgaggctggtcttgaactcctggtctctagtgatcctcccaccttgatctctcaaagtgctgggactaccagtcccaaagtgtgaactaccaggaccagctggtaaggatcattttggaaaattctcttctctaaccattttttaaaaaaaataattggccaactttcaatttcaaccaagttgaaaaagaagacagaggctgggcgtggtggctcatgcctgtaatcccagcactctgggaggccgaggcaggtggatcacctgaggtcgagagttcaagaccagcctgaccaacatggtgaaaccccgtctctaataaaaatacaaaaaattagccgggcatggtggcgcatgcttgtaatccagctactcgggaggctgaggcaggagaatcactcgaacccaggagacagagtttgcagtgagccgagatctcgccatcgcactctaatctgggcaacaagagcaaaactccatctcaaaaaaaaaaaaaaaaaaaaaaacagaaatgtggccaggtgcagtggctcacacctataatcctggcactttgggaggccaaggtgggaggactgcttgagcccaggagtttaagaccagcctgggcaatatagtgagaacttgttgctaccaaaacttaaaaaaaaaaaatcaactggatgtggtggcgtgcacctgttgccccagctacttgggaggctaaggtgggaggatcgcttgagcccaggaggcagaagttgcagtgagctgagatcatgccactgaactccagcctgggcccacctaacttttgacgacaccccaaacttctacctcgatattctccgacagattcttcacaggtatgagttgaccactagggctggtcacacggaggccaccgacagtcccgctgacatcaaagtggcttcgggctggaaaggggctctttgggaaactcatgatctgaaaccaagagcaaggagtgttggccaaggcccctgagaagctggagggtgaaagacaaggtcctaagactcaaggagaagtagccctggcgtgtggggcgggtggggcctgccttcggctgctgctgcttcccctggcatgtttccagcctcagggctgaggccgcagagaacctgcgctagaggacccatatcagacttgcttgggctgagcaatgactggaatgtaaaaccatccaagtctttttttttttttttttttgacacagtctcgctctgtcactcaggctggagtgtaatggcacaatctctgctcactgcaacctctgccttccgggttcaagccattcccctgcctcagcctcctgagtagctgggattacaggtgtgcaccaccatgcccggctaattttgtatttttagtagaaatggggtttcaccatgttggccaggctggtctcgaactcctggcctcaggtgatctgttctcctcagcctccccatccaagtctttcttccccaaaagccagtaagtctttaagagaaagatgtttgctttcactagagctcagggagtacacagttagacgtgctttaatttgcggatggaagagagcctgggttggccatttccaagttatgacactaagctgaagagctttatttccagtgactacctgaatcaaggctgttggagaaattttgtagcacaatggaaagagggtaaatctgggagcccagaggtgtgggtctgaaggccggcagagccacttacttgtggctttgggaaaatcattgaacctcactggtacagcgggcatcatcatactaaacacaaataaggaaatgcacgtgaaagtgctctgcaaactgtaaaggctgtccccaaggacgctactaccgttattacctttatatccacgggctcctggccgccctccagagagctgagggaggaggcagcgggcagcatgaaggttgcagagtctgcggcatcagggcgcagggaggagccttgccaactccagggttgtattctggccacaaggtgaggacagaggtggcaggggagggaggagaaagtcagtgttcgagggagccctcacacctcctgcactactgggagcccagcttcaccatcagagtgggggtgtgttttgattcccataggtggttcagcatgtttgtttcagcagaagcagcacaagaggcagctagactggaggctccatgagggtggggctttgccagcctggtttactactgtatccccaatgtctacagcagcgcctggcatataacaggtagtccatcagtattttcgttgaatgaataaatgagcttggatgcaggtttttctccagggttatctccccttcccacctggacctctgacgtcatgtcttaaccccgccccatcttttctggtctttgaccttgcccctttctgatcttgttggggaccccacttcagatcgttcctctaatcaggatactgctttgggaaactgtctgtgagatctaagagggaaaccctggcaggaggaactgaggcttggggcagagggtcccagtgttgccagcagcattgtccagctcctgcttgtcaggtggaggaatggaaggtgtggagcatcccaggtatggcatcagtgctcactgagagatgagccctctgtgtgtgtgtgtgtttgtgtgtgcgcgcgcacgccaaaagtaagaggatcttgagtccctgcaggcccaaggagcagtggctggtcagacacatgcacagcatggttaacagcaggctagtcccattcattcagccccctggcctgcacagctgccatgtgaccgtctctcaggactccttcaggtggatctaacactgggcttggcactccatgcctcccttcctgtgctgtgcaaacactcaacatggtgacaagggggccttctctcggtgggaagcccttcccagctctaggtcccatcacttctctagctccaaggctggtctcctgagctctgcctagcacagggctttggagtgccggtgtggaatgaaccaggttaggggatgagctttcttggggacctgtaacgcagctggtttgtacctgtttgtgtacacagagatggagggggtggccagcatggctggaaggccccctggcagttttcccagcaggagggtggtctgcacatgctccatgactcgaagcagccgcagcactgtggcaatctgaaaaaggaggcaggaagatgttgctatggacctgctgccatacaccatctttggttactgtcaccaggccaatgtgggaccttcaggagggatcgggagagtacagagaggagggagtaagactgcctcggaggtggcccaagaacagtactcataaagcttccagactggcttttgtgagcccattccatcctcacagtaactcggtgtggcaggggcttcactagccccattggacagatgggggatggaggcacagagagggtaggaggctgtgggaggtcacaaattgataaggggaagagccaggactcacggcaaagcatatggctacagagcccgtgtgctgggctgtcagacaatgtggctgtctgggctgctgacatctgccagcaccctaaggcttgttccaggggaaatggacagctgagagcgaggccatttcaccaggtcacctgggcttcgaatctgctccccacccgtcccaacccccagatgagatgcatcctgacaccacggctggtgcggggacccaggaagggctggatgtttgcacataattcctgttggggcacagatcgtgtgggtgtgagtgtgtgtgagtgtatgtgtgcatgtgcgcacacacgtgaacacacagtgtgagggtgacatcactgcatgtgaatgtcagtgtttgagcgtgtgtatgtgtgagcgaatgtgagtgtggtcctgagcgtgtgtgggtacagtgtttgagtgtgtgagtgtgcacaggtgactgcatgattatggagtgtgcaaccatatgtgagggtctgtgagtatgtgagtgcatgtgactgcatggccctgtgtgaagatgcgtgtgtgtaaatgtgcatctgtgtgcaaaagtgtgtgcttgaggccgtgtgagtatgaggtcctctcagtgtgtgtgtgagcttgcacatgagtgtgagtgtggccatgtgtttttgtgtgtgtttgtggagattgagtgtgtctgagcatgtgcgtgtgtgcatccacgcatctttgcgtgttgtgtgtctttcagttcttcctgaatggaggtgatggccccatgtgatcaagaaccatgcaacagcaagaaatgggttttgtggctctgtcatgatgccatctaggaggctatgtccccaccaggatgctggggccacgtgacacagtgctacacctattcttactctgggcagctgcctctcttctgtgttcttggtaaaatgagccacaagtttacccagacctgctagtgggtccatatgatctctccagttggcagcttatttgggatgaggcagagtgccttgatttacacataaggaaatgaggcttaggtaagctctgtaacttgcccaggtcacaagcctcctaagcgacagaggcaggattcaaactcagaccgtctcattccagagcctgtgatttggccaccactccacactgcctcccagaagccctgctctctggaaattttctctttttttctttctttttttttttttgagaaggagtttcactcttgttgcccaggctggagtgcaatggcgcgatcttggctcactgcaacctccgcctcccaggttcaagcaattctgcagcctcagcctcccgagtagctgggattacaggcgccggccatcacgcccggctaattttgtatttttagtagagacggggtttctccatgttgaggctggtcttgaactcctgacctcaggtgatcctcctgccttcgcctcccaaagtgctgggattacaggcttgagccaccgcgcccggcatgctctctggaaattttcttccacctcccagggcaacaccttaacctctgtgccgcactttcctcatctgcaagatggggggggaaagttccacctagaaaagctgatgtgactaagcattcagtgtgtgtgaggtctgcatctggcctggacacccacctggctgctgctggcctccgcaggctcttctggtctgttgctcagggaagcttccagcacactgcccacagcctgaaacaggtccctggtggctgcctggcgcctctggtcctcagggcgggccttggcactcactgtcaacagggcctcactggcatgctgtagagccaagctggcctcccactgggttcacccaaataaggaaaagcgatgtgagcctctgcttaagatagaccattcctgtgtcattcaagggacaagggaagcaaggaggggaacaagccaggaaagagctgggctagacctggcacacgagctccctgtatctccggcttgagaccagggcctcccaccttacagtcctctgagatcctctaggagagtagcctggtctgcctctgaatccttcccagaacgccctgcacagtgcccagcacatagcaggtcttcaagaacattcaatgactaggggacggatggatggatggatggatggatggatggatggatggatggataaatgaagggtggataggcagtttgataaatggatgtatggatgataggtggatgggtggaaaatggatggatggaggatgaatgaatgaatgggtggatggaggatgaatgggtgatgaatggatggatggatgggtgggtggatggatggtagatggatggatgggtggatggtgggtggatggatgaatggtgggggggtggatggatggagaatgaaggatggataagtgggtggatagatggatggatgacaggtggatggatgaatgggtggaagatgaatggatggaggatggatgaatgatggatgaatagatgggtggatggtagatgaatgaataggtggatggttgcgtgggtgggtgggcggatggattcagtacatattcaaattttgtagttttctatgtatttttgaaattatttgtctaatgtctggctgtctcagtaatctgaaaggaccgtaatggcagatgccatgtctacatgatttgctgctgaattctcaatgcgttgcacattacctggcacatacttgacattcaggaagcatttgttaaatgaatgatgaaattaatgcatgcatgaatggatagaaggatagagtggaggatgtgtacaggtccatgtatatacagtgtatatgcatgtaaatagatggattagcaaatggatgtgtaaatgggaagtgtcatatcaagaattagccccagaatcaagaccagccttgctggcttcaggctggaagattttaggagcacaacctcctaccagagtgcgtggggcaaagccaggacagttctcttctcttctgtttttttgtttgtttttgagatagattcttactgttgcccaggctggagtgcagtagcgcaagcatggcttactgtaacctcgaactcctgggctcaagtatcccttatgcctcagcctcctgagtagctgggactacaggtataagccagtatttaggtgttgttttttttttttttttttttgtaaagatgtggtttccctatgtttcacagactgggcttgaactctacggatcaagtgatcctactgcctcaggctcctgaagtgctgggattacaggcatgagccactgtgctggcccgctttccctgtttttagggcttctttttattgttattttttttcatagggtttgctctgtctgccatgctggagtgtagtggcacaatcatggctcactgcatcctcgaccttccgggctcaattgatcctcccacctcaacctcccaagtagctaggactacaggtgtgtaccatgatgcccaaccaattttgttttgctttgtttttgtttgtttgtttgtttttttgagatggagtctctatcacccaggctggagtgcagtggcacgatctcggctcactgcaacccccacctcctgggttgaagcaattctcctgcctcagcctcccgagtagctgggactacaggcgcacaccaccacgcccagctaatatttgtatttttagtagaaatggggtttcactatgttggccaggctggtctcaaactcctgacctcaggcagtccacctgcctcggcctcccaaagtgctgggattacaggcgtgagccaccgtgcccggcctttgttttgtttttgaagggatgaggtctcactatgttgcccaggctggtctcaaactcctggcctcaagcgatcctcctgcctctgcctcccaaaatgctgggattacagacgtcagccaccgtgcctcacctatggcttcttttttaacccttggctgtcagaaccctgggaacacggtgttttaatttgagttctccaagaagcagatcccagagcaagaatttgagagcaagtcatttatttggacatgatcccaagaaacacttgtggggagtagggggtgtgagacagggaagggtggaagccagtacaggagtgtgatcaagcccattacctgggattcactcctgcttgggattatccatcaagaggggtgaggtagctggggtgtttataagccagcttcattagtcactgaacactgcatgaattcacagccatatgggcaggtacagtaggctctgagggtcagagaagacccccagaaggataaggaagcacaggagctggcagccagatgtcaggctggcatgtactgaagttgagaacatgggcagtcagtagcagtgtctggactcacatttggccacccaaatattaatgagattcagttactccctcaacttgctcaccagcagatgcaggagtgagagtctgggcaaacaggccctctcacctagcgtgagatacatgggcagcaggaggggcaccttcccatgaatcgcccatgcaggacccctggaaagaagatgacagaggtcttggcagccccaaaatagccctgtgaccaagggaccccttcaacctatgctgatcacccacctgctgtgaaggagcgtgtcccatgttagcctctgtagatgggagctactcacctgggccgagggtgtgagttccttactccggcaggtcacctctctcagcacctcggccagctcctgcaccctctgcacgtcctccaagccggtggtgactgcagacagtgatcccagcacatgctctctgaccttggcacgggggagaaaggcagggagaggaaatgtaattctgtggctccatgaagtagtgtcaggaagatgcagggtcaggagtgaccagggttattagggggttctttttcttttctttcttttttttttttttttttgagtcagagtctcgctctgtcacccaggctggagtacactggcatgatctcgactcattgcaacctccgcctcctgggttcgggcctcagcctcctgagtagctgggattacaggtgcgcaccaccatcaccagctaattttttgtatttttagtagagacagggttttgccatgttggccaggctggtcttgaacttctgacctcaagtgatccacctgcctcagccttccaaagtgcaggtattacaggcgtgagccaccgcacctggcctcactggtggtttctaaagccctgcagacctctgtctgccttgtatgatgtgtgattaggcagataacagccccctcaagatgcccacattcacatccctgaaacctgtgaatatgttactgaatgtggcaaaaggcactttgactaagtcattttggagaagcaattaagttaaaaattctgagatggagagattatccgaacaggtgggaccaacgtcatcatacgacccttctaagagggaggtaggaacgttaatcagaacaggagatgggtgatggaggcaggggtagggggaagaaaaagagagggaaagaggatgaggtaagggtggggagagacagagggagaggagaggactttggagatgctgcgtggctggctttgaagataggagtcaaggagtgcaggcggcctctagaacccggaaaaggcaaggaatggcttctctcctggagcctccaggtttgcagctctgccatcaccttacttttggcctagtggaccccattttaaacttctggcctccagaactataaagtgaataaatgcgtgttgcgttaagccatgatctttgtggtcatttgtaacagcagccctagcaaacatatataggatgtctcaagctttctccaaatcttcaaattgaatctgtagaatttggcactatttgaaaataaattgtgtctcagcgtggcacctgtgaccagaatggcatgaaattcagaaactggatgactgttggtctggcatggatgggaggtctcaccggaggcttggggtccctgtgtgcctttgcagcagtggggacaagaacccccctacccagccctccactcctgtcttgggccaggccacgggcttcagggtcaagtgctttctacactacaaagcactaatgaggggctggtgaggggctttggtaggagcagagaaaaactaagaacatcatttcagcactgcccagtagaactgtcatttgtaactttatttaattttaataatgacttagatttaagcagcagccacttttgatggggcagagacaccgtggcctgttgctcacacctggctcagcctgacaggctttcccgaagcttccaagtatgagtgcatctgccatccattccagggacagccaggcctccatcccggctgtgtcttgggttgaggaaagaataggtcagtgtggcaggagactctttgcagaatattccagaagggaaactcagataatgggtaatctcacatttgcttctgcaggccctgaccccatcgtttgtcacctaccctgggtaaagatgtcaccggctctggaccctccggcaaatggactcacccagcaggagcccagcaggggacgagatggcaggaggagagagagctgggaggggtcattctcctgatgccctcggccaggtcaccgggggctggccgcctcattcttcaaaagccacagctcctaccagagagtccctctgtgggcagccgccccctggatcctgctcacggcaggccgggcctctggggtcctccacgctgtctagtttgttccctaagccctgcacacacctgtctcaacagagcccttgttaacatcttctcagcttcccagtgagagtttgacatctgtcttgtgccaggccccgggcatttcatggggagaccttgggttaggctgtgtggtctgtgtgcttggggaccacaggatgtccaggggaagcttcccattggtacttctcagagtgaatgtgaccaagaatgagagctgtgtgtgtgtgaaagtgtgtgagtgtgtatgtatgtgtatgtgtgaaagcataattgtgtgtgggagtatgtgtgtgtgtgacagcgtgtcagtgtatgtgtgtgagcatgtgtgtgagtttgtgtgtgcatgtgtatgtgtgtatatgagtgtgtgtgtgtgagcatctgtcagtgtgtgtatgtgtgtgagtatgagtcatatgagtgagtgtgtgagcatgtatgtatatgcgtataagtgtgtgagtatgtgtgtgggagtatgtgaatgtgtttgtgagtgtgtgtgtgtgaacatgtttgagtgtgtgtgtgtgcataagagtgtgtgtgaaagtgtgtatgtatgatgtgtgagagctaatgtgtatgtatgtggcagggggtctggggtaagagggctggaggtggagggggaacctctaaactgggtttgaacccaggcttcaccacttaccagacacagggacacaggcaggcacctctgattctcttaccctctgtttcctcagctgtaacatagatggaggcctcaccatttacgtcccagggttgtagtggggattacagatccatgaagccctaattcagggcctggcagctcatagcaggtgcttgatacatgttagtttctctcggtaagcgaccacaatgacaatccggcttcctgtattaagtacctaccaggcctctagcaccacactcagtaccttcctgcaaacctttcagggagccaagagaagtctttcttctcttctccgtgcccacaggggtgtgtgtgtgggtgtgtgcatgcacacacacgaacacaaactcatgtggcacatgctgggagtggacacaatcatacgttctgcaatagtttatcatactaggttgtaacaatggaacggccatttttgtagattaaaactgattgaatgttgacggtcttatctagttttttagttgcagtgatcgtaattcttatttaactcttactacaattgtatgaggagactagtattcttctatatggggaaactgagacttagagaggtttggtccctggcctgtgacaatgcgaatggtaagtgacaaagccgggacgccatctgtggtccaactccaaaccgctacccatgtgaccgaggacagtcccctttctgctctggggctctgccttgtcatctgaaacatgaaaagcaggggatgatgtgttctaaactccccccatcccagaggcctgtgcctccatgagggccagccgagaaagcaggttaccaaggaagaaggcattttcttcactttatgtcactcacccaaaagaccagagagggaggtggtgtcagccgcttgggagacaccacaggtttctcccctgatccatgaaccttgatccacagcccaaatggccgcacgcagaccctggggccccagaggaagggaatgaaaggagccccccagcttcccacgggtaccttctgtctgacgtctatgctcagtgactgtcctgagccctggctttcatgctcttggttcagcatggaggacacagccttggccagctggaggagctgctcggggccaccctcgccttgcagagctgtggggattttctctgacacggcagcctggaatgctacatcctcaacacatgtgtctccgagtgccacctgttaggaaatcagaaatatgctcagaacctgctaggaagaagctggcctctgaagtcaggggtcttcatgtggggtcagagaggcttggatgcctttggcctggcctgtgggctctcgagcacttcctgaggctggagggcacccagacctgctcgcaccaggcagctgacagccacccaaaccaagccttggttggctccagcctggcgcaagtcattgctctaccactggccgccctcctctcttggtctcaacctcttccacccccacctggcctctgacgcttgaaatcttcttggaatcttatccaggctcttccttgagtccttgttggctaatcttggtcctacttcttctgagctctctgaaggtgctggcctaactcatgccagagtcattctccaacccccctcacccacccaccagctcccaggaccctccccctattctggccactaaatcataacatctacaaaggtagagaccatgtctgttgtgtccctggctatacccccaggacgtggcccagggtagatgctctgtaaatatttgtggaaggaatggatgaatcactgacttatctggctatgcccctggctatcttccatccggccatccttttagtgaggttcatatgggtggagaatttttctcagtaaagaaacagtgaccactgccaccacctaccttagccatggcctgggtctgctgcgtgtcccctgcacgattggtggcagaaataactactgtcagcacaaagtcattgttctcctctccaagtggcagatacactgatgggagggcaggttcagggccacagtgtaggcaggaacctggcaaaaccagaaattgaccgatgagggggcatcgctaagccccaggtagactgcaacccactcaggtagaggctggtgacagggacacaaaagccacagctcttgaaggcatggtaggctctcgggattccacactttcaagtatgagacagtcacgtatgctgattcactgtcttctctaagcaactgcaggttgctgtaactttggaaaaattttactaaaatccataaaaaattgcaggaaaaacatcccatttacagttttttttttaaaaaaagtcaaggtggtaaaccaaattataagaggaagaaaaagaaggaggaggaggaggaggagcaacaatgacaacttaaaacttagctcaggggcgaggagttcaagaccagcctgggcaaattaggaagacgttgtttctacaaaaaaaagtaaaaattaggtctcgaactcctgacctcaggtgatccacccaccttagcctcccaaagttcctgggatgactgacatgagccaccacgcccagcctgggactcgtttttatgtagccacactttcctgcctccgtgctcacttggatgatgggggagaggtactaaagaggaatagcctattggaattagggcagctgtcctggcctttccctctggcgggacgcagtttgaaataacatccacttaccttgcttgaactttttcctttcagactcagccccattcacagccctcttaacggtgatgcatttccacatctattagacagggcgctcgtgaaaactacactctcttaggtattacaatagctgacgtgcactttccctaatcaaggtgtagtgtttatgccgttgtgatgtttgatgctggatttgggggaccatcctggcaacactactggtggctgactttggtggaaatttacaatctgattagagcattttcagagcacagaatgacaaagctctcccgggcgtgtggcttacatctgtaatcccagcactttgggaggccgaggcaggcagatcacctgaggtcaggagtttgagactagccgggctaacatagtgaaaccccatctctactaaaaatacaaaaattagccgggtgtggtggcgggcacctgtaatctcagctactcgggaagctgaggcaagagaatcgcttgaacccgggaggctgaggttgcagtgggccgagatcgtgccaccacactccagccttggcaacaaggcaaaactctgtctcaaaaaaaaaaaaaaaaaaagaagaagccaaagcccagtgggtggagatcagggctcagatgagccctccaaggaccaatcactctccaaatggaagaataaatgcaatgtgagtggctccctcatctctcctgctaatgccctgtggctgtcctggggtgtgagtggttagggtgaaagcagggagactgtgtagggttttatgcattgtggatggggtcttccatgtttgtcacctgtacacctttgcaaaaatgttctttcagttcagctagtcctgcaattatcacccattccctggggctgcttgcaaagcagcgtcaatgaaattgttgaagattctgttaaccagacccatctctgtcttcctgaatagctccaggcttctgggagtcccagctactacaagtgtgtgtgtgtgtgtgtgtgtgtgtgtgtgtgtgtgtgtgtgtgtgtgtgtgtgtgtgtgtgtgtggtgagcaggggttgggggatggtgtcttggtggtggccccacatggtcatacttttgggtatcctcgttcatttcactccatcactgtcccccacgccagggcaatggattttggcttccagttgtggaagagctattgatgagaccttcttctcatgtctctgtggactgatggctgagtcagtgtcttgaggctaggggttgaggtttaggggagccctcatcctaccaacctctctcgcacacggaacatattctttgcagctcccagagagaacaggcccctgttctgcaagaagatgagcccaggagctgagggaagagcagagtcttcagccggtacctgattccagacagaagcagaactccaggggtcccagggctgtggaggcgttgcagaagatggcaaagctcgtcagaacggtgccctcctctggggcaatagtgcaggcaggcacctcacggggaggcacagtgctgatcacataggtgtcctccccataggcatgcctggtcagtgctgggagtaaagagagatcatgttcagggggccacgtggggcccacaaactccatcctgctgttagattgccccctgagctcattaaacacaaagattcttgggctctacttcaaacccagaacttcagacatctctggatctgggaagagcccagaaatgtacatatctaacaattaaacaatgaaaccccaaaacaactccccctgatgcaagggatcccagggcctcactttgagaaactgggcagagataggggaagataattagacagacctgagcttgaattttagttctgccatttgttaaccgagtgacctcagacttgaccttttcttttccaattttgttttcctaattttttttctttttagagatagggtcttgcactgtcacctaggctagagtccagtggtgcaatcataacttactatagccttgaactcctacacttaagtgattccactgccttggcctctcgagtcagctagaaccacaggagtacaccattacggctggctaattttctaatttttgtagagacagggtctcgctctgttgccagggctggtcttgaactcctggcctcaagggatcctcccgcctcagcctcccaaagtgctgggattacaggcataagccactggacccgggctgagaacttgacctttttgagagtcagttcctcatctgtagaatgaggctgatgataatagcttccgcacaaagatcttgtgaggtgggagtatgctgggaaaatgctcaagatcacagagccaggaaagaccagaaccaggatccggaaacaggctgagcccaccccgaagcccacactcttcccaggcgccgagatcactgttaagagccacgagtggacctgcagtcacatcccacatcacctggagtagccacctacattttcagagagcgcatgcctggaagagctgggcataaagagaatttgaacccataaaaactcattccttggcctagacccaattcggaaagtttggggtggacccaagagtgtgcatgtttaactaattccttgtttatcctgatgtgcatggtctgtgggccacttcgggaaaaatggaagcaaagcaatccttcctaaaaagaatcatcacctccattgtttgtgtgtttgagaatctatgtttctcacacagggcttgttttaaacgagaagccctgaacaatcctggcagggtgtacaggttgcacgaccccagaatgacctgcttgtaacactggggttatctcattcatcctgcaaaataaccattctgaggcaggcatttcgattatcccagtttatatgtcaggaaactgaggcatagagaggcgaaatcctctgcctagagtctcccacgtagaaagcggaagtggtgcgatttacaccagagcctgcgctgtggcctctgcactaagctgatgccctggctgggtatggtgactcacagctgccatcccagcacttcaggaggctgggacaggaggatcgtttggctccaggagttcaggaccagactgggcaacatagtgagatcacatctctctatttcaatatttaaaagaaaaataaactgacacccaatatctgagtgtttctgggtttatctgggttccctgagaggagataaaagggaggtttcgcacctgtggctctgattcggatgacctctccccgggactgcagaaacgagctgttcaacagcaacgtggaggtgttgctctggaggagggttaaggaccttggccaaaatcctctgagtctgcaggcatccaggaggggctcagcctgaaagacaggatggcccagggctgctgacgctacagccaggccacaggactgcagcaggacagtggcttctgggtgctagacagcctttcagatttattactgatgaacggaggacaggcagccccagctccccaagaagtcacctggaatatacactttccagcctcactgcggtgtctgtcttagattgggctccccggaagcagagcctgagatggggatttgtgtgcaggttatttatttgtttatttttgagccaggcacagtggctcacacctctaatcccagcactttgggaggctgaggtgggtggatcatctgagctcaggagttcaagaccagcctggccaacatggggaaactctgtctctactaaaaatacgaaaatcagccgggcatggtgttatgtgcctgtaatcctggctacttgggaggctgaggcaggagaattgcttgaacccaggaggcagaggttgcagtgagctgagattgtgtcattgtactccagcctgggtgacagagtgagactctgtctcaaaaaaaaaaaaaaattaaaaagaaaatatttttgagacggagtctcactctgctgcccaggctagagtgcagtgtatgatctctgtgcactgcaacctctgcctcccaggttcaagtcattctcctgcctcggcctcccaagtagatagaattataggcacgcatcaccataccccgctaatgttttcgtatttttagtagagacggggtttcaccatgttggccaggctggtctcaaacccctgacctcaggtgatctgcctgcctcggcctcccaaagtgttgggattaaaggcttgagccaccatatccagccttgtgtgcaggttattgatggaaggaggattcacagggaaaagcagtgcagagagggaaacagcagagaacaaaacaaggcaaaaaacagttactggaggcatccagcctctgcctggtcacacggagagccctgaagtgtaagttgcacaactgaaatcaccctacctggggacagagaagctgggctattagaccctccacccatcagtcgttggccaatggtcaggccacaaaagctggagttaggatcgtccgcctgggaagcaggacttttgctgagatgccaagagcacccgctgcaaagtttctccagagcttatgctcctttgtgcccatttgccctgctgtcaattccctgattttctccccagcccaataccctgagtcccacaccacaggctctgaatggaattgacccaaccctggcccagtaccgggcatgcgacacgggtgtgctgaaagcgcaagggagatttccattcttgagtggttgtcactgtgctcacctgctctgttggggtgttgtccaaataccagctgaacatagccactggagagtcctcccccatggtgaccctgagcagaatgtctttgctggcattaactggcctgcagttcctctcacagctgaaaggcagacagaggacagagtgaggaagctccccgaggcattgctatcatctggatgtttgtcccctgaaacctcatgttgaaatatgatccccaatgttggaggcggggcttcatgggaggtgtttgggtcatggggttggattcctcatgactggatgaatgcctccctcgggagcgagttcttgctctattagtcaccaccggagctggttgctaaaaagatggccgggagcagtggctcacgtctgtaatcccagcactttgagaggcccaggcgggcagatcatgtgaggttaggagtttgagaccagcctggccaacatggtgaaaccctgtctctactaaaaatacaaaaattagtgggatgtggtggtgggtgcctgtagtcccagctactcgggagtctgaggcaggagaatcatttgaaccagggagatggaggttgcagtgagccaagatcacaccactgcactccaacctgggtgacagagtaacactccatctccaaaaaaaaaaaaaaaaaaaaagagcctggcacctcccacccttctctgcacacaccaggtccccttcatctttcactgtaagtggaagcagcctgaggcccttatcagatacagatgtccagtcttggattttccaaccataagaatcatgagccaaataaatctcttttcttctttcttttctttttcttttctttttttttttttttttgagacagagtctcgctctgtcgcccaggctgcagtgcagtggcgcgatcttggctcactgcaacctctgcctcccagattcaagcaattctcctgcctcagcctcctgaatagctgagattacagacaggcaccaccatacccaactaatttgtattttcagtagagacagcgttttgctgtgttggcctggctggtcttgaactcttggcttcaagtgatccacccgcctcaacctcccaaagtgctgggattacaggcatgagccactgcgcccagccaaccatttttctgtataaattacctagcctcagatattcctttataacaatgcaaaatgggccgggcgcggtggctcacacctgtaatcccagcactttgggaggccgaggctggtggatcacgaggtcaggagatcgagaccatcctggctaacacggtgaaaccccgtctctactaaaaatacaaaaaattagccaggcgtggtggcaggcgcctgtagtcccagctactcgggaggctgaggcaggagaatggcgtgaacccgggaggcggagcttgcagtgagccgagatagcgccactgcactccggcctgggtgaaagagcaagactccgtctcaaaaaaaaaaaaaaaaaaaaaaaaaatgcaaaacggactcagacaggcattgtgaccactggcctggtcttttgtccagtccttctcaagtcctttgagagggtaggaaatggccctttttcaaattaaagatggaataaaagccgcccctgccccaaccaacactgggacgtagccttggttgtgaagatggactgagtcatggcctgactgaattcccatgtcattcactgacagcgtaatgatacggaaggtgaatgaggctgagacaggacctgggttctaatcctgtccttgtcacttatgaagggtcaccttgtgtgcatcacttaaactttttttttttttttttttttttttgagactgagtctcactctatcgcccaggctagagtgcagtggcacgatctcggctcactacaacctccacctcctggttcaagagattctcctgcctcagcctcccgagtagctgggattataggcgctcaccaccatgcccggctaacgtttgtatttttttagtagagacagggtttcactgtgttggccaggctggtcttaaactcctgacctcaggtgatccgcccgcctcggcctcccaaagtgctgggattacaggtatgagccaccatgcccagccgaatcacttaaactctctaagcctcagtttcctcacctgcaaaatgaggggatagcctagataatttctgtgattctttttagttcagataatagtaaactaatgctgtggttcaacagcacgcctgccatgcacacattacttccattgtctctagcttgtccaatgctcacaatagccctatgagtgacatattagcatccccacatcacaggtgagctaaccaggccccgagagcttatgtgatttgtcctaagtgatgtaacttctaagtgggcagatagaatgtgaaccatcgtgtctggatccaaactcttggccttctctataatgtctctgtgaaggccaaagcaactccatttcagatgctaatctgccacgttgactactgattaaccccaattccaggaatgcctctaagatttctattctctctacagttctttgtgtaagagcatgtacttactatgagtgctgccctgaaagagattcacatagtattcttacctttccctacgactgtcctacacattcctttcctatggtatataagccctggttctggcgggtaatggcgctggctttcaccatcttgtcttgcagctgccctagacatcatggtttctgttcgcaagtctcaattaaatgtttctttctaagaaactaaatttgtcagcttctttctctggcctctctgcttcctcgaactttgcgggaaggtttgcatagacctgccctccacaggacggtcccccagtttcccctttggtctgaacttgatgacagctcttgaacttcctacttatctcctcatgtctgccctagtccaagtgtgcaggacattctctatctgcctctccaatccagtctcctcccacgtgcggctctgacctgggagactgagctctatacactgcatcacccaagctgccacaccctccagcttctaactgggtccagccaatgggaaccattgatagaggattggagggtgagaggagagagtttggggaatttattcacggctttccctgctcttttccctgatgggctgcaggtgagagatgctgtgcttctccaaccaaggccacagctccctacgtatgtagtcctgcctaatcttacctctgcattcctgggggtgataatggcttcccttggttgtagtcctgccttgtcgcccctgcttcattgccttatacctgccctcacctgtaaatagtcccttcatcagctctcttccattcattcctggtttggctgagccatcagcttcctgcagggactggctgatagtccaagcaaacttgacctcctaccttgactcctgcaagagcctgggcaatctccctgggtcttctcttgccctcttccaagtcattctccactgagccaccagagcatattgaagtcacatgcttagaactcttggttgcttggcttggcatggtggctcattcctgtaatcccagcaatttgggaggccgaggcaggtgggtcacctgaggtgaggagtttgagactagcctatccaacatggtgaaaccctgcctctacaaaaaatacaaaaattagctgcgcacggtggcatgtgtgcctgtaatcccagatactcaggagtctgaggcacgagaaatgtttgaacctgggaggcggaggctgcagtgagctgcgatggtgccactgcactccagcctgggtgacagagtgagactccatttcaaaaaaataaaaataaaaataaagaactcttgggtggtttctctgtatcactcttaggaaaaaggctaaaatcttgatatgaccggcaaggccccacttgagccaggccctgcctacactaccagctccttcccacccttctcttctccatcctcaggacattggcctctttcgctccctgatgattctctgctccctccctttgcccgctctgttcctgctccagctgccccttccctgccctgtgaatttctcctgaacacctctgctgagctgcagttcctgagagaagtctctctaaccccagtcagggcagttttcatagaggtgcgctctctgccttcttcattcgtgtccagaagtgctgatcaccaggtggtagtaacccctatgacaacagagaccaccacagcaagccttgccccaaggcagccccagcctcagtgggtcctcagtaagtgttggctgaacgaatgaatcaggaccctggaggaactgcccacgtgccccacctgactcgaggcctgagttcccagggcgcagacacgtagaggcactgctctgccctgttctccagctcttggcctctcagaacagccaggcgcagggtgacagcagagtcaggcggcggcaggcaggatgctggaaccaccagctccctctggtctgtgcgaagcagctgcctctcaacacagctgctccacagagcccagcaagaccctgagagaaatggacagacactatgatccatcaggagccctgaacgtggcacacactgctagcttctggttttgaaaggggtcatgaataataacatcagctctaaatagacattttaattttttaatgtcagttttattatttatttattttgagatggagtttcccccttattgccaaggccggagtgcaatggcaccatcttgcctcactgcaacctccgcctcctgggttcaaatgattctcctgtctcagcctccagagtagctaggattacaggcatgcaccaccacacctggctaatttttgtatttttactggagttggggtttcaacacgttggccaggctggtctcgaacttccaacctcaggtgacccacccacctcggccttccaaaatgctgggattacaggcctgagccaccacacccggccaaaacgtcacttttaatgcaggttgcagaaatggtgctatggaaggatgcttttgggaaaaagaaccatgcttcacccaaactctgagcaaatctgcaggatgtggttggcttgtgttgcactggtgctcaggaaggtgtgtagcaggagaggggccaggaggatctgtggccctgggagaaggtccagggcagcttcttatcccggtatatttgtcattccatgtggatgaggctgtccacagcgccaagtccctgtgggctactacggcggcctgggaggttgtactgccatctgggaggctgctgtgtcacctcctgctttatgttagcagcttcctaagtttctgtatcctctgcccttcaactctattgacagatgtttactcatcaatacctcacctcccaccatctccaatatggtgacaggcatatagcagcagagaggccaggaagatctaaatccccaggagaatattcccaagattcctgggactattccaagaattccaagattccctagatctacagccctgggagaacagtcccaagatatgttccctgagcatatttccaaaatatgttcagggttcaggctcatcagctcggtcgcctaaactctggacttgcatactctgtattcagataaggagaatgaatattcagagggatgtcattaccacgtaacaattaacatcaaaagccttaaaatgttgcatgacttttgacccagttattccatttctacaaatttatttatgaaagtaaccacagttgtaaatagagattgaactgtataagagcaaacaatgtgaaacaatctaaatgtccaaaaagagggtaaagaaatgatcgcacatcagccgggcactgcggctcacgcctgtaatcccagcactttgggaggccgaggcaggtggatcacctgaggtcaggagttcgagaccagcctggccaacatagtgaaacctcatctctactaaaagtacaacaattagttgggcatggtggcacgtgtctacaattccagctactcgggacctgaggcaggagaatcgcttgaacctgggaggtggaggttgcagtgagccgagattgcgccactgcactccaacctgggtgacagagcgagactccatctcaaaaaagaaaaaaaaatcacacatcaacattatggtctattgtgcagctattaagaaaatcaatatagagacgataccacgacattataatatgcaaatatgcaggttacattgttcaatgagaaaagggtaaagaaaacagtatgaataacatttctttctttctttctttctttttttttttgagacggagtcttactctgtcgcccaggctggagtgtagtggcacaatctcagctcactgcaacctctacctccaacattcaagcgattctcctgcctcagccttttgagtagctgggattacaggcacccaccaccatacctggctaatttttatatttttagtagagacggggtttcaccacattggccaggctggtctcgaactcccgtcctcaagtgatccccccacctcaacctcccaaagtgctgggattacaggcatgagccaccgtgcctggcccatttattttatgtctaaaagctaaaagaatgtgtatgtagctaggctatattcctgtaaaaaggaggataccatttctacaatgtgagcgctagtgctgccatcttggtttgttggaaaatgcctgactcacttcccccttctagattctctccctagggatataccaaagggctggggaaaggggaggagtccacaccagagaagaggagcactttatcacttttgtttggaattgtcagcgtatggaccagcttttcaggtttcattattgttttaaaattctctagatccccttgctgcctgcattcagggccacccttggtctgtcactgctttctcccaccttctattttttttttttttttttttgagacgcagtcttgctctgttgcccaggccagagtgcaatggcacaatctcagctcactgcaacctccacctcccaggtgcaaacaattctcctgcctcagcttcctgagtagctggaattacaggtgtgcgccaccacgcctggctaatttttgtatttttagtagagacggggttttgccaagttgaccaggctggtctcaaactcctgacctccagtgatccacctgcctcggtctcccaaagtgctgggattacaggtgtgagccaccacgcccggccccacctcctatttccatggaatttgcaagctctggcatgtacaagttatacaaaatgtaggccatagggaaagctggtgcgaagattaagaaaaagaacagcaaaatctgaccactgctcaccacttcttagtgaaacaggacaattcaagaactctatcattggccaggcgcggtggctcacacctgtaatccgagcactttgagaggccaaggcgggtatatcgcttgaggtcaggagttcgagactaacctggccaacatagtgaaaccctgtctctactaaaaatacaaaaattagctgggcgtggtggcaggcacctgtaatcccagctacttgggaggctgaggcaggagaatggcttgaacccaggaagtggaggttgcagtgagccaagatcacaccgttgcacaccagcctgggcaacaagagtgaaactccatctcaaaaaaaaaaaaaaaaaaagaactctattgtcacctaccacatgaccattggaagcgtaactccttgtcattgtctggccagcccagggtcactgtcgtgaaaggatccacatatggaccaggttggatgtacacctccatatcgcctttatctttctgcaaaaaaaagcagccagctggtgagactccaactacagttagctcaggctcactgtggggtgctgttggcattcccctttcaccccagagcagtctgcaccaagagcagctgcagtgtaaggcgtggggtggagacagaccctggccaatccccctggcttccttcccctcatggggcgtggagttggttgctcaggatccctgggcaagtcacgttattctgagtgttggctcggggtacacggggtgttcctggagtaagttctggtgggacttgttaaacagcttgggctgtggagcttcttgctcaagccccgaagtcctgacctgaaataacacagggctccagtggaactcaagccccagtggcctcccgtggcctgagaataaaatccaaatttcttgccttggcaactaaggctccgcgtgatctggcctctgtccacgtgtccataatctcctacatccctccctccaacaggctccagccacgctggcttcaggccatcgcctgcctctcagatctgcccactcagaaagctcttgttctgctttcaggcatggctggctggcttatcttcatgtgtccgcttacatgtcacctctggagaggccatgtctgaccacatcagccagaccaccctgttcgttgctatcgttgcactctattggttcttattagatacttaccacaattcctaattctatgataatttgtttgttggagttttttttttgagacagagtcttactctgttacccaggctggagtgcagtggcacggccatggctcactgcgcctcaacctctcaggcccaaactatcctcccacttcagcctcccaagtagctgggaccataggcatgtaccttaatgcctggctaatttttaattttgtttttttttttttgagatgagggtctcactttcttgcttgaactcctgggctcaagtgatcctcccaccttggcctcccaaagtgctgggattacaggcgtgagccactgtaccgggccgatatgttcgttagtatcactcagtaagcttcctgaaggcggagaccatatgtgcttattcactattgcattcccagcccctgataccaagccttgaatgttgtagatgcacagtaagtctttgttgtagaataagtgcacgcacgaacaacgtcaacagcaaggagctgaactcagtcttgttataaaaactgaagagcttggtctgttttcttttcttcctgctttctaatataagcattaaaagcgataaatttctctctgagcactgctttagctgcattccacaaatgtgcataggttgtattgtcattatcatgtagttagaaattttttctaatttcccttgtgatttcttcttgacctattgatttttttacaagtgtgctgtttaattgccaagatatctaacagatatctacatatcctagatagctcattatagatttacaacataactctgttgtgattagacaacttgctttgtttgaattcagtcattttgggcctcttctcaaatggaagaagcctcagggattcctagtgctctgggtattggtaccaaaaaaccaaaactcaaaactaaaacagagtgcttggacatcttttccttgtgaggttaaacgttttttaaagacaatactcacactctttccttcagcattcatcccagatggttcttggagaccggaaggggctgtgaacacagtgggaacgggtatcaagctttggttggaaaccttataaaaggctgtcaaaatatagagtcagagagtcatgtggaaaatgccaccaggggcgtcagcctgtctttgaaaatggtttaagggaacatagcaaacattcaggtcctagggaaatggattaaaagtgagtcatcttgtccaccactggactaaagacacccctttggtagttgagaaagaggcagctgccagtgcagataaaacacaagatttagagtcagacagatgcagctatgcactgctaatgtgtgtttttgttttgttttgtttgttgtttttgttttttgagacacagtcttgctctgtctctcaggctggagtgcagtggggcaatcttggctcaatgcaacctctgtctcctggttcaagtgcttctcctgcctcagcctcctgagtagccgggattacaggcacccaccaccacacccagataatttttttttttttttttttttgagacggagtctcgctctgtcgcccaggcgggactgcggactgcagtggcgcaatctcggctcactgcaagctccgcctcccgggttcacgccattctcctgcctcagcctcccgagtagctgggactacaggcgcccgccaccgcgcccggctaattttttttttgtatttttagtagagacggggtttcaccttgttagccaggatggtctcgatctcctgacctcatgatccacccgcctcggcctcccaaagtgctgggattacaggcgtgagccaccgcgcccggccaacccagataattttttgtatttttagtagagacggcgtttcaccatgttggccaggctggtcttaaactcttgacctcaggtgatccgcccatctcaacctcccaaagtgtagggattagaggcatgagccactgcacccagcctgcactgctaatgtttaactaccagtaaaggaggtgggagtgagaagccctgatttgtagggtttgtcaatttccatggtataaatgttcccaccaatctataagcctgatgctactgaatatagagtgaggagagatgggcacgctcacctctggcaagtgggtggagtcggcaccacacactaccctgttgtcagatcctcttactggcctcccattggctatgtgaaccgggcaggtgagttatcctctctgagtcttggtttcctcatttgtaaaaatacctggagtccatccccatttctcagggctccaggaagactgaatgtggtgctgtttatagaattgctttgtaaactatacatctagaaagaatgtcatcctggctaacacagtgaaaccccatctctactaaaaatacaaaaaaattagctgggcttggtggcgggcgcctgtagtcccagctactcgggaggctgaggcaggaggatcgcttgaacctgggaggcggagcttgcagtgagccaagatggctccactgcactccagcctgggcatcagagcaagatcctgtctcaaaaaaaaaaaaaaaaaaagaaagaaagaaagaaacaaagaacgctagtttttcaagtttaaacaatggaaaaagatacaatcaattgatgtctctgaaaatatatatatttttgagatggagtctagctctgttgcccagcctgtagtgcagtggcgtgatctcggttcactgcaatctgcccctcccgggttcaagcaattctcctgcctcagcctgctaagtggctggggttataggtgtgcaccaccacacccagctaatttttgtatttttagtagagacagggtttcaccatgttggccaggctggtctcgaacctctgacctccagtgatccacccgcttcgacctcccaaagtgctgggatcacaggcgtgagccactgtgcctggcctactgaaaatattgaaatattaatgattaatatctaattaaagtgtagtgcttaaagtaggaacttagagttatttcatgtgattcactaaggccctggatatattaaggtctgagtaccactgatctttaaaaaattctctcccagtgaattctcattcacacaactataattccaaaggcatgtaaaactgtacaaatcaaggctaagatgccagagaaaggggactttcttaaccttaagaaggaaggcagtccaatcaccctgaatgaaaaaattaggagaaacatttgctgcctttgatcctgcatgaatcagccatgtgacttctgcaaagtcaattaaactttctgggtctcaaatcccacatctggctgtcgaatttccaggcatctatgatcccctcccttggtagcagcatctacgggtgatattttccctaagaaccatccctccccaactctcaggccttggtttgggtgaagctgaccctacattgtactccagcgtgggcgtgagaccctgacctgccaaactgactgctgcttcccctggtctcagcagctggtccaggagaaaccatgaactgagcttcagccagcaagaggcagcctcaggacttctactagaaatatccatcaagacgtactctttctcctctggggttaaagatcaaagcctggggtcatcttgctactgctgggaagagagaatccaaaagaagtcaacacagaaccagaggaggaaagaggcaggtttctgaagacactgtctgagcgactcatccagctgtgtttaagaacaggtctactccctgggcttttcattttcattttcttttttcttttttttttttggtcggggggtggggacaccatctcactttgtcacccaggctggagtgcagtggcatgatcttggctaaatgcaacctctgcctcccagattcaagcaattctcctggcctcagcctccccagtagctgggactacaggtgtgtgccaccacgcccagctaattattgtatttttagtagagacaggctttcgccatgttggccaggctggtctcaaactcctgacctcaagtgatccaccacctcggcctcccaaaatgctgggattgtaggcatgagccacggtgcccagctggcttttcattttctgagctgataaaatttccttttgacccaagccagtttcaccttcgtttctgtcccttgctacttgaattgtcctagcaaacacattcaagtgaaccctacctctgtgatggctactctcagctagttccccaacagccattaccccagccttcctcctggcagccagaatccaccttctcccacagaaactgaaaatgctgggtatctgcttttccagtgcactttatagcagcggacctgaccctactttggtcatggtatctgaggtgatgattgcttagagtgagtgggaaagatttttcccctaataaaaagaggtgcacaggaggaaacccctgctcccgctgctggtacgctgcgttgacatgtaatatccggaactgcagcagtcactttgattccttgagcaacaagcctaaggcagcaccaaagctctaaggatggcagacgagaaagatagactgagcctggtttctcgctggcatcactgagccaccgaaccaaccctggaagtgcttacctcctaacttcttatgtgagtcaagaaagccctgaatctgaagctacttaggttggaccttctgttacttgcagcttaaagcatcataatgaacgcaaactcttgttttagaattctgtgtcagtggttggccgggtgcggtggttcacgcctgtaatcccagcactttgggaggctgagacgggcggatcatgaggtcaggagatcgagaccatcctggctaacatggtgaaacccggtctctactaaaaatacaaaaaaattagctaggcgtagtagtgggcacctgtagtcccagcaactcaggaggctgaggcaggagaatggtgtaaacccaggaggcagagcttgcagtgagccgagatcatgccactgcactccagcctgggtgacagagtgagactccatctcaaaaaaaaaaaaaaaaaaaaaaaaaagaattctgtgtcagtggtgaaatgttttactgtaaacatcattgcctccttagaataactggagaattctaaccatctgtagaacaagatacatattcagagccgtgtttggaaaggcccctcactggagcccaagcaggtgcaatgctctggactcttggtaaaaggttttatgctcccttgcagaaacaccttgcctgtgatagtgatgttcccgatttccaaactcaggttggagaaggcattcctcaccagcatggtgaccagaaaggtgcctgcaatacaaaggacccagagtcacagccattgtcatgaacttgaccaagaaaactctcccagcttgcttctctagtccaccgatgcctccaacgaaatctttcacctctgagcatttaatgaatccctgctgtatgtcaggcatggtgcaaggctctggggacacagagatgaaggagcttggttcttgtcctcaagggccttatcatgtagtagacacataggacagtgaacgccaaaccacgggaggaatcggcatggggcacagtgggcattgggtgggcccgcttcaacctcaggagagaaagaaatggttcacaggatagagccagggctggagctaaattccaaaggagaagtaggttctcgatagataagactgcagattcccaagagggagacacatagcaggattgtcagaagcgtggagacagtggaaaaggatattttattttattttactttactttattttatttttgagacaggatcttactctgtcatccaaactagagtgcagtggcacgatctcagctcaccacaacctccacctcccaggctcaagcaattctcctgcttcagcctcccgagtacctgagattacaggctcatgtcaccacgccaggctaatttttgtatttttagtagagacagggtttcaccgtgttggccaggcttggagaaggatttgtaagatttatttagatacatgtgtgtcccatcccttctccctcatggggaaggggctatgggtaggggctaccttctgtgttctcaagcccagagagaaatgcttgagagaggagccttccttggaaagcccggtatgtgtctgtttggggtccgcatggacaggcttcatactcatgcccttgaaggaacagtctgtgacgggaagacgtgcgggtgggaaggggacgggaggaaggggctccatttctgcgtctgggaaataattgcatttggctgggagtcggccaagacatgggtcagaatgttctgtggaccagatgtgtgccttggggagacggatgctgacgaggggagggagaatgaggagagtccaacagagaggggaggtggccagggagaagcagccagggcgtgtgaccagctaaaggggaggcatcccccaccaccccaggaacaaaggcctataaggcccagctgggggccccaagaacccagagaagctcctacaagaaagaggcagcttgaaacatctgctagccctcaagagccaggccagctaggactcggccagcaccaccaagtgcaaatgtccctgccctgtcccgttccctttccatccttccactcccgccacccctggagtcatccaaatctgttggccttaggggcaggaacagtctgttaatcatctaatagtgagcaaaagtcacaaagcacatggatattttatcagagagggatcatcttcccctgtggagtgacctttatagcagcgactttcatggcaggagtaatttttataggtgacaaagcaaaacctgcatctggcttataacccacgcgtggtgtgattttccagctgcagcagcctctagactttccctcttccaagctggacccttggtatctggcaaagcccggatggttttcttctcaaacctattgtcccttctgctatctggtttgtggagttgcttgcagagggcatggtaaccccacacctgcacagtatcacccgttttctaacacacttctgagatccagggggagctacgggcaggtcctggatgggctggagactctgccattctcatcacatttctgcctgctgatctcatccgggccctcaagaactctctgttccttacagattaaatgcaaatgggcgctgtggccacctcccctggctggtgcctgccagtctgtcctcccgtcagcatcattgcaaatacttctgagatagaccagagatgggacttggacccctgccctgcctcatcgaggactctactacaagctggttggggagggtggcccatggcaggcacagaccccagtcagatcatccagacgttgcaccacaaatcttgctcaaggtgccatgcccactgagtgcagaccttgaggaaacgaaaacaaacagctcccaccttaaatcttactcaagggagttaaccctatagcccgcacacacagaagaccagaaaaatgaccatctttaccctttgcctcattataatactaaaaatcatgcccgagggtggagctttaacatgctaatgagacataccacacatcaagaagcatgtgaccagactgcacaggcgctgaacattccccacctccacatgcttaaacatcgcccttttcccatcctacctcctttcagaatgccgggagtggtggctcatgcttataaacccagcactttgggaggtcgaggtgggcagatcatatgaggtcaggagttcaagaccagcctggccaacatggttaaaccccgtttccactaaaaataaaatagtcaggcatggtggtacatgcctgtagtctcagtgactcaggaggctgaggcaggagaatctcttgaaccagggaggtgaaggttgcagtgagctgagatcacgccactgcactccagcctgggtgacagagtgggactccatctcaaaaaaaaaaaaaaaaagacaggccgggcacgagggctcacgcctgtaatgccagcacttcgggaggccaaggtgggtggatcacctgaggttgggagttcaagagcagcctggccaacatggtgaaacccctctctactaaaaataccaaaaaaattctccgtgcgtggtggcgcatgtctgtaatcccagctgcttgggaggctgaggcacgagaattgcttgaacccaggaggcaaaggttgcagtgagtcaagatcacgccactgactgcactccagcctggaagacagagcaagactccatctctaaaaaaaaaaaaaaaaaaaaaagaacgccttctggactttttggggagtcagcccctgaacctccactccagtgctgccttctttatgtttgaacataagcctctaacaaaagcctcgtccaggaaagtttgagtacatcagagcctaagaccccatggtcggcaacacttcctctctccatccccatctctgccattcttggtttttacctctttcccgctagggcatcacctgcagttccccaaaccacactcttctctagagatgtttgaagaaatctgaatatgcctggtctcttacaggggccctaaatgggggtgattttgccccccaggggacatttggcaatgtctgacatttttgtcatcatgacttggggtgctggtgttactagcatctggtgaataaaagccagagatgctgctaaaactccttcagtaccagcccccaactgtaacgaggaatgatccagctccgaatgtcagaagtgccgaagtggagagctgataactcaacgatggcagattacatctggctgttccttatcttatgacccaggcaggatgctgtgaaccaaatctatgtcccggacacactggaaaactggccggcaggaccctgggcaccaagtcacaaagggaagaggaggggcatcagaaggggagccactaaccccatgtaccttcaaccggaacagccaggcggcaaatcccaaatggctctccaaagctcacttgctcgtgggagaaggttgcattgagtccagccacctcaaaggtcagctcttccggggtgccctgagccaatgagatggtgatcaataggtcctgtccaagctccaaatggtcagaagcccaggaggcctgcagccctgacagcagctccaccaagtggactgtaatgtttctggagattgtagaggtggtggtgttgccggtggcttggatctccaggcggtgcctcccagggcccatcagtttctgggtttctctgtccaggatcagattgtacggtagcgagcccttttgggtggtggactcggccagggttatgtcacccaaaagcacagtgtaagtcactcctgttcctaagtggggtaagaaaaattaaagaatgttggtaacaaccatgcggttgataatactatggcagctcagagtcagtctctgaagcctgattctggatacaaacttggatacagatgcagacataaagaaatatgtaaggatatgcccccttctcaaatattaatggtggttatccctgagtattaggttaatgactgatttcgtctttcttttgagacagggtctggcgctgtcgcccaggctggagtgcagtggtgcgatctcagctcactgcaacctctgcctccccggttcaagtgattctcctgcctcggcctctggagtagctgggattacaggcgcctgctaccacacccagctaattttttgtatttttagtagagacagggtttcaccgtgttagccaggatggtcttgaactcctgaccttggatttgcccgcctcagcctcccaaagtgctggggtgacaggcgtaagccaccgctcccggccgtgattttgtcatctgggggtccgctctgttcatttgcatattctaacttatttatactatacatgtcttacccgagaacctaaatatttgtaattaaaaaattaccacatttagttgccagggatgtcctggtcgggggaggaggaggaggactaaaagggagcatttcttaagggtgggggctgatttttatgcatgagaattagctttgggtcttgttttaagcaggagcaagtaaagccattccttcatcctacactggtgaccgcccagaaccctgcaaaccaacatgagaactcagcccgttcacgggaagatgggggctcccttgcaggttgcagatggttgttcttactggatgataaatattgcggttgactcttaaaatctgacttaaatcaacaaattaggattccttccaataaaaaccaagctagcgtagttctcatctgggtgatgatgatgataactacgatataagccccatgagaatgggaaccctgactttcatatttactgctgcctcgcccacacccggcagagtagtaggcactcaattatattagtaggatgagtaaataaatgaaggattattttgtttcctcaggggaacatatgagccctcttcatccaacaaacatgcaagaacagaaggggtttcctgagggctgtgttaaagccccattatgacttccacagctattgctatgagagggctccaggtgggatgtgaggtcaaaccgagccacctgctcattgcactagctctctgctgccctgtttacatcaacaggcctctattctaatctcaaactggtcctgggcttcaggaaaaacgctgccctgggtgaggatgagtcttagccaggagagtctctattgagagaaaggatgataatttaaaatatttaacaaccagcacagcatgggcgccaaccaattagaatggatgctctgataaatcagaatagacactgcgaccaacaaatagatgccatgaccaatcagaatagatgctgtgaccaatcagaatggacaccctgacccatcaaaatagacatgacaaccaatcagagcagtctctgtgaccgattagaaaacacaggctgggcgcggtggctcatgcctgtaatcccagcactttgggagtccgaggcgggtggatcatgaggtcaggagttcaagaccagcctggccaatatggtgaaaccctgtctctactaaaaatacaaaaattagctgggtgtggtggtgggcgcctgtaatcccagctacttgggaggctgaggcaggagaatcgcttgaatccaggaggcggaggttgcactgagctaagatcatgccattgcactccatcctgggacacagcgagactccatctcaaaaaaaaaaaaaaaaaaaaaggaaaacacactgtgggcaggcacagtggctcatgcctgtaatcccaacattttgggaggccgaggtgggcaggttacctgatgtcaggagttcaagaccagcctggccaacatggcgaaatcccatccctactaaaatagaaaaaaataaaaaattaacctggcatggtggcacgcacctgtagtcccagctacccaggaggctgaagcacgagaatcactggaacccgggtggtggaagttgcagtgagctgagatcgcaccactgcactccagcctggatgacagagcaagactctgtctcaaaaaaaaagaaaagacactgtgaccgatcagaatggacatgacaatcaatcagagcagtctctgtgaccaatcagaaaacaccctgtgaccaatgagaatggacctcagccataacagttggcatggctataccagtgggtgcagctgaatactggccttggccaggggcaacttgattgtgccaagctagtcgatgctggctgtactgagatgggctcaggcccagttggtagcagtcccagtgccacctcatcctagttaaattcccaaaaggaagtgactcggaagttcggttctacagggatgcaaagaagggcctttggaaggctaggagcactcactaccttactagccttctgactctgggcaaatgttttaacctttctgtgtcttcatttcttcatctgtaacatgaagataatactactatgtaatgagtagacaagtttatgcaaagcacttagaacagtgcctggcacacactaggtgctaaataaatgaataaatgatagtttaaaaatgaactcggtcaggtgtggtggctcacacctataatcccagcaccttgggaggccaagctaggtggatcatctgaggtcaggagtttgagaccagcctgaccaacatggtgaaaccctgtctctactaaatacaaaaaattagccaggtgtggtggtgcatgcttgtaatcccagctacttgggaggctgaggcaggggaatcacttgaacccaggcggtataggttgcagtgagctgagattgtgccgttgcactccacctgggcaaccagagcaaaactccatctcaaaaaaaaagaactcagtaggtgatccttgttactatttatttacttttttttgaaacagggtctcactctgttgtcctggctggcatgcagtagcatgatctcagctcactacagcctcgacctcccgggttcaagccatactcccacctcagccacccaagtagctgcaactacaggcatgtgcaaccatacctgactaatttttgtactttttgtacaaatggggtctcaccctgttgcccaggcttgtcccgaacttctgggctcaagcgatgcgcccgcctcagcctcccaaagtgttggaattgcaggctcaagccactgcacccagcccactatttattaaggtctgggagttggatagatttggaggaaatcagtgattttatagcttgccttgatgtgcccaattctgcagactcacctccatcaagctccacctgaatccacagaggatccccaaagacagcctggcagagagggccggctcctgactgggacaggccggagcatgcagtcacactgagcgtctccatcttgtctcgcacggtcacctgcctctgagctgtcacatgccactcactggttgtgcattcagcaaacacggtgaattccccaggagatgtgaactggtgggtcacattgctggacacattgccggccacagtcagggacatgaccagtgttggggaaacacaaagacacgcatttacacatgcactgacagggtttggatctgcgctcctgcccaaatctcatgttgaattataatccccaatgttggaggtggggcctggtggaaggtgattggctcataggggcgttttctcgcgagtggcttggcaccatcgccctgatgctgttctcttggtagtgagtgggttttcacaagatctggttgtttaaaagtgtatggctggccagccttggtggcttatgcctgtaatcccagcacttcgggaggccgaggcgggcagatcgcttgaggtcaggagacagagaccagcctggccaacgtggcgaaaccccatctctactaaaaacacaaaagttagctgggcgtggtggtgcacacctgtaatcccaggtactagggaggctgaggcaggaggatcgcttgaacccagaaggcggaggttgcagtgagctgagatcgcaccactgcattacaggctgggcgacagagtaagagcctgtctcaaaaaaaaaaaaaaaaaaaaaaaaaaaaaaaaaaatccagcgagtactagtaacactagcaataatagtaacaacttagactatgtcgttcctggcctgaaaaccctcctattatcctctgtagtgggtgctacagggaatcccccagattccacccttcaagcctgagcatgcattcccccagtacacctgtgagctgtggctgagggcttacagctgaatccatgtccaggagtcccttttagccaaagggagctgcctcgctcaaacctacctcccctcccatggacatctgcaccccacgagtgctcagtgccggggtataatggtctggctctctggcctcaactggaagcaactctgagggccatctctgctcagaggtttctgcaggatcgtcagggtctctgtggcccctgcatcccagttcaactctcctcttgccccatcttactactcccttcccatgctccacaacagagtctgtttcctggttcctgtgagacaaagtagcaaactcaaggagataggtgtgctcatttctgttagccagcataatcacaggaagcccctgactgcagtgacaggcagccctccagaacactttgaagacaaaacagaatagagtgctcggcttccacgtctctagcctgagtcactatatccctaaaaagataaatgactggtccttttcttacatataagataatgtctcgctgggtgcagtggctcacgcctgtaatcccagcactttgggaggccgaggtgggcggatcacgaggtcaggagattgagaccatcctggctaacacggtgaaaccccgtctctacaaaaatacaaaaaaaaaaaatttagccaggcgtggtggcgggcgcctgtagtcccaactacttgggaggctgaggcaggagaatggcgtgaacccgggaggaggagcttgcagtgggccgagatcgcgccactgcactccagcctgggtgacagagcaagactccgtcttaaagaaaaaaaaaaaaagataacatctgagatggctggtgattatgcttctgcaatctacaacaagattttttttttttttttttgagacagagtctttctctgttgctcaggctggagagcagtagcaggatctccgctcactgaaaccttcgcctgccaggttcaagcgattctcctccatcagcctcctgtgtagctgggaatacaggcatgcaccaccacgtccagctaatttttttttttttttttttttttttagtagagatggagtttcaccatgttgaccgggctggtcttgagctcctgaccccaagcgatctgcccaccttggcctcccaaagtgctgggattacaggcatgagccaccgaagccggccaacaagatatactttagtcatctagaggcagatgcactcttgcacccaaactttgatgtgattttacgtggactgaacctccacaacccatatagaagctgtgagctgaaacactgttttggagcagtctggcagaacctctttgaaagacctcccaggctgtagttctcagtctgtcgtcctgaacaaaactaactttaattatttaaaaagcttgatttttctttagttgacagaccccacctacgttagactggctagcatcaacagctcttcaggaccaggctcctgctgagtttttcagcatctttcattcttccacagagtcctgaactccaggcatggcgaggtccttgcagttatttgaatacgccacatgctttcaggtccatgctactctcttttctctagatccattgctcttgccttataattctggttccccgagagaggactttagctctaggtcactctaaggctcctgctgttttgtggattattagtttcagacaaatctctgcacgcccaatatcagctgtgcgcagaagcagccgattaacggaagaacaatgtcaatccctagatttgccagaaggtggcgctcagctaaccaacgctggattcacacagatttcaccaaaagcaaattgttctgtaaggcccgtaatacagtttcagaaatgtggaaaattttccatgacaaacacagaaaaaaaaaaggccctccatgcaaatgaatataaggcaaggtaaaaaggagcttctaacagagaagtcttctgactcctaagcaatgcaattcttcccaggagctcttattatttatcaacaatggatacgaagggtttgatttaaacatctcacctcttagactaatgatgagttaagaaaaaggaggctgcaccaacacataagagaaaagcacagtgatatttacacaaaaaaatgtggcttccgtacattcaaaaatcaaaattcatgctattttccctatcataacctgagttctgtggctgctagtattgataagaaggcatcagaaaggcatttcccagtgtttataaaaatgatttttaaaaggtgggtggtgaccaggcacaatcgctcacgcctgtaatcccagcactttgaaaagccgagatgggcagatcatctgaggtcaggagttcaagaccagcctggacaacatggcaaaaccccacctctatctactaaaaatacaaaaattagctgggcgtggtggagcatgcctgtagtcccagctactcgggagacagaggcaggagaatcgcttgaacctgggatatggaggttgcggtgagccgagatcatgccactgcactccagcctgggtgacagagcaagactctgccaatcctccacccgccccccccccccccaaaaaaaaggtgggtgggtagtttcaaggtccaacaaatctttaatgtaaaggaagatggactatttgggtggggcaatggtggaggaggtgccaccatctatttcctttgaaagagaaaaaaatgtcagtgattgttgtttagagctaatgcccagagagactgcaaatgtcaaacagtgctgtgtcttagattttaatcgcacaaaaacttccagagaataatacaacaaacacccttggattcgccatccagacttaacaaacattaacatttggtcccatttgcttctgttctaaaccactgtttatcactgaaaagtcctgtgtagctgtgggtcatagcggggctacatttaggcaattttgacttatgccaaattcaagttctacaagatttgggggctgaaagattgtgtaacttacaatctgtcgttttctttacaaactcatagcagtcaggaagaaacccacagaacagtggcataggtatttgtatcacccagatatttgcccccaaaacatcactgtaaatagtttctcatttgacaccatgaaacattcaaggcagccacgaacacaaatgtgacagggggccatgtgctgtggctcacacctgtactaccagcactgtgggaggccgagggggtagatcacttgtggttagaggttcgacaccaacctagccaacgtggtgaaaccctgtccctactaaaaatacaaatattagccaggcatggcggcacatgcttgtagttctagctacttgggaggctgaggcaggagaatcgcttgaacccaggaggtggaggttgcagtgagccgagatcgagccattgcactccagcctgggcgatggagaaagaccctgcctcaaaaaaaaaaaaaaaaaaaaagaaagaaagaaaagaaaagaaaagaaaacctatgaggtagagtgtttgcaaaagtagcagcaacagttcctcccatcccatatagaagcacctcgcagtgtggctccacactccttctatcagtaggtggggtctattcctccacctcttgaatctggtcttggccatggaacttgctttggccaacggtatcttagaaaatgtaacacaagcagagatttgaaaaaatgtttgcgcattgggctccgctgctaggaacactgtgtgaatgagcctaggctaacctgttgagtgatgagcagcatatgcttctagctgacatccagctgaccactaggcatgtgagtgagtgaggtcttcccggacagcctaccccagccaactccactcagacaagaaaagccgcccagctctccaaagaaccgtaagaaatggtaactattgttttaagccaccaagttttgggttggtttgttatgtggcaaaaaaactgatgatacaacctggctcaaggctcagagatttctcttacctcggcgggttgtagggatcaaaagtgtggctgtctcctgtactaattatacaggacaggtttcctatgtagggtgagaggagccacgtcagggagatggtgacattgtcaaagatgaaactctcactggacaccatcagctgcagggctgtggattaaaacataaaatgctgcatgcacttgtgaagcaaaattgcacatttctgtttataaccgactctcttctggctacctgtccagtatttttatgtgggtctttttttttttttttttttttttctcacagggtcttgctctttcacccaggctggagtacagtgatgcgatcatggctcactgcagcctcgatctttccaggctcaggtgatcttcccacctcagtagagactgagtagctgggactacaggtatgtgctaccacacccactaatatttatttttattttttgagacagggtttcactctgtcgcccagggtggagggcaatagcatgatctctgctcactgcaacctctgcctgctaggttcaagtgattctcccacctcagcctcccaagtagctgggattacaggtgcatgccactacggctggctaatttttgtattttttggtagagacagagtttcaccatgttggccaatggtctcgaactactgacttcaagtgatctactcccctcagcctcccaaagtcctgggattacaggcatgagccaccacacccagcctaatttttagattttttgtagagacggggtttctccacgttgtccaggcttgtctccaactcctgggctcagactatcctcctccctcccaaagtgctgggattacaggcgtgagccaccgcgtccagccaaggggagcaactttgaatgagggagtctcttagcacacagagatcagcccacgtgggtggctgctgtctctgttttcaggggaagctggacatgccataaaatcagagggacatttctatgctcaagcaagtcggggactcaccttcccggcactggtactgcacccacaggtaactgccctgagtcggacacaggtttccaaagtaggtctcatctgctgccacctggcatgactgtagctcctggcactggcctgggaagcacgcacatcccagcggaagcaggaatggtgtgcaagacaaaagaggatacattcaacagagctgtacagagatgaatggcctctcacccactcattcatttacccaccatccgcccaacaaatagcttttgatatctcctgaagaccaggtactgggctaggtactcaggtgagggagaagtaggatttctgtcctcaagtagttcagggtctagcatcctggtctcaaacttcagcttgcaacagatccccctgtgagtcttgtgaagataccatattccagaccccaccctcagcgattctgattcagtaggtatggagtgcagctggagaatatgcatttctaaccagttcctatgggatgctgatcctgacattgctggcccagggaccccacttcaagaaccactggtccagcagcgtctagagagatggcccaaaatagaaatctacacccagagaaccggcagaggaggcaagattaggaatcctgcgtctatcatggtaccacatgcccacagaagggaggagcagggacagcccattccagaagcttcagggtcatccagcacctctccctcctgcccagcgagatctgttagatgcccacagggaagcctgggagaaagaaacaggtccagaacacccacctgtgcttctcccagttacctgctaggtcccacttcttctgggcagttggccctgggcccacagagccaccctcaccctgccatgcttgtatcacagcgaactacattttccaaactcccttggccactggctcccaggtaggcttggccaatggccggcactactgaaagactggagggtggtgtattcatttccaatcactgttgtaacaacttaccactaacttaatgacttaaatctacatagatttggctgggagtggtggctcacacctataatcccagcactttgggaggcagaggtgggcagattacctgaggtcaggagctcgagaccagcctggccaacatggcaaaaccctgtctctactaaaaatacaaaaattagctgggcgtgatggcacatgcctgtaatcccagctactcaggaggctgaggcaggagaatagcttgagcctgagaggtgaagattgcagtgagcagagatcacgccattgcacccaatcctggattacagaacaagactcagtctcaaaacaaacaaacaaacaaaaacgcagatttttgtccaggtatggtggctcatgcctgtaatcccagcaatttgggaggctgagtcaggtggatcacttgaggtcagaagttcgaggccagactggccaacaagatgaaactccatctctaccaaaaatacaaaaactagctgggtgtggtggcacgcgcccgtagtcccagctacttaggagggtgaggcaggagaatcacttgaaccagggaggtggacgttgcagtgagctgagattgcgccactgcactccagccaaggcaacagagcaagactttgtctcaaaactaaaataaacaaaaataaagcagcacagattttttaaatctcacaattctgtatggtggtcagaagtctgggtgggctcagctggcctctgctcatatcacagggccgacaccaaggtgtcagggctgtgtttctttttttttttttttttgagatggagttttgctcttgttgcccaggctggagtgtagtggtgcgatctcggctcaccgcaatctctgtctcccaggttcaagcgattctcctgcctcagcctactgagtagctgggattacaggcatgtgccaccacaaccagctcattttgtatttttagtagagatggggtttctccatgttggtcagcctggtcttgaactcccaacctcaggtgatccacctgcctcggcctcccaaagtactgggtttacaggtgtgagtcactgcccctggccattttttttttttttttttgatacggagtctcgccatgtcacccaggctggagtgcagtggtgccatcttggctcactgcaacctctgcctctcagattcaagcaattctcctgcctcaccctcctgaatagttggggctccagatgtacaccaccatacccggctaatttttgtatttttagtagagacagggtttcaccatgttggacaggctggccttgaactcctgatgtcagatgatccacccacctcagcctcccaaagcactgggattacaggtgtgagccatcgtacccagcctcttgctttttttaagcatctcttctcccttgacacagcagttcccccagtggaagctccaattaactggcagctgtcagcatttaactagactcagaccctaccccccaggattctgattcagtaagtatggggtgcagctggagagtgtgcacgtctaacaagctcccaggggatgctgatcccgatactgctggcccagagccagctggaacagagcatgcagaaatttcaaccccatttgcagagtgcatacaaggtgctacactcttcccccaggttctcctgaccctcacaggagccccatgaaacttagaaagattctgcaacttgcctggatcacccaggcagcaggggctgagctgggatttgaaccccaacctgccgcccttttgccatgtaccctgctgcccacatcccagggggttctgccccatccttggactcggtctaagcagtttgcttagacaaactgggggtggcagcagggctcaccttccagctcacaaattaaaccacgcataatattcaacatccccttgtaatggataaactgcctcaagacgcagaggccacgtccctgctgaggtttttttctaatactgttgttacccagcgagaccatcctgggctctctctccaccatcacggttcatactgcagtccacacctgagcctgccacctcatgtcctcaccaccttgtcccccagtctttctcgtggctggatcctgcacttccctcacagccaggctcctgatgccgcccccgtaaagctttcctgagccccacctccaccccgtgatctggggggcccctctgatcaaaagggaacacgagccaccaccacatctctgttctcagattaaacagactcaaagagaggtctaattccagaacttgaggacagagttttttctatgactcttcgtagccacatataatccacttaaaaaaaaaaaaaaactaaatctgatctaattccaggatttaacacgccttgcagacaaaatttaaaatcccttcaggtccccagatgccttgaggctcagaatgtggcccaaagacatttgggatcctaagtggcatcacttgggagtgagttggaaatcaagtcggaggtttttaaaaatttttggttcactgcaacatctccaggacatagaacagtacctggcacatagtaggtacaaaataagttttgcatgactaaatagatagtgtttgctcttctgggttgcggcatttatcacagcattagttaattgcctgtatatcactgtctccccactccgccgcaagctctttgaaaaacagagcttgggccaggtgcggtggctcatgccggtaattccagcactttgagaggccaaggtgggtggatcactggaggccaggaggtacagaccagcccgggcaacatggtgaaaccctttctctacaaaaaatacaaaaattagctgggtgtgagggtgcttgcctctaattccagctacttgggtggctgaggcaggagaatcgcttgagcccgggaggcggaggttgcagtgagccacgactgtgccactgcactccagcctgggcaacagagcaagactccatctcaaaaaaaaaaaaaaaaaaaaaaaaaaaaaaagcaccaccaaaaaaaaccaagtgtttattggctaactgaatgaatgagggaccagggtgcttagatacagaccccgcgggatcctctctgcgctcctcctccgactcccacaacagggctcccctctaacgtgctctctgagctgtgggtaccacatttcaggaacttgcagctgagcctttgaggaaacagctcactaagccccagcagtgccttggtgaggaaggtacatccattctcccgtccggggccctttctccttgcaggggccacagcctcaggaacgctggagtaagaagagtcagtgaaaaccagccagctgattttagcgtttcctttccccatgcctgctccaaaaggcaggaggacagaggagccattctcagttccccgaggcaggagaaagttctgggagtactggcgtccctccctgaatcttcaaagggtctttgggcagaagcagaggctcagaggagagtgccaaaaggcacaactggggaggctggcccccaggacctgaggcttgcagcctggccacacggggctgtgtcctcacttagccaagaagcagcaggccacttgctttcctggaccctccagcggggacagtggtgactgcagcagaaagaagagggtttcccgatgtcctggaccagggaagtctctgaggagtttttacctcctagcagggtgcaagaaacccccataatcccggaaattgaatcctagtcactgggcaagcgcaactcagaagtagatttaatctgatttagaaaaacaaagccctagagtaactctcccacgtgaacaagataccatctatcaggagcttggcttcagcgttattcacagtcacagagattaagaaccaacctttctcaacaggagaagagacaaatggcggcacagttacacaacagatgaaacaaataaaccagcacaacatgtatcaagacggataatacatctcaaaaacaagatgttgagcaaaacacaggaaccaaaatgaaaagaaaaatgcattctatagaacgacacacaatatgataccatttatataaacattaaaaccctgcaaagtggccaggcacagtggctcacacttgtaatcccaggaaggccaaggtgggcggatcacctgaggtcaggagttcgagaccagcctggcaaacatggtgaaaccccgtctctactaaaaatataaaaaattaacctggtgtggtggcgcacgcctgtagtcccagctactcgggaggctgaggcacaagaatcgcttcaacccaggaggcagaggttgcagtgaaaagaaattgtgccactgcattccagcctgggtgacagactgagactccgtctcaaaaataaataaataaaaaataaattaaaaaaatagatttaaaaaaaagccctgcaaaagcaacagtctgtagtgtttaggaatacgtgcctagaaggtgaaaataaagcaggcgcagtggctcacgcccgtaatcccaacatttggggaggccgaggcaggcggatggcctaagctcaggagttcgagatcagcctggtcaacatggtgaaaccccgtctcttctaagaatacaaaaactggccaggagtggtggcacctgcctgtaatcccagctactcgggaggctgaggcattagaatcgcttgaacccaggaagcagagattgcagtgagctaagatcgggccactgcactctagcctgggcaagagtgagactctctctcaaaataaagagagggatccacaggagtctcctagtgttgtattcatttttctttttcctttttcttttctttttttcttttttgagacagagtcttgttccatcgcccaggctggagtgcgatgatctgatttcggctcactgcaacttccgcctccagggctcaagcgattctcctgcctcagcctcccaaatacctgggattacaggcatgtgccaccagcccggctaatttttgtatttttagtagagatggggtttcaccatgttggccaggctggtctggaattcctgacctcaggtgatccacctgccttggcctcccaagtgctgagattacaggcatgagccaccacgcccgactgtattgatttttctaacgagggaatcttaagcaaatgaggcacggtgttcagatctgatgaaggtgggtagtagatctgtgggagttcattacagtattttctattcttgtctatacgtttggagtatttcaaaaatttaaaaattaagttaaaaaagtgatgtttcctgcatccagcaggggtcgaggcacgccatgcccaccagatccatggctgtgtttgatgtcggggagggtggaccacagccccctgcttccttgctccgtgcgatgggcagggactggccagttttcccccatgttggaggcccacggtcagagatgaagattatcagaggcttccggaaccctttgctgagcacagaataccagcaactgccctctgctggccgccagagctgcagagcccttgggccctacctgccacctcctccttgacgttggcccagctgcatccctgctccagatctgaaggacgcccggcatcctgggtgcagaaatggggattctggcgcccgtagacggcatcctggacctggatgacctgccccaagccacagtgcacggtggcattgagtccctcgcaggccaggctctggccaacccctgaggcaaagggaaggcaagacattaggggggctcacggttacagacaggtgagtgccggttcacgggaagaggagggtcccgggggttgggctgagatgcaagaacccgataggagccgcttggcaggggtgataaattgaatatgattgtcggcagcattgtgctgagccaggttccctgggatcagatccagcccagccacacactgctgctgtgtgaccttcagcaagttagttagcttctctgtgcccccactctcatactaaacctcatgcaggccgggctccgtggctcacccctgtaatctcagcactttgggaggccgagacgggcggaccacttgaggtcaggagttcgagaccagcctggccaacatggtgaaaccccgtctctattaaaaaaaatacaaaaattatctggggatggtggctcgcacctgtaatcccagctactcgggaggttgagacaggagaatcacttgaacctgggaagcggaggttgcagtgagccaagatcacaccactccagcctcagtgacagagcaagactccatctcagaaaaaaaaaaaaaaaaaagcgggaaagacagaaacagagatgagacaggtgggcaggcaggaaggtgggcaggtggatggggacagggcagggatgagtgacggagcatcacgtgggcagagagagatgcatagagacagggagagaaagctgcggacagaggtaaggtcagaaaaacacacacaggtcagctcttcagcagggagatggggacagaaaccggcaggccctgaagagcgagagggagacagagagaccacagaggcaggaagagagtcagagaccaagggagagaaagagaaagagttagagaaaaacagaaggggaagaaagacccagagaaaactgagacaggggaggcggcaagagaaagagaaggtcagagagatggaggcaggaacaggagggagaggcgagcctggagagaggcctgcaggcaggcagggagacagggtgggagatgggaactcaggggcacgggccactcacggaactcgcacatgaaggcgaaggtctgggcgcagtccgaggtcacccactcagaggaagggcctctcccgatgtggccgcaggtgtcaggggcagcggcggcctgccctccatgccagttgctgtaggtcacattggaggtgtccaaccaagtccccggccctggaagggcaacacgaccaccaggactcagtaactgtcttcaaactccatttatacaaatgcaggactcacgcctgctctgccgctgctgggcagcaggtcagcaattaatgttgatgggatggagacctctctctccaggaccaataaagttctcttcctcactgtcatcatcaaacactcaatgtaagaactggaacaccaaattggagagcttgcaaaaggtgctttgattaaataaatgaggctgccagctctgtctaaccataatcaataatttatttattttgagatggggtcttgctctgtcacccaggttggagtgcagtggtgccatttcagctcgctacaagctccacctcccaggctcaagtgatcctcccagcttagcctcctgagtagctgagaccacaggtgcaagccgctatgcctggctgatttttttgtatttctggcagagacagggattttgtcttgttgcccaggctggcctccaactcctgagctcaaactccacccacctcagtctcccaaagttctggaattgcaggcatgagccaccacacctggccctgagcacagtctaaggaagagccaggggccaggcccagtggttcatgcttgtgatcctaacattgtggaggtgggaggatcacttgcacccaggagtttaagaccagcctgggcaacctagagagaccttgtctctacaaaaaaaaaaaaaaaaaaatttagtcaggcatgctgcctgtggtcccagctactcgggaggctgagttgggaggattgcttgagctgaggttggggctacagtgagccatgatcgtgcccctatattctggcctgggagacagagcaagaccctgtctcaaaataataataataataataataataataataataataataaagtccagaagtgggctaagggatgttttaacatatcatcttcttcataagctgtgtcccttgccaagtacacctgggcagtgctgagttaaaacatgagcagttattgttactttgggcctcttcagatccttgaaaatactgatgtaactctttaaaaggagtgtgtgtgtgtttatgtgtgtgtgtgtgtgtgtgtaaaacagaaccatgtcgaggacaccagagagctagaaaacactaaatatcaaaatttactatggattgggcatggtggctcacgcctggaatcccagcactttgggaggccaaggtggatggatcacttgaggccaggagttcaagaccagactggccaacatggtgaaaccctgtctctattagaattacaaaaattagccataattccagctactagggaggctgaggcaggggaatcacttgaacccgggaggcagaggtcgcagtgagccaagatggtgccgccactgcactccagcctgggaaacagagtgagattgtctcaaaaaacaaacatttattatgggtactcagaaacgtaattattaatttattgaaagagactcatgcaaatgaaatggttttaaaaaatccaaagggtctaaaatgaaagtatcttccctctccaagctatgggcttctccatcattgttatgtttctcataaatgattccaggatgaattgaattgtatccacacatcagcatctatgagtgcctgaaatctacttacataaatgtcatgtgattgcacacagtatctggcccttgcttcttaaatgacattaaatattggaggttgttgcctatcagcctagttagaactacctcattttctgcaacagccacacggtatccctggagaggtgttaataggcacacctcctctagctggatgtgaaaggatgttcaatacacagaaatcggcaattgttgcatctacacctcaagaaaccattcaggagacattgtctgcaggggcgtcttaagaattcaaatccccttggctgtgggttttcttaaatgagcttcccggtagctcatttattaaaacacttccatccacgctggtgttgttctgtggctgttcggcacaggccatgtctcatttctcaaacccagtagcttctacaggggcaaagagaacctctgggtaccaaggtgcccagtaggaaagtcaggcttagcattgctctgactggtagagaccccactgtgcaccaccagctatgtcatgttgagcacgtcttttctctctagacttcattttcctcctccgtgaaaggagagtagccacgcttacctcatgggatccgtgtgaggcttaaatgcaaatgttttcttgtccattctctctctctctttttttttttttttttttttttgagacagtttctctctgtgttgtccaggctggagtgcaatggcacaatcttggctcactggaacctctgtctcctgggttgaagggattctcctgcctcagcctcctgagtagctgggattacaggtgcgtgctaccatgcccagctaatttttctatgtttagtagagatgaggtttcaccatgttggccagtctgatctcgaactcctgaccttgagtgatccacctgcctcggcctcccaaagtgctgggattacaagcgtgacccaccacgcccagcctccttgtccattctcaattgtgtctaggcactgggaaaacaaaaatggccagggtatggttctttccttgaagggcttgtagtctaggagggagacagacaacttagctgtttaagccacagcaaaagtactgccttggaagtgtgaacagggccctgcaggctcgtagagaacgactcacctgactgcactgggtgggggaaggagccttcagagaataaaggaggactaagactttcaggaccattaaaattagactgtgaatggaactatgctaagcacttggtctgctttaatgtcagagcaagtggggaaagacaagtgggacactttaaaaaatagcttagtcattattttctgagactcagttttctcatctgtaaaatggggacataaggccgggcgcagtggctaccacctgtaatcccagcactttgggaggccaaggcaggcggatcacaaggtcaggagatcgagaccatcttggctaacacggtgaaaccccgtctctattcaaaatacaaaaaattagccgagcatagtggcatctgcctgtaatcccagctacttgggaggctgaggcagaagaatcacttgaaccagggaggcagaggttgcagtgagccgcgatcgtgccactgcactccagcctgggcaacagagagagactctgtctcaaaaataaataaataaataaataaataaataaataaaaaatggggacatgatttttctcattgttattgtaagaattcaacatgatagtgacaacgaagcactcaggatagtgcctggcactatcctagcaagaatcaaagcagtcagagtattactattaggaacaggcaaagaagcgaacatttctagagggtcagaatttgatgtgccagattctgtgctaggcattagacatgaattatttaatccacaacacaaccaaagggaagggtatccataccatgagaattaggtcgtattaatttgttccatgtttctttgggtgagaagtgatggcaagaattgcaaacacaagtttctcataaaacagcgatcacggcacctaccctccgtggttccattccgtgccaagttccacgtgagtccaatccaccattccctgtcctgggagatgtgcttctgcagaaaccactgggtgccttcgtcctgaatgaagaccaaatggcctccttgcccctcgcaccagctctgggcatcacggaaggtgcgtccgagtggcacaaattcatagcaagcatctctgaaggccacctggctgttagagcaaaagctgccttcctctggcttaacagtggtggccctaagcctcagagcaagcaccaggagtaccaagcccactgcactcatgcttgaaccactgctggggcctctggatggagctcgctcttgggactttcatatgcgggtgccctcacatccacccgtcatccatcttcccttctgtctttgcatcacataatggcagctaccttttgttgaagaaacaaaaggctcagcttgacagtgtctgcgtttttgcgtcacccagctctttgttccacgcctgctccaaagcctattaatttgtcagatggtcttctcgggaaagataaagttgctatatcacctgtctgcttatctttcagtcaactgttagcggtggataaaaagtccttgctattggttttatgtcattaccctgagggctgtatgtttcgtgcaaagccatcagcatgtgggaagtgtgtgataaaagaaaaatgggaggaaggttggagaatggcaggaaggcaggaagacggtaaagaaaccaagttgcttttatatccaagcccattgtgccgagcggcagctgtgcccaaatgatacccattctctccccagcgtggctgaaatcctaatagatatttggtcccctctctgattcaccacattattcatcacccatacctgctggagaataaaaatcccctaaaaaatttattggatgtcataagctcagaactgaccatccttatccactacttacaccttcccgtgggtttccatggtccatggatcaagttcaaatttcctagctttgtatacaaggctttgtatggtctggcctccgagagtatttccaaacacatcctcccaaatgtggagaaacaagctgtctctctgcttgctggtggtaaattggtacaacctctattgtgggcaatgtgataatatccataaaaattttaaaagcacaaactctataatgtagcaattacacatctaggaattacaccaacaggtaaattcatacatgtgtgaaatgccatatgaataagattattcttggcagaatttgttaagaaggaaaaattggaaacaacctaaatgtccattgataggaaacgggttcacaaaacatggtctatcatatataaccacttttaaaatgaacaaattcttcctctgcaaatttggaaggatccctaaggtttttgttttttatttgtttgttttgagacacagagtctcgctctgtcgcccaggctggagtacagtggcgcaatctcagctcactgcagcctccacctcctgggttcaagcaattctcgcgtctcagcctcccgggtagctgggactacaggcaggcaccaccacgccctgctaattttttgtattttagtagagatgggctttcaccaagttgcccaggatggcctcgaactcctgaactaaggcaatccacccacctcagcctcccaaagtgctaggattacagatgtgagccaatgtacctggtgagatttttgttaatattaaaagctaagtatgagatattgtatataattcagtcccatttgcataaaaacatatctaaatatttatttgtatgtgtataatatagctcataagaaacatacaagaggccgggcgcgttggctcacgcctgtgatcccagcactttgggaggccgaggtgggtggatcgcttgagctcaggaattcaaaaccagcttggccaacatggtgaaacctggtctctactcaaaacagaaaaaaattagccaggcatggttgtgcatgcctgtaatgccagctacttgggaagctgaggcaggagaattgtttgagcctgggaggcagaggttgcagtgagctgagatcacgccattgcactccagcctgggcaacaagagtgaaactcagtctcaaaaaaacaaaaacaaaaacaaaaacaaaacaacaacaacaaaacacatacaagagctggacgagatgactcacacctataatcccaaaacgttgggaggccgaggcgggcggatcaccctgaggtcaggagttggagaccagcttggccaacgtggcaaaaccccatctctactaaaaatacaaaaaattaaccaggcgtggttgcatgtgcctgtgatcccagctactcaggaggctgaggcaggagaatcacttgaacctgggaggcggaggttgcagtgagccgagatcacaccactgcactccaacctgggcgacagaatgagactctgtctcaaaaaaataaaaataaaagcccatagttggatgatgtggtctgcataagaaattagtaatctgaggttacagagggagacttgcaatgtggtgagaccctggagtgttcagaaaaggtgtaaggtatataattcctccagccagagacattagagaatgcagttgtctaatatttggctttagaccgttaacttgctctgacataagtcactctttctctttccccattgcccctcctctatcacgtggcaacctctaatctttttttttttttttttttttttttttttttgaggcggagtcgtgctctgtcatgcaggctggagtgcagtggctcgatcttggttcactgcaacctccacctcctgggttcaagtgattctcgagcctcagcctcccgagtagctgagattacaggcgcgtgccaccacgcccagctgatttttgtatctctaatctattttctgactctatggatttgcctattctggatgtttcacctaaatggagtcatacaatacgtggacttttgtgtttggctactttcacttagcatcatgttttcaaggttcatccacgttgtagcatgtacttcactcctttttatggctgaattatatcccatcctatggataaaccacattttatctattatcggttgatagacatttgggttgttttactgtgtgaatttcttagggaagggacatctcttaatctctgtctaccccatgtctggctcataataagactcaaggaatatttgccagcctggccccatctcccagttccctggagattaccctgttgcctctgtcattttcctagaaaccactgcaatccttctggagtgaccctgccagacagagaatgggaaagggctagagcccaggataggatgcaggatcgttgctgactcaggctaggacacaggctgagcagaacaggcctgttatctctagaggtcaaccttctaataactttccttcgaaaactctgtggaaagtcacacgcagtgataatagaaagggtaaaggcttaatttatgtccctaatggaagttgcttggggacatttgataacaaatgcaaatctgcaggctaaattccatgttcacattctttacattctgataaattgcagactcctgggcacagtgttcttcttgttgacatcagctcccaatgtcccttaacctctgtgtgcatgaagctccactgaaagtagtcaggacatggctggaccctgtgagcattatttccagtgatctgatccagctgtctgagcctccaagtgggatcagcaatatgaaaacagaaagacagcaagtttggtttaaataaggcattgaggccaggcacagaggctcacgcctgtaatcccagcactttgggaggctgagacaggtggatcacctgaggtcaggagttcgagactcagcctgaccaacgtaaagaaaccccaactctgctaaaaatacaaaattagccaggcatggtggcagatgcctgaaatcccagctactggggacgctgaggcagaattgcttgaaccagggaagcagaggttggggtgagccaagatcgcaccattgcactccagcctgggcaacaagagcgaaactccatctcaaaagataaaaaatgaaaataaggcattgagtccataaaaagaaccataaagatagttatgccctgttattccagttattccagtctggggaatattcccatcttactttgagtcccccagaagccaactgagaccaagattaagagcaaggagtctatttgctttttgttttcgggttttgttttttttttttgagacagtctcactttgtcacccaggctggattgcagtgtcgccgtctcggctcattacagcctccgtctcccgggttcaagcagttatcctacctcatcctcctgagtagctggaattacaggcacacgccatcacatccggctaatttttgtatttttagcagagatggagtttcaccatgttagccaggctggtcttgaactcctgggctcaaatgatccgccctcctcggtctcccaaagtgctgggattacaggtgtgagccattgcacctggcctcaaggagtctatttgggggggaatctaggaagccctggccggggaagaggagtatatttctctataggaattggcggctttatcagtcatatttaatcttggttctcctttagatcgtaaagagaacacagcagaagaattcccatggtcccattaccctaacacattttcatttcttcagggttccttcatacaccttgttcccttgaagacaggtgttttcccaggcactactgtagtgtctgtgattagttcataagcatttcctgcttagcattagacaggaaggcttttccatgttgctaatgggctttgaaattgacatggtggtggcagagcctccttttactaaatggacattgctaaatcagtcccatattgctggacaggtcatgtggattttagtcatctgtttctcatttctcaacacaactttgaacatcttcttgcatgcatgctttagcctgggctgagttatctcttgaggattgtagcagacactatcagtgctcaccctaacccacacacctgccatgcagacatctgtggctctgcctccctctgcatatgtgcgacaggatggaagtgcctggaagttagcacctctcaggagaaactctcaaccttgactgagcagaattggtgaatcaatgccctgactcctgaagataactctgaggcgtgttcccaccggctccaggagatccccagccagactgagtttcagttgctcatgatggtgataggcttgagaatgtattgttaacatcttttctcctcctttatcttaggtcctcattcccctgctgttatttcctaggttcaaatcttaggcttctccagagaaacagaatcaataggagatagacagatcaatagacacagatagatagatagatgcatagatacgtagacacatagacagatgaatagatagatggatattataataataaaaaaagaaaatcaataaataaagcaaaaaaaaaaaaaaaaaaaaaaaaccagagccaggcacggtggctcacacgtgtaatcccagcactttgggaggccgaggcaggtggatcacctgaggtcaggagtttggaaccagcctgaccaaaatggtgaaaccccatatctacaaaaatacaaaaattagcagggcatggtggtgtgtgcctgtaatcccattactcaggaggctgaggtagaagaattgcttgaacctgggaggtggaggttttagtgagccaaaggtttcagtgagccaagattgcgtcattagactccagcctgggcgacgagagcaaaaactgtctaaaaaaaaaaaaaaaaggaaccaaataggccagacacagtggctcatgcctgatgcctgtaatcccagcactttgggaggccgagtcaggtggatcacttgagaccaggagtttaagaccatcctggtctacatagcgaaatcccttctctacaaaaaatacaaaaattagttcggtgtggttgcatgcccctgtaatcccagccacgtgggagaatgaggcaggagaatcattatgatcatggaagctaagaagtccataatctgttgtctgcaacctggagaaccacgaaagccactggtctaaccctctccaagtctaaaggcccaggaaccaggagctctgatgtccaaaggcaggagaaacggatatcccagctcattttttgttctactcaggtcctccatgatgcccatccacactggggagggtgggtgtgccttactcagtacactgatccaaatgccagtcttttctggaaacaacctcacagacacattcagacatactgttttaccagctctctggggaatcccttagcccagtcaagttgacacgtaaaattaaccatcacaacctcccaaataaatttcttgctcttgaatcctacttctgggggaacccaagcctagacagacatattcccaggacgagggcacctggaccacaggggtgaatatcttcatgattcttgt

SEQ ID NO: 120 - DNA, 96912 bp, Homo sapiens
ctttagttgtaattggttgagggttgggcaattcgaagttatgataggctgctaaaagtgtctgttaagctaactggcaagagacgtgacggttaaggttgattcacgcttgtgcacagtttggttgcgcagtagaaagcaaaggaggggcagacgctcacattcgtggttacccgggaagggttaagtctttgttgtagagttttctctgtaaacttttccacttctccagctcacttcctgcaaggagaagcttatctctgctagctttattcataggggtagtacttacaaaacaccaacattagaggttgtgtttaagaagtgtttccaagccctggggagaaaggtatcagagagataaaaatgtccccttcttttctttggtctcaatgcatccaatttcattgaagttctttccaggagcctcaatgctaaagggcaaagcgcaaactttcatttagcagaaatcagtcaacttcggttgcaattataaatgtcgtcaataaactgaagtggcgtattgagagttctccagcttccagatccactcctggctgacccctgccaattgaccagacagccattagcaactttttttttttttttttttttctgtgagacggagtttctctcttgttgcccaggctggagtgcaatggtgctatctcggctcatcgcaacctacgcctcccaggttcaagcgattcttctgccttagcctcccgagtagctgggattataggcatgagacggggtttctccatgttggtcaggctagtctcgaactcccaacctcaggtgatccgcccgcctcggcctcccaaagtgctggtattacaggcgtaagccaccgcgcccggccagcaactttctaataagcgggccacattataccctttatgatgctctggaaatgagaattctgctttcccccacctctcactgccactttgtttttctgttcagcagttcttaaatagccctactagctgtgtgtcagatactttaaaagcttctctctctctctctcttttttttttctaaacctcttcctagcagtctaaattagggccattgaatgaattgccgggttgtgtgtgtgtgtgttttttttttttcctcacttggcacaatgcacaagaataaatgattgcattttttattcacttgggtacaaatcacagtaggcatttttgagaaatctaatgttgctataaaaactcttgtgctcctagaaatatattcatcattagctttttgtttttccttttttttcacccacttttcctgctcctaaataacaaaatgctggtctgattactctttcagtttctaaatcagatttaaatgtactttctcacaaccccacctatgatacatatacccatgggccatgaaacaacacccagggatagtttaagacactgtcaggccgtgcggtggctcatgcctgttatcccagcactctgggaggccgagccgggcagatcacctgaggtcaggagtttgagaccagcctgactaacatggtgaaacccctgtctctgcagatggtgccactgcactccagcctgggcaacagagtgagactctgtcttaaaaaaaaaaaaaaaaaaagacactgtcaaggaggcattcacctcaaggatgtggactttggaaatgtgctttgtctctttcttctttctgctaaccctttgtctcatatttcttctatttactaacctccttgttctttgcagagcaagctacaaagagtctaaaactgtatggtttattattcagaaaaatattgtcttttttctagcctatatttttagtcaagtttaaataaagtacatacttctatcaccagactaagcagaaattattcctccagtaactatacataacaataaagtgccttttcctagttattttccggaactttcctccccctcctctcttcctcaccttccaatttagaaataacctcccattcaattcaatgactcacaaaaagcctgtgaaaggaaagtggaaaagccaaaataacttagagatgtctgaatcattcagctgaaggaaagatcagacattgaccatgataagatagacgccaagacataaggcaagcctgagctaacatcccataacatgtgaagtaatgcaaatgtgaagatgccccaagaaaaagcaaataccaatatgtccttttacacagccttttaatatatcaccagcagcttgcttctctctagtcttggcagtgtgccatgctaccaattttagagcaagttagaagacaattaatgtcctgacagataggaaacaataacgtcataggaggacatgaccattattatggtactttgggtaataatggctcttgcacagccatagtgactaggtgccatagaaaacatagaattaggccagccttgctaagaggacttgccatctaagttgaagaatgcagcgaaattactatcacaaaactgggtggaaaattgtcacaaaagtcagccgctatttcatacactaaaaaaaaaaaaaaaaagaaagcatgtataaatgcttttgctcatatacacacatctatcattcctattctttgtgaatatcagttaagaaaggacatataaaataaatatgttacaacccagtaagtagtgggaaaaccttaaggaaggtttcaaggaacatgccttgaaataacagaaggctattgtgttatcaaagactgtgcagtaccggaggggttattgcttgtatccctacattttgctttcacgtgcacaaggtaaccctatcatgtaattactccatccagcttttttcttttctttcctgtgttttttgcttctctaccattctcagggctccctctcagaaaacaagaacactggagtctgggagtctgcagcttcctgttgcatggctggctgtggaggtcctgcagatggtatctgttcagagccacttgggcacgaccaagatggcaggtacattcggggcaaaaatagcatttataatcccaattaagcagaaaatagaggactcagagtgatgtccaatatctgaggagtgatatagtgtgccttgggctttcctgtacactaatgctgtttctcctgctctttcataatgtcacttttcaagggaaaagaatccaagtctctttccatttctattttagcccacaggggcaatctcactagggaaaggatccattttttgcttttggattttcttcctctggattctacacacgattccaattccaactagattagagaaataaacaaccggtggagaagaaaatcgctcagatagcagacaagggccagaactgcctgccactagcagttggaggcaagccaaaatatttgataagaggtagcttcctgagttagggatccctgagggtggaggctgacaaagatgaagggattagagagaaggggagggaaaaggagggaagaggaggagatgagggggcaggagagaaaagggtaagaaaagctagaaaaacagtcaaaaaacccaatcagagtgctgagccagcttacagtcctgccttgcctaccccctatccccacccatgtggactttacactaggttgcataattacaccagcaaagtgcagcctctgccactggttaaaagggaaagcgtgccaggctccagcctatgggaccgttgttctgctgccacctggaaatcctcccagagctcaaagcctgctgctctgggcaaagctgacaaggaaggacagattcagcagccaaccaaggagcataccttcatttgatttccttaaggcaaaagcactggctaaacaaagggagactatctgggagaaggtgttttcaccctttcaagctggggtgctttcaccaccgggaagtgccacgctgctttccacgctggaacaaggtactgtggtttcaaagttcaaggctctgtttcagggatgggaaggaaaaaaaaatcagtgaaagaaggtgttctggtctctcaggcagaaccatttgttatttgattccagagctcatgtaatttttaaataccacactatgcattttcattactaaatgcattcattttcatcctcaagaaaagtgtatgcccccttccgcctgctttacataatatggcttgagcgcttgtaaaaatggatgggctgtagctctgagttctgccattgtgctattgactggagctcctggttactatcaccagatctatgggtggatcagccattcttctgcagcagggagtggaccgactcaaagcacttagcaccatttaaacttttgtccatctctgtttttatgcacacaaagagtttcctggaaacatggctatcctccaaggatttcagagagtagaattcttccagaactgcagtgtcccaatcacttggaacctcatgagaaagcagacttaaactcagaccctagaacctcgaacttagtatgttccaaaagctttggctctgccatttaccaactgtgtaatttggggaacattgattcatcaccctaaagcttcattttcttcatctataaaatgagatacatattagctatcttgtcttgcataacaaattaccccaaaactcagtagcttaaaagaacgtttatcgtctcagtttctgtgggtcaactctctggcattgggtctcttataagaccacagtcatctcaagctcagttgggacagatctgcttcctgcctcactcacctcgttattgttggcaggactcacttcctaaggccttggttccccaggagctgttggccagaagcctccctcggtgccctgcctcatgggcctcttcgttgagcatctcacaacgtggcagcttacttcatcagtgcaagcaagcaagagcaagagagaggactcaccagagacagtaatagcaaaacagaaggcacagtctttcgtaatccaatcacagatgtgacatcccatcactgttgccacatcctgtgagttagaagtaagtcattaggtccagcccacactcaaggagattacacaaggatgtaaagaccagcaagaggatcattgggagctattttagaagcagcctactctaagataataataacatctagggtttgtttaaaatttaaattagagactgcatggtggcagctacttgggaggctgaggtgggaggctcacttgaggccaggggtttgaggccagcttgggcaacatggtgagactcctccatctcttaaaaaaaaaaaacaaatatatgtgtatatttttaaatattcaaaaatcaaattagagaatatgttcaattcgggccagcatatgttatgtaatatataactgttatatataataactattattaccattaatattattattgactatataatggctggttttctcccctagctcctagaaggaacccttttatgaggagtaaatgaaataatatacataattcaggacctgacatgtagtaaatgctcaataatcattagttattgttaacattattaatagccgggcacggtagctcacgcctgtaatcccagcactttgggaggccaaggcgggcggatcacaaggtcaggagatcgagaccatcctagctaacacggtgaaaccccatctctacaaatacaaaaaaattaattgggcatggtggcggacacctgttgtcccagctactcagaaggctgaagcaggagaatggcatgaactcaggaggcggagcttgcagtgagcagagatcacgccactgcactccagtctgggcaacagagcgagactccatctcaaaaaaaaaaccaacattattaataaacatgtgatatttgatattctctccaagctactggaaggaaatactatgaactctcattacttttccagggtggccttatttccatatgttttgttcagtttttccattagcaccctatactcaccagagcacaattctagatttggggttcataaaatatgaccaccaaatccataacacagtctaatttcctgcctgccctataccaagaagggtatgcacaaaaccagcaaaatgggctaattatggcagcacctcctatatgcacaaaagtctgagcctggccccaaccagaatccagacagaagggattgtgcctgggagaatgaacagagacttcgctatgtgacctttgtcccttttaaaatatggtcatcattgtgcagtctactcagtcaatcctcaactaagaatgagagaaagagggacctacacaggccctacagatgggataagggtgtccaagaagacattttcacacctgggttggaagtaataagaacccataaaaataaagagcaattttgcaattagaaagttggaagaagagagtccagtttgcaacatgaaagaaagatcataagaggctggagtcaccctttagggctgggttgaagctgtcttccttataaaggtggaggatattgagggttggcctgtggccaggaaaaatgaggaactataatcaagaaaaccccattatttttgctttgagtcatttctcagggctcacccataattattacataagaaagacagaaaaaacaaaaacctcctaaagtgtaaatgatccttaaactaaaaacaccgtagaaatacaaagatccaggccgggtgcggtggctcatgcctgtaatcccagctacttgggaggctgaggcaggagaatcacttaaacccgagaggcggaggttgcggtgagccgagatagcaccattgcactccagcctgggcaacaagaaagaagaaactctgtctcaaaaaaaaaaaaaaaaaagaaaaaagaaaagaaaagaaaagaaaaagaaaagaaagaaatacaaagatccaagtttttgcaacttatctgtctctctctctctctgtctctgtttcttcttctcccacccatatttgcacatgttctttcatttcttttccgcacagaagaaaactacccttacaaggaaatgccttaggatcctccaggctggaattgttttcagatcaggaatcatcttctctagcagtctccactgcagctctacaggattagagctcagtattcacagataatgacagtttacacctctccctctaaatcaagtcacctgtgcagctgtgatttaaagagttcggatgattttctgagctgcactagccctggccctttcctctcccgaaatgttcccaaacattaccagatttgtacacagaaaggctcaaagcagaagttgctgggaaagttctgtaaacatgaaggggagatgtacaccaatatcaagttcctcttcctgtggctctggttttctctccttcctattctctattctgtgtttcctctgtgtctgggacagaggagacttgtatgtttccatacctgttaatagccagagaaaactttgttcggtcccttggcaggttagcggattttagaagggaaagacagggtaaagagatgaggactcgcccccaggaagtctgactatacaataggaatggtgtatttatttattcagccctttcctacactgcagtcatttcatttcaccctcaggatgtgtatttagtggtaagctttctttcttttcctgttagtttcctgcaaaaggacatcagtgtcttcctcattggagcagctgataagaaggatgttgttgctcaaatagagacagaaaaacatatttcctatcacagacccaggccatcccaagggcatggagaattagaccaggttgtggaaataatagaagaacctgattttcatgcctatttccctggtgccatcttcctccctgaaatactctgcaataattacaccttccacttaagtaggatttcacacttttccaaagtagcatcacgttgtacggaagtagagttggctgcactgtagctggcatagcctattagttactttggagggtttatatgaagaggcaactttgggtttaactttaagttttggggaactcatacaaatagcataggtttaccctaagttggattccatttgctagctcctgcctctcctacagatctcatcttcaaagttactattataggggaggcttcctgttatccctctcccagccacattgagttgggtgcccctcttatacacactgcatttccactttggatacacatatcccgtgggtaaacttgctcagtgcctagccatccagcaacatgtcggcactgtaataccagggacaacaaccttcctgctcatggctgcctagcatagggcctggcccacagtagttcactaaatatttagtgaatgaatgagtgagtcaggaattgtctctaggagtagccttgccacctgacacaatcacttattttggggtagtgctctgggagttataaaaaaggcctgtgctaattatcacataatgatcaccggtggttatagtatttagtaggcaaaagcacagtggtggagtatgactaaataaaggtctcctccaggtgggggctatccccgcactctgaatttggaaccccactgcccatctctcttggactcctgtggacagggtcattcctttgggaaattcttttcggagttgccaacactggggaacagggagaattaagctccatttccccaaactcaatgaagtctttctgatatgaaaattaaattaaagaacaaggccagtggtggccctctgttgctttcctttcagcctctgagacagatttccccatcaagggtctgcgctgagtcatcccgcctccagcggaaacaagtcagcagcaccctgaggatgggtgatggaggtaaagactcatcctgctaatctcctcctcccgcggaggccaaggttcatggtcttggccccctccctgggaacaaaaaggcaacccaagagaaaagactcttccttcccactcctctctctcttacaagctcatggtctgtggctcctctttcttctgccaatggaagttgaggatagagagagaggaggaggaagaagaaaccaaagggcacaggactgtactttgctggctggggggaggtgggacacatgggtggggggtatgaattgggatgaaggatgacaagacatgaagaatccttggaggttctccaacagttctcacatacagaacagctaaggcacagcccagttgcggagacaccagggaacccagaaatgtaaatagtaggaggtgatgacagcaaagaagcaggcagatctgatacacaggcccctacacagagctacgccctgtgggagaaccacaaactgcctaagactgggtagcaaagagagagagagtgggcgttcagtgtgagaccttgaatcagaggcccacactctatatctagctcagtctccaatttgtggggaggaccggggtgaaagatgaatgtcagagatgtggcttcatcagctgcctatgggatgggcacatgtttaggagatactttgaaatctctagatgaaaggaaatgccagaaaaagctatcattactttgagggctgatcatagagcagccggagcatctttgagctcctatattggaatcagagtctacagtattttcatcttgggcggaccaattcctgaagaccagttttttaatagcatcaattgagaacagggtcaattgtgaggtcccttaggaatacaaccagaaatctcatcactggagtatagaaatttccaaccaggctccagccagttatctatgcagactgattctagccaggcctaacttgcctagggtgatgatctacaggctatgacctgatgacacttctccctttctctcctctctttctctctttcacgtgtgcataaggcaacttagaaacattaattcaccaaagaatacttggagattcccaaatgatcaccccaattgtggctcttcatctccaaacacttagcctttttttttttttttaaaggaatgtgatgtgcttaaaccagatcttttttctttctatttggcaggtacataggcacatgaccctagtattttccttctctatttattcccttctatactttaccacaaatacttccacttgactccctcttctggtctctgttctatgaaccatctagattatcattccaaatgaatacatttgtgtttgagcccttaaatgcaagaatatttcccttcctggtctctccaaagctaacaggctaactagactcagaacaggactttaatctaagctggcaataagtgcttacctgtcctgaatgacctaagctgcaatcatcctgggtcacaatcatcagaggaacagatattatttttctcctattgcacgaagtggacaaaggttgtctagatggtgcagaatggatctcgataaagccagagctccttgtgaaataagaaaaatctcaagaatgggcatgtgactgctaagcaagctctgtgggagagctcaacctataatattacaagtggcatgcgtaagatcaacatgaactcatctctcaaatccccaaatcttaggtttcaatgtctcttacaaagttccaggagagttaagcttaggaccaatataaaggaagactactccaaactgtaggtagtaaatgcatggcactcattacccagggagggaatacaatcagaatacagaaaaaaaatcagggcaacatttatgaattgcagagccatatatgagtaaaactggatggatcttgaactactcattttcaaccctagtcctatgtgaaagtctcatgtctctctcctaggtcctagtattccaactcagtaggttggagtggggtctgtatatagttgcaaagctcccccaggtgattctgatttataaccaggtttgaggaccactacttgaataacttgaataacctttaacctgctggataggtctgacccagcctggtcatccttacggtcctaattgtcaaactgcttggttgatgaatgacaactcaaacagatacagctgtatacctgcaacataagaacaaactccagagcagtcattagaccctgaatctacagatcaaatcaagcagtataataatgctctggtccctggctcatttagagtcttctccaagatctctaagtctttcccaccttagggatgaatcagcggaggcacttaaaacaaggtactacttttggaaggaaatattcagatttgcttataagaataagatgcagacttcttttttcttttcttctcttttttttttttttttgagatggaatctctctttgttccccaggctggagtgcaatggcatgatctcggctcactgcagtctccacctcctgggttcaagcgattttcctgcctcagcctcctgagtagctgagattacaggcaggcaccaccacgcccagctaatttttgtacttttagcagaaatggggtttccccatattgaccaggctggtctcgaactcctgacctcaagtgatccacccacctcaggctcccatattgctgggattataggcatgagccgccgcgcctaggcagatgcaggcttctttacatatttctgtcacggctctttttgcacaatgtttaacacagtactaggaattcgtttattcagtaaacatttattgattaaaaattagttacatacccaatgccaatagtttgttgctgaggatataaataattaaataaggcagtgataaaacagaccagatgtgatctctagcttcttagttacctaataagctctcaaaaatattcttttatcatagtggctggatacagtgtaaaactctacctaagggtcatcctaccctcttaggaacacaacatttaagttctttcgaagaccgagctaccctggggccaagaacaactataaaaaaagtgcctaccttttcttctcaaatgtacctacaagtgaaggttaaaaatgaacttctggctgggcacgttggctcacgccagtaatcccagcactttgggaggccaaggcaggcagatcctgaggtcaggagttcaagaccggcctgagcaacatggaggaaacccccgtctctactaaaaatacaaaattagccgggcgtgctggtgcatgcctgtaatcctagctactcaggaggctgaggcaggagaatcgcttgaacccaggaggcagaggttgcagtgagccaagattgcgccattgcactccagcctgggcaacaagatcgaaactctgtctcaagaaaaaaaaaaaaagaacatctggagaatgagaactatgctatattcatctttgaatttccagtaccaggtacagtaccttgcacatagtaagtgttcagtgttttaaattttttttttttttttttggagacagagtcccactctgtcacaggctggagtgcagtggcgcgatctcagctcactgcaacttctgcctcccaggttcaagcaattctcttgcctcagcctcccgagtagctggggctacaggcatctgccaccacacccggctaattttttgtattttagtagagatggggtttcaccatgttgcccaggctggtctcaaacttctgatctcaggcaatccacctgcctcggcctcccaaagtgctaggattacaggcgtgagccaccgcgcctggcccagtgtttttaaattttaattaattaattaattttgagacagggtctggctctgtcacccacgctggagtgcagtggccccatctcggctcactgtaacctctgcctcctgagctcaagtgatcctcccacctcagcctctgagtagctgggactgcaggcatgtgccatcatgcctggctaatttttgtatttttttttttttttggtagagatggagtctcactatgttgcctaggctggtcttgatcctcccacctcggcctcccaaagtgaagtaattgcaggcatgagccaccgcacccagcctgttcagtgtttttgaatgagtgaatgaatgaatgaagctggaatcccagttctgccactaactgtgtatctttgtacaagtcacagattatttgtaacccttttttcatgactgggataacaactaccttgcttatttgttgttatgtgactggaggtcatgtgttctaagaatcactggcagctgggcatggtggcctgtaatcccaacattttgggaggctgagatgggaggatcacttgagcccacaagtttgagaccagcctgggaaacagagggagacctcatctccacaaaaaaattaaaaactagctgggtgcggtgagcgcgtgcctatagtcccagctactgggaaggctgaggaaagaggatcatttttgagcccaggaagtcaagcctacagtgagccatgattgcaccactgcactccaacctgggcgacagagtgagaccctgtctcaaaaaaaaaagaaagaaaattggcactctgcctggcattcagcaggtgctcaacaaatggttgtggtgatgctgtatggttgttactctgagaacggagaagcagaagcttccaagaaccaacttgtatggtcaaagtgacatctagtggtaaaattttagaacacacaccaaaagcacagtcaattgctggtttgaaatttaaattgaggaatgactaggaactaacagggcacctgatttacataagtacagtaacattatttaattctcaccagtgatttttttttttttttgaaacggagtctcactctatcgtccaggctggagtacagtggcgcgatcttggctcactgcaacctccgcctcccaggttcaagcaattctcctgcctcagcctcccatgtagctgggactacagatgctggccaccacgcacggctaatttttgtatttttagtagagatgggggtttcaccatgttgatcaggctggtctcgaactcccgaccttaggtgatcctcctgcctcagcctcccaaagttctaggattacaggcgtgagcgaccgcacctggcttcacgagtgattttcaatcctggatgcagattagaatgacgtgtgaagctttaaaaatctactggtgtctggatctcacccttggagacaccaatttaacttgcaggaggtgtgactcaggctgtcacatttttaaactgcgattttaacatgcagcctggttgggaaccacatgcaagagacccatgagatagtcttcttctcgttttacaaatgatgaaagtaaaagtcagaaggataaagtaattttcacaaagtcacacatttattattagcagtaggttatttgaacttgcatctaccattttcccacaataccacgttgctttgcagaggcttttggaagtctgatgtgctccacttagcttctgtctaggggagtctcaaactcagaagcgttaggaaattgcatggtgctgtgagctgaagccctccaaacaacagtttggtgttgatgggatagtgtggtctaatgaaggcactaactgcctgatcctctctctggattctttttttttaagacaaggtcttgctttgttgcctaggctggaatgccgtggcatgatcacagctcactacagccttgaactcctgggctcagctgggaccagaggtgcatgccaccatgcccagctatctttgtattttttgtagagatggggttttgccatgttgctcaggctggtatttttatgttttgtagagacgggggtctccctatgttgctatgaacattcatgtcaatttcaattttttaaaaattatttcaaaagaaactcattgtaattgtttgtgttaaaaaatgataacttgcccaggtgcagtggctcatgcctgtaatctcagcactttgggaggccaaggcgagtggatcacttgaggtcaggagtttgagaccagcctgaccaacatggcaaaaccccgtctacactaaaaatacaaaaattagctgggcatggtggtgggtacctgtaatcccagctactcaggaggctaaggcaggagaatggcttgaacctgggaggtggaggttgcagtgagccaagactgtgccactgtactccagcctgggcgacacaagactctgtctcaaaaacaaacaaacaaaaaccttaagcatacacattaaaaatctaccaaaactttttaaaattgagttttggcacttcatttttaaaaatataactggggtctcaaaaaggagtaacgaggccgggcgcgatggctcacgcctataatcccagcaccatgggaggccgaggccggcagatcatgaggtcaggagattgacaccatcctggctaacacgttgaaaccccgtctctactacaaaaatacaaaaaattagccgagcttggtggcgggcccctgtagtcccagctactcgggaggctgaggcaggagaatggcgtgaacccgggaggcggagtttgcagtgagccgagatcgtgccactgcactccagcctgggcaacaaagactccgtctcaaaaaaaaaaaaaaaaaaaaaaaagagtaaccagcttgctcttgacctctgaaaggctctgttgctgcctccaacaagaaaagcccattttatccaattagacaacaaatccccaaagtcagaaaaaccacgtgatatttgctggcatatccatgatgactactaattatgtatttggtaaatgtttgctgacaatatagcccatcaagaaatgatgggaggccgggcgaggtggctcacgcctgtaatcccagcactttgggaggccgaggcgggcggatcacgaggtcaggagatcgagaccatcctggctaacacagtgaaaccccgtctctgctaaaaacacaaaaaaattagctgagcgcggtggcaggcgcctgtagtcccagctattcgggaggctcaggcaggagaatggcgtgaacccgggaggcggagcttgcagtgagccgacatcgcgccactgcactccagcctgggcgacagagccagactccggctcaaaaaaaaaaaaaaaaaaaaaagatgggaaggctgggtgcgggtggctcatgcctgtaatcccagcactttgggaggctgaggcaggtggatcacttgaggccaggagtttgagaccagcttggctaacatggtgaaaccctgtctttactaaaaaaatattaatattagccgggtgtggtggctcacacaggtaatcccagctactcaggaggctgaggcgcgagaatcacttgaaaaccagaggtggaggttgtagtgagccaaggtcataacactgcactccagtctggatgaaagagcgagaaactctgtcccttaaaaaaaaagaaaacaaagaaatgatgggacagggtgagggtaggggagaggaaattctaacacaggtgatttccttctgacccacaacccccactttgctgttggtctggctgacgtggttcacaagggggatggtaacttagatggaacgtgtaaaccaatggaaacatgaaccttgattgaaaaatgaaaaatttctctagatcctgactaaggcaaggtcagcatgtttctcccacatgctggtccaaacagaagctttcttttacggcaggatagggatcagtcccttgtctaatcaaccagtggagttaatgagtatggcagaaggaagggagaggaaagatgacaaaaggagcaatgaaaaggaaacacctgacacatttatctttgtgagaagtgagaatcacctgtaaatgcctcagccaggaaggacaggtagggccctttataaaaggatttgtggaacttctggagtattttgtcattataacattttgttaatagattaacaaggctgggcgcagtagctcacacctataatcctagcactttgggaggccaaggcaggcggattcacttgaggtcaggagttcgaaaccagcttggccatcatggtgaaaccccgtctctactaaaattacaaaaaattagctgggcatgtggtatgcgcctgtaatcccagctactcaggaggctggggcggagaatctcttgaacctgagaggcggaggttgcagtgagccgagatcatgccaccccgactccagcctggacaacagagcgagactccatctcaaaaaaaaaaaaaaaaaaaagattaacaaaaacatggctgggcacagtggctcaagcctgtaatcccagcactttaggagggcagatcatttgagcccaggagtttgggactggcctaggcagcatagcgagaccccatctctacaaaaaatataaaaattagccaggcgttgtggtgcatgcctgtggtcccagctactgaggaggctgaggtgggagagtcacttgagcccagaaggttgaggttgcagtgagccaagatcttaccaccacacttcagcatgggcaacagagtgagaccccgtctcaaaaacaacaacaacaacaacaacaaacacaaaacacaaagaaacaaaaccgtgatagtaaggagagcagatgcctgcttttctgttgtgaagaaacttgggaaccactgtggaaacaggagaggggaaaggagctgtcatggacccttgctgagctccttccttcccccagccttttctcccatccctccccttacctggaaggtcctctctcctcctctctgcctaaatcttgtgccatctcagatccaacacaaattcccatgtctccatgacgactcctgccccccttccctgaactcctacagcacatctgctgtataccacacaattctcactaaattaagcatattgtctttgaaaggttcttgtgtgtctgtcttctaaaaccccttgtaaactcctcgaggacaagggccatttcttctgctgctgctccgtctcccacagtgctgatggcctaatagaccctctgtatggtcttgctggctgactgactgaagggttcagttaggctctcttgctcctgccagcaaagcaaagagtgcacaataaagtcctttcactatgaaatgacaaattcaaagatagaggggctgagaaagtgctcatacagaattattcattgtcttgaatgtctcatagtagccagatcccagaatcctcaggttagatgcggaagtaactttgatccatgtgatagtgctttttagattagtatttcacttaaagggaaagtgtaaagtaatacacattccatgggttacatgagtcaaggaaagggaagagtttctgttacgaagttagctcatatccccaaagacccccccaccaccgtgtttcatagcagtcaggaatttatagaagaaaatattgcgtgcgctctctcactctctctctctctctctccatatatatatatatatatatatatatatatatatatatatatatattttttttttttttttttttttttttttagatggtggagccttactctgtcgctcaggctggagtgcagtggcgagatctcggctcaatgcaacatccgcctcccaggttcaaatgattctcctgcctcagtctccggagtagctgggattacaggtgcctgccaccatgccccgctaatttttgtatttttagtagagacggggtttcactatgttggccaggctggtctcgaaatcctgacctcaggtgatctgcctgcctcggcctcccaaagtgctgggattacaggcatgagcctccatgcccggccttgctttttatatttttgacaataacagagccacgggaagaaaggatgtgattaggggaagaaaaaaggggagaggttcatgttgtctttattttcattaatgaatgtctcaaacattttagggtataaatagcaatcagtatttaggaaaggaagctggattcacactacttggaaatctgggtctttactcatccatggcaatttttgggtatcatgtgctcttacagaatctcatcttatgatatagattcagtttacagctattctatgatgcttgagtatttcaaatattaagtacattgaggctcatgagaattgctaatctgccgtgtgaaactgcagagttgtttcccaagggtagagatgcattcacatccacccacatagtacaaagggggaaatgattacgctggcctggattttttgtaatagtcccgtgacatggcttccacattgctctgtgggctgtggttaaagaacctaatctagaacaagacaagacttgtagatttaaaaagtcacctaagctgtttctttcctagacaaatgggattctagtttgggttttattttattttattattttttgagacagtctcattctgtcatccaggctggaatgctgtggcgcaatctcggctcactgcaaactctgccccctgggttcaagctattctcctgcctcagcccacctagtagctgggattacaggtgtgtgccaccacactcagctaatttttttgtatttttagtagagacgaggtttcaccatgttagccaggatggtttcaaactcctggcctcatgtgattcacccaccttggcctctcaaagtgctgggattataggcataagccacagtgcccagccctaatttgagtttcagagggcaatttgtaccgtttggaaaagatgctggatccttcaatattactgctttagaaagatttggaactctgacccatatttagtacatgacctttctggggcgtggaaaaatatgctctgtcatctaatgtgatgtcaattttctttaaccttccatgtaaatagtgcgcattaagacatgaggtctactgttaaataatttctctttataaacatagtgacaacaagattgtacagtatcaattaaaaagacccaatgtgaccaggtccactgcttcctgcatcttgaagtaagacaagtgttcagcttagagatgagcacctttctttccagagggagaagacatgatgggagaaaaaaatgttctctctgagaatttacccagataaagagctgggtagtcggatctaaatggtcccacagcaatccttttctcgggggaggtgcgtagatctttgacaagtgatgaacgaactttgcttcgtgtggttaggcctgggactgaactttgtaaccagggatttggtgcgcggggcttcacaggctgcagagaaacatgaaaacatgagtgcatatgccaaacgtgtctcatgtgagcggcagagcccaagtgaaggcctctttggctatagggtgtctcctttttttttttctttttgagacggagtcccactctgtcgcccaggctggagttcagtggcgcaatctcggcttactgcaatctccgactcccgggttcaagtgattctcttgcctcagcctctgaagcagctgggattacaggcgcccgccaccacgcccagctaatttttttgtttgtttgtttgttttttttgagacggagtctcacactctctcccaggctggagtgcagtggcgccatctcggctcactgccagctccgcctcccgggttcacgccattctcctgcctcagcctcccgagtagctgggactacaggcgcccaccaccacgcccagctaattttttgtatttttagtagagacgaggtttcaccgtgttagccaggagggtctcaatctcctgaccttgtgaccagcccgcctcggcctcccaaagtgctgggattacggtgtcagccactgcgcccggcgtttttttttctttctttctttctttcttttttttttttttttgagacggagtttcgctcttgttgcccaggctggggtgcaatggtgcgatctcggctcaccgcaacctctgcccccagagttcaagggattctcctgcctcagcctcccaagtagctgggattacaggcatgcgccaccacaccctactaattttgtatttttagtagagacagcgtttctccatgttggccaggctggtctcgaactcaggtgatccgccggcctcggcctcccaaagtgctgggattacaggcatgagcctccgctcccggccacgcccagctaatttttttgtatttttagtagagacagggtttcaccatgttggccaggctggtcttgaactcctgacctcatgatctgcctgcctcagcctcccaaagtgctgagattacaggcgtgagccaccatgcccagagattattctttaattaatctcaaaagcctaacaccagggtagtctctctcagcctactctggcttgaaaagctgcccattaaaaaataaaaataaaagcctaacaccagagttcgatatatgttcactcacacatttgtagaaggaacacaatatctcttataatattctttacttcactaataagttataatttcagctatacattatatggcgttattactagttaagtaataaaaccaatgtattatttatcttgtttttcatttcttaaaaaatgaataattggctgggcacggtggctcacacctgtgatcccagcactttgggaggccaaggcaggcagctcacttgaggtcgggagttcaagaccagcctggccaacatggtgaaaccccatctctactaaaaatacaaaaattagccaggcatggcgcagatgcctgtaatctcagctactcgggaggctgaggcagaagaatcgcttgaaccaggaggcagaggttgcagtgagccaagattgcgccactgtactctagcctgggcgacagagagagactttgtctcaaaataaaaaaagattaatcaattataatggaccatattattttaattttaattttcaagatttattcttatatttgttatatttatttttaatattttattatgttttttgaatattgtatgtgaaataaaaaatgaagtcatgatacaaagtaagtctgacctgtacatgaatgtttgtagaagctttattataatcacccaaaactagaagcaaccaagatgtctttcaagaagtgaatgaacaaactggtgcacctacacaatggaagagtattcagaggtaaaaagaaacgatgcctggcgcggtggctcatacttgtaatctcagcactttgggaggccaaggcaggcggatcacaaggtcaggagttcgagaccagcctgactaacatggtgaaaccctgtctcttgtaaaaatacaaaaattacctgggcgtggtggcatgtgcctgtatttccactacttaggaggctgaggcagaagaatcgattgaacccgggggtcagaggttgcagtgagccgagaacacaccactgcactccagcctgggcagcagagcaagactccatctcaaaaaaaaaagaaagaaagaaagaaagaaatgagctgtgaagccagaaaaagacatgcattattttaattattttagtagagacagaactagtagagttaattattttagtagagacatgaacctcttcaaatgtgtattgctgccaggaggttggctgacgcctgtaatcccagcaatttgggaggccgaggcaggcagatcacttgaggtcaggagtttgagaccagcttggccaacatggtgaaaccccatctttactaaaaatacaaaaattagcggggggtggcggtgcacgcctgtaatcccagctacttgggaggctgaggcacgagaatcacttgaacccgggagtgagatattgcagtgaggtgagatggtgccactgcacttcaacctgggcaacaaagtgagactgtgtctcaaagaaaaaaaaagatatgtattgctaggtgaaagaaggcagccggaaaaggcaacatactgtataattccaattatatgacattgtgtaaaagacaaagctatagagatagtaaaaaaaggccgggcatggtggctcatgcctgtaatcccaagcactttgggaggccgacgcgggcggatcacgaggtcaggagatcgagaccatcctggctaacaaggtgaaaccccgtctctactaaaaatacaaaaaaaaaattagccgggcatggtggcgggcacctgtagtcccagctactcgggaggctgaggcaggagaatggcgtgaacctgggaggcggagcttgcagtgagccaagatcgtgccactgcactccagcctgggtgacagagcgagactccatctcaaaaaaaaataaaaaaataaaaacatcagtagttgtccagctactcgggaggctgaggtgggaggatcacttgagcaggggcagttgaggctgcagtgagccatgatcataccactgcaactccagcttaggcaacaggaggagaccctgtctcaaaataaaaaacaaaaacaaaacaaaaaaaggagaggaaaaaagaaaaatcagtggttgacaggtatttgtggggaggaaaggagggttgaataagtgaagcacaggccgggcacactggctcacgcctgtaatcccagcactttaggaggcccacgcaggcagatgacttgaggccaagagtttgagaccagcctggccaacatggtgaaacccagtctctactaaaaatacaaaaattaggccgggcacagtggctcacacctgtaaccccagcactttggaagcctgaggcgggcagatcacctgaggtcagaagttcaagaccagcctggccaatgtggtgaaactctgtctctactaaaaattcaaaaattaaccaggcatggtggcaggcgattgtaatcctagctactcaggaggctgaggcaggagaattacttgaacccagaaggcggaggctgcaatgggccgagactgcgccactgcactccagtctgggcgacacagccagacttcgagactccatctcaaacaaaaaaagggaagcacaggagactttttaaggtggtgaaactattctgaatattctgtataatatatgatggttacatgacattattcatttgttaaaacctgtagaactttacagcaagaagagtgaaccttattttttgagacagagtttcactcttgtcacccaggctggagtgcaatggtgcaatctcggctcaccataacctccgccttccaaattcaagcttcttttaaatgcctcagccacccaagtagctgagattacaggcacacaccaccatgcccagttagtttttgtatttttagtagagatgggggtttcaccatgttggccaggctggtctggaactcctggccctcaggtgatccacccatctcagcctcccaaagtgctgggattgcaggcatgaggcaccccacccagccagagtaaacgttaatgtatgcaaattaaaacaaaaacatttaggaagtaaggggatctaggaaggaatacggactgcatgtagcaagagaaccaaatgtatagagcaacttcagtgaagggagtaggaaaaacttcggaaatgtgtggaatctataagactaaatacaacaggaattgcacatagcactgtactctagttaataaaattgtttcccaggggagtgtgggttaatatttctgatttatgtatggaaaattggaacatgaagtatactaataataattgtaatgattacctgaaagaaatatagacagtcttctagtcatggagaataaattttaaaaccttcattttttacatcaggtgttttttatttgtttgtttgttttttagagacctggtcttactatgttgccccagctgccagagtgcaggagctagtacctattcacaggcacgatcatagctcactataaacttgaactcctgggctcaagtgatcctcctgtctctggcctcacatgtagctaaaactacgtgtaccatcatgccccaaccctcaatttaaatacagatttttgttgcagatgtgatgatgaaaaataaatactttcaagcacaattgtatattaggataaaattctgtgtggaagttacttcataaaggaaatgtgagcgtttttttttaagatgtaattttaattttaaagaagagcttacatattttatttttaaaatggatgatggtagttatcaaactgttatggcatttagattcaaatggatgcatttaaattcagttttgaacttaaaatatcaatatgtaaagctggaatacttacatgtttgaaattaaactctgcttctatttaaaatgaaaacattttagatgtcaattttttttttttgagacggagtctcatctctgtcacccaggctgtagtacagtggctcaatctcaggctcactgcaacctccgcctctcaggttcaagcgattatcctgtctcagcctcccgagtagctgggattacaggcatgcaccaccatacctggctaatttttctttattttcagtagagacggggttttaccatgttggccaggctggtctcaaactcccgacctcaggtgatccacttgcctctgcctcccaaagtgctgggattgcaggcgtgagccatcatgcctggcctcattttagatgtcaatttaagaaggtaaagaggtgacatcatttttcaaaattattttataggttatatgagcaagcaaaagagttggaaattcaacatcctagatagcatctgttacgacgtatagcaagactcagccaatttgttctgtaaaaggccagatagtagatatttcaggcttttggggccagatggcctattcaaactgtggttttttgtttgtttgtttgtttgtcattgagagggagtcttgccctgttgcccaggctggagtgcagtggcgcgatcctggctcactgcaacctctgtctcccgcattcaagcaattctggtgcctcagccacctgagtagctgggattataggcacatgccaccacacccggctaatttttgtattttttagtagagacggggtttcactatgttggccaggctggtctcgaactcctggccccaagtgatcctcccgcctcagcctcccaaagtgctgggattacaggcatgagccaccacacccagcctaaactttatattaacatcctaaagttaaacatgaaaattcttctataacaaataatcccattgcccagagggaacttctttctgtcttcagtttggtttatatctttccagatattcaactatgcaggcagacacacacacacacacacacagacacacacacacacacacacacacacacatatatggttttaaataaattttacataatgtaggctcatgcctgtaatcccagcactttggaaggctgaggcaggtggatcacctgaggtcagcagtttgagaccagcttagccaatatggtgaaaccttgtcactactaaaaatagaaaaattggctgggcatggtggcaagcgcctgtaatcccaactacttgggaggctgaagcaggagaatcgcttgaacctgggaggtggaggatgcagtgagccgagattgcaccactgcactccagcctgggtgacagagggaaactctgtctcaaaaaagaaaaaagaataaagaaaagaaaagaaaattatatataatgtatattggctgcattttttaagcaaaaaatgggacaacatattgttctataatttgattttttaacacgttatagacatttccttgtcattcctttaaataactattgattggtagatatttgagtaatttccagttttgaaattaaaagcaacaaccatctatgtgtaaatatctttgtacacatgggtgaattttttttttttttttcgagacagggtttggctctattgcccaggctggagtgcagtggcgccatctcagctcactgcaacctctgcatcccaggctcaagccatcctcccaccttagcctccctagtagctgggaccacaggtgtacatcaccatgcctggctaatttttgtatttaaaatttttcggcttggcatggcagctcattcctgtaatcccagcactttgggaggccaaggcagttggatcacttagggcaaggagttcaagaccagcctggccaacatggcaaaactccatctcaactaaaaatacaaaaattagttgggcatcgtggcacatgcctgtaatccaagctactcaggtgaggcacaagaatcgcttgaacctggcaggtggaggttgcagtgagccaagatcacgccactgcatttcaggctaggtgacaaagcaagactctgtctcaaaaaaaaaaaaaatgctgatttttcatagcaacagcgtctcaccatgttgctcaggctggtctggaactcttgagttcaagcaatccacctgcctcagcctaccaaagtgttgggattatcggtgttagccactgcacctggccagtgaatattttttaaggatagatttctagatgtagaattactactgggtcaaagatatcaaaattttgtattgatgaattgtcatctaaaagtttttaccagggtttctcaatcctggtactattgacatttgggcccagatactccttggttatggggtttcattgtacattgtagaatgttttacagcatccctcaatgctagtagcacccccactgttggacaaccaaaaatatctctagatattgctaaatgacccctgggggtgcaaaatagccccaggttcagaaccactgcctcggacatttgctttcttttactttccttttatttctctttctcaccatctccctttcaacaactcatgctatccttccttcttaaagaaaagaacttatgaggctgggtgtggtggctcacgcccgtaattccagcactttgggagactgaggcaggtggcttgcctgagtccaggagttcaagaccagcttgaccaacatggcgaaaccccgtctctagtgaaaatacaaaaattagccgggtgtggtggcctgcgcctgtaatcccagctacttgggaggtggagacaggagaattgcttgaacccaggaggcggagattgcagtgagccgagatcgtgccattgcactccagcctgggcaacagagtgagactctgtcttgaaaaaaaaaaagaaaggaacttataatttagtatatatcacccttccttcccagtatatttacactttagatatagatgaagtgaaagtgacaatgactaattcaagaataactatctaatgatgggatgaattttgatgggagagataatttggggtactttcctgataggctttaaatcatactatgtacacttaaacatcctgttggctctattcatcttcttttctgtagaagtttctctgaataacaatgattagcatctatattcagaatgtcaagttcctggcccagcgcgatggctcacgcctgtaatcccagcactttgggaggccaaggcgggcagatcatgaggtcaggagatggagaccatcctggctaacatggtgaaaccccgtctgtactaaaaataataataataataattaaaaaaagaatgtcaatttcctttgatttttttaaaagggaattctattgattcaaaacaaaaaaaaaaagaagagaaaggtaagcaatgcttaaaaatcaagaaaaatgagatgaattagggaaagtaaagtttattgtttaaaaaatactatattttggctgggcacagtggctcgcgcctgtaatcccagcactttgggaggctgaggcaggcagatcacctgaggtcaggagtttgagaccagcctggccaacatgggaaaccccatctctactaaaaatacaaaaattagttgggcatggtagggggtgcctgtaatcccagctactcgggaggctgaggcaggagaaaattgcttgaatctgggaggcagaggttgtagtgggccaagatagcaccactgcactccagcctggatgacagagcaagactctatctcaaaacaaacaaacaaacaaagcctatatttttagcagggcatggtggctcatgcttgtaatcccagggcagtgtgctaaatgcaagacgggatagaaaaaggcataaggaagtcttttccttgaattttaggaaggaatgtgacaagaacatgaattaccagcacaatgtgttaaattcatgtgaaagagtcaaaattctcttgagatgaaggagatggtagcgcctttggagaggagatggaatgtgaaatgggctttaattagggttttgacaaaagataattgggggacaatatgcagaggaaacagcctgagaaaacatataaaggatgatataggtaagcaacagcaaacagtctagcttgtagaagtagagtttacaggggttggggatgataggctgtaacattatgtgactccagtacctagctgaggaacttggatttgtcaatggggcacctaggtagattttgagtagggtgatgacaggtttggggcctcaacttgagaaaattcatcttgtagctatctgtggtataaattggcatgggggctgataaggtttggctctgtgtccccacccaaatctcatgttgaattgtaatctccaatgttagatgagggacctggtgggaggtgattagatcatgggggcagatttcccccttgctgctctcatgatggtggttgagttctcacaagatctggttgcttttgtttgagacggagtctcgctgtgtcgcccaggctggagtgcagtagcgtgatcttgactcactgcgacctccacttcccgggttcatgcaattctcctgcctcagcctccagagtagctgggatgacaggggcgtgccactatgcccggctaattttttgtatttttagtagagatggggtttcactgtgctagccaggatggtcttgatctcctgacctcatgatccacccaccttggcctcctgaagtgctgggattacaggcatgagcttgcttccccttcaccttccaccatgattttaagtttctttaggcctccccaaccatgcttcctctacagcctgaggaactgtgagccaattaaacctcttttctttataaattactcagtctcaggtagttctttatagcaatgtgagaatggctaatacaggagcaattaatggtaaagagacagtcgggcaccgcggctcatgcctgtaatcccagcactttgggaggccgagataggtggatcacctgaggtcaggaattcgagaccagcctgaccaacatggtgaaaccctgtctctactaaaaatacaaaaattagcttcggtggtagcaggtgcctgtaatcccagctacctgggaggctgaggcaggagaatcgcttgaacctgggaggtggaggttgcagtgagccaagattgggccattgcaacacagaggttggggtaacacagcaagaccctgtctcaaaaaaataaaataaaaataaaaaataaaggtaaagagactagttgggaggctatttgtaataaaccaggatttgtctgcctcaacactacactactgacattttgcatcagacaattatttgttgtgggagggttgtccttagtattgtagaatgtttagtagtgtctctagtgtctgtttactagatgttagacaacccctagccccctatatgacattgccaaatgtccctatggagacaatatcacccccagttgataactgtgtgtgtaacagaccatgtgagaaataaaaaagggtggatgttagacatgggtaaggacaaaatctaaaagccttggcaagtgtttggataggcttgcaactgagaaagagggagtgttgaaagctcaaacagagaaaggtcctagaggccatgtactgtagtctaatatgcttatcattgcttgaaacattgtaaaccctcttggaaggcagtttggtaaaacctattaataatcacaaaaagtatcttactttttgacccagcacttttatttctgggagtttatcttaaatgattcaaatgaagacaaggaatctttatgtacaaagcaattagttgcatgacagacagtgaccacgttctcaaaaattacacccgcatgccaccacattgcctgttaaattagaagccgatttaagatcctgagtttaagagccaaagaagttgtagctaaagaaacaaaatcccagaggggcaggaagggcagatatcaagaatgcaagtagagaaattcttaacttatttttcagagagaggacaatgaatttgagaatttgtattggagaaaagagggagagaagttaggtggaggaactcctagataaggcttcaatcagtgaattcatctgcagagcagaagtttctgcggaactcaaactgcctgggggcattccttgaaaagaagaattctgcactttttggtgggaacctgccggtggaacatcctgtttagaaatgaggacatccaaggaacactgcaatgtgcagagactagaaggaaaaaacagtcaagtagccatttctcctggggagtctctagtaacttgattttgtgcttcttcttgttttttgagacaagagtctcactctgtcgcccaggctggagtgcaatggtacgatctcggctcactgcaacctccacctcccgagttcaagcaattctcctgtctcagcctcccgagtagctgggactacaggtgcaagtcaccacacctggctaatttttgtaatttttaaattattatttatttttatttttttgaggcggagtctcgctctgtcgcccaggctggagtgcagtggcgccatctcggctcactgcaagctctgcctcccgggttcacgccatcctcctgcctcagcctcccgagtagccgggactacaggcgcccagcaccacgtccggctagttttttgtatttttcttttttagtagagacggggtttcaccgtgttagccaggatggtctcgatctcctgacctcgtgatccgcccgcctcggcctcccaaagtgctgggattacaggcggagccaccgcgcccggccaatttttgtagttttagtacagacggggtttcaccatactggtcaggctggtctcgaactcctgacctcaggtgatccacacacctcggcctccgaaagtgctaggattacagtcgtgaaccaccgcgcttggccgcaacttgatttttaaattgctctctgagtgtagattccttgtttgtttggcaagggttcttgccgctgccgctacagcttgaagccaaacatttaatgaaagagagcgggaggggccgaatagaagaatgatgggcgtggccaaccccgaggtggctggaggccgcgcccccttcccagagtgcaccgcagccgctgcattcaggaaccgctttagcttcgcccccggccggccgggcggggaagactggtgtggtctggccatggatgggctccaggccagtgcagggccgttgaggcgcgggcggccgaagcgccggcgcaagccccagccacacagcgggtcggtcctggccctgcccttgaggtccaggaagatacgaaagcagctgcgaagtgttgtatcccgcatggcagcgctgaggacgcagacgctgcctagcgagaactcggaggaatcgagggtggagtcgacggccgacgacctgggggacgcgctacccggtggggcggcggtggcggcgtcccggacgcagcccggcgagagccatacggccacctggggcccgcagagctgctggaggcctcgcccgccgcgcgctccctgcagaccccgtcggcgcgcctggtgcccgcttccgcgccgcccgcgcgcctggtggaggtgcccgccgcgccggtccgggtggtggagacctcggccctgctgtgcaccgcgcaacacttagcggccgtccagtcgtccggggcccctgcgacggcgtcggggccgcaggtggataacacgggtggggagccggcctgggactccccgctgcggcgcgtcttggccgagctgaaccgcatccccagcagccggcggcgagcggcccgcctctttgagtggctcatcgcgcccatgccgccagatcacttttaccggcgcctatgggagcgcgaggcggtgctggtgcggcggcaggaccacacctactaccagggacttttctctaccgctgacctggattcgatgctgcgcaacgaggaggtgcagttcggccagcatttggacgccgctcgctacatcaacggacgacgcgagaccctgaacccacccggccgcgcgctgcccgccgccgcgtggtccctgtaccaggccggctgctccctgcgtctcctctgtccgcaggctttctctactactgtgtggcagtttttggctgtgcttcaagagcagtttggaagcatggcaggctccaacgtttacctcacgccccctaactcgcagggctttgccccccactacgacgacatcgaggccttcgtgctgcagctggaaggtaggaaactctggcgtgtataccgaccccgagtcccaaccgaggaactggctctgacatccagccccaacttcagtcaggacgacctcggtgagccggtgctgcagaccgtgctggaacctggagatttgctgtattttcctcggggcttcattcaccaagctgaatgccaggatggagtccactctctgcacctcaccttgtccacgtaccagcgcaatacctggggtgacttcttagaggccatactgcctctggcagtgcaggctgcaatggaagaaaatgtggagtttcggaggggtctgccccgagacttcatggattacatgggggcccagcattcagattctaaggatccgcgaagaaccgctttcatggagaaggtgcgggtcttggttgcccgcctgggacactttgctcctgttgatgctgtggccgaccagcgagccaaagacttcattcacgattctctgccccctgttttgactgatagggagagggcactaagtgtttacgggcttccaattcgctgggaggctggagaacctgtaaacgtgggggcccagttgacaacagaaacagaagtccatatgcttcaggatgggatagctcggctggtgggtgaggggggccatttgtttctctattacacagtggaaaactcccgtgtgtatcatctggaagaacccaagtgcttggaaatatacccccagcaagctgatgccatggaactgttgcttggttcttatccagagtttgtgagagtgggggacctgccctgtgacagtgtggaggaccagctgtccttggcaaccacgttgtatgataaggggctgctgctcactaagatgcctctagccctaaattagtttcttgttgattgctggaaacaaggcagtagtgattctccgctgccactgctaccttttttttttttttttccttaaactcacgttcttaccttgataagcatcagtgtgctcacatttacctttatcactgcttcagtgtcacaaacctcggaaggtcttctaggaagaaccatctcatctaggtacaaaaggaaaaggagaagttggaggtggaaaaaaaacccttgatccgtgatcatttcagagcaccaacttcatcaccttcaggcttcagtgtactgggtaacactgaccatgtcgttctgcttgagacagatattagattttttttggaatttggatctttcatctgagttctttttcatgggcgggtcggggtcagtatcctgtttgttattgttaaatttgtatgaaccttagaaaagttattaaagtgccaaagaatgtttccctttcctaaggctagattattatgtgggatggttcgaagaaatgcaggagcgggaggaagatagggaaaatctataatggctgaagtgaaaagcaacctggggtggttgtagcatgtaaaaggagcatgttaatcaacctcttaaggaagagactctcaggctgggtgcggtactcatgcctgtaatcctagcactttaggaggccgaggcgggtggatcacctgaggtcagcagtttgagaccagcctggccaacatggcaaaaccccatctctagtgagaatacaaaaattagccaggcatagtggtgcgtgcctgtaatcccagctactaggggggctgaggcaggaggatcacttgaacctgggaggtggaggttgcagtgagctgagatcatgccactgcattccagcctgggcaacagagcgagactccgtctcaaaaacaaaaacaaaaacaaaaaagaatcttatctgattgggaccagttcactaactttggggataatttatgctatttaattatgcaacccaattctagtagaaaaattattttctaccagcttgttcagttttaagatcatggtatgtttttgctcactgtttgcttacatccatggctggcactgctgtcataagggcagcatgtcacctagttgtgccttcatagaccttaggcaaccaacttttagcaagctggccatgaaggaaggctactgttcaagttactttccactctcatttttattctggcagttcgaagaaacttccccaaatctgacaagtgaatattctcatggttggtggaaaagtgcctgatgtaccagaaagagcactggacttggaaccagaagacctgggtttggggtggtagctggtaggcagctggctgagtgacctgaggctgatgctacgctcaggcacacagattttgtaagtatattttggtacagtttgatttctgcaccctcatcatttaggttgcgtctgggactcttaagagtctgtcaccataatggatagttttctgttatttaaggttgagaactttacaaattctttttaaaaaagttacaaaagcatagacatacactaagtaaaaatgatagttctccctccaaccccactttccagagacaagcactattttttgtttgtttgtttttttgtttgagacagggtcccactttgttgcccaggctggggtacagtggtgagatattgggttactgcagcctcaacctcctgggctcaagcaatcctcccatctcagcctccttagtagataggactaccagtgtgtgccaccacacccagataatttttatttatttatttttttgtagagatggaggggtcttgctatgttgcccagactggttttgaactcctggcctggggtgatcctcccaccatggcctcccaaagcactgagagtccaggtgtgcgccaccacgcccaaccaccaaccactaccactattaaggttaagctcataaagcttttttgagtgcttagtcaaacatacatggtagtattgttttataaagacttgtgtttttctgatatgtccttttttgacctaacttttaagtcagttcaaatagagataacttttttttaagggagaaaataaatgaataaaaacccgagaaacaaacaaacaaaaaaaaaacacaaagactgagtggatggtagccaagagggaagagagtaccctttcctgactctttcatcctctaaggcttgctactaagtcccaaaacatccagatcctggaagaggcttattaaaggaatcaaggcatggaactcacccctaggaaacctaccctgaaaagtttcttggagtaaagtctggagtgttagtggtccttgttctcctttgggtttcaagtaaacacgttttgcttcctccctcacttttcccatgaccatctccagcttgagtattttgtgtgtcagcaagtccttttggcttagtgttttaatctaaattagaacaaataatgtttgaaaaacaaaacaaaacacctgtactaggcagcaaattatcaaaaaacattaataaagtgattgtaggaggctgaggagggaggatcacttgagcccaacagttcaaggctacagtgagctgtgatcatgccactgcactccagcctgggcaacaaagtgagaccctgtctctagaaaataaagaagtaactaattgcatatgcttatcagtagtaggtggtacataagtgcctgagaacattgttctcttatgatattggttggagattttttatacctgttcgtgaaaattttacttcagctttttgggcatgatgaacctgctaagaattgcttgcttgatgtgaagttggtttcttgaattacctttttaaagtcctttcccctctattccttcatcttatctaacagctttgaaaaattagaacaatccaggccaggcatgatggctcatgcctgtaatcccagcactttgggaggctgaggcgggtggatcacttgaggccaggagttcaagaccagcctggccaacatagcaaaaccttgtctccactaaaaatacaaaaaaattagttgggtgtggtggcacatgcctataatcccagctattttggtggctgaggcacgagaatcacttgaacccaggaggtggaggttgcagtgagccaagatcacaccactgcactccagcctgggcgacagagcgagactgtccccccctcaaaaaaaaaagcaaaaattatgttaatcctttcagctagagattttctttggtgagaaaacccagattaggaattcagaaaaattaagaagaaaatctagggggccagctctagtcccttattccttctctatgcctatttgaaaaaaaggaaaaataaacaacttgggtttggggttgatggggagaaaataggaagggagggaaatagtatttctgaaacaatgagggttacttgataggactaataggatttttgttttgtttttgtctttactagtaggaccttgtaacccaatcttgcacagatgctttgcatcttcaaatgatgtggcatctgtgtctggggttttagaaagtacttctatggtgggaaaaagggtatgtacatgtttgaggaggacagggtctgaggaactcttgagagtcctgaattttctcttgagaacagagcttgcacttatttaccctgttcttgatctcctgaagcatttcttggtttccttcatttcctaagttgagtatcttcattgtctggtacatttctctgaaagataagaagggcttcttagattattctaccctgccctttaaaaaagtatgggggtagaaaatataggacttggaatcaggtaagaatcccaagttccaatcctaactgtgcagttttgctgagccttatatgcaaaaatggtataatgcttagcttacaggaataatgtgcagtttttgagacaatatatttgtgggttttttgtttactttttgtttttgcgagatggagtcttgctctgtttcccagagctggagtgcaatggcacgatctcgtctcggctcactgcaacctccacctcccaggttcaagcgattctcctgcctcagcctcctgagttgctgggactacaggcgcgtgccatcatgcccagctagtttttgtatttttagtagagatggggtttcaccatgttggccaggctggtctagaactcctgacctcaggtgatccacccgccttggcctcccaaagtgttggggctacaggtgtgagccactgcacccggccatgcccgtctaatttttgtatttttagtagagacaggtttcaccatgttggccaggctggtctagaactcctgacctcaggtgatccatctgcctcagcctcccaaagtgttgggattacagatgtgagccacctcatctggccaagacaatatatttgaaggtgccaataggtaccatttactgaacacctttatgacaggcgctaaacatgtcatctcattaattatcaccacaaccctataatgtagactatcacctgcatttgatacatgaaaaaaatgggctcacagagtttaaataccttacacgggctcacatagctattgcatgccagagctggaattcaaaccctggtctttttgactctaaaacttgttgtcccaataggcatttgataaatgttagttgaatatatgaataacttaaaacccatcctttttttttttgagacggagttttgctcttgttgcccaggctggagtgcaatggcaccatctcggctcaccgcaacctccacttcccaggttcaagtgattctcctgcctcagcctccctagtagctgggattacaggcatgtgccaccatgcctggctaattttgtatttttagtagagacagggtttctccattttggtcaggctggtctcaaactcccgacctcaggtgatcctcctgcctcagcctcccaaagtgctgggattacaggcgtgagtcatcacacccggccaaaacccatcctggtggggagaaaagatgcatgaactacataagcttgactttcaatctaatttaggccagtttttcagttacctacttgggtgagtggtgaatgtgcaggtgaaccagtgcttttactgccattaggtagcctggaaaggcagggacatattcaatgagcaaagatgtgagagttggcagtataaggtcatggtgggagccagaggtttagtgcttactttagaacagcatcgtggttctccaggagcagcacgtctaggaaggtgtccctgacccggtccccttgaagtttcagggctaggatgctacggcaagcttccagccgtacacctggtgactcttcatagtggatagcccagagcagaagatccgtcagctcgggacttacttgcccaatctgtcccaaagctgcagagattagagggcagcatgtcactgaagactgagcttactatattctagcatccagaaataaattgagttttgcaaacaataccttcccttttggatggtaatcaccattagaattttagggataggtcagaatgggacattacctccaaaggattcctagaagagggatgttccatcccatccttgcctgttaggatatttgcctattttgggatgaaatatagaacaaataacatggaagacctgcctagtcccagcagggtgatggggaaaggaggcacaattatttatctatgtcaaaaagagaagcaatgccaaagattctaaaaagaaactaggcagattaaggggcagggttttaggtctgtagcagtcttgaaactgatctgacttttgcagagcgtaatagttgagatctccaaggaaagcaagatgcatccagcactggatacctacttggaacttatccttaattctgttggcagggactgtcttgtcagccctttctttaacttaagtttgacatatacctagactcaggatctttcactaaaaattgaagaaaattatctttctcttttcagacaaggaacttctgaaaagctaagatcattacctctcctgcacttcaccccattagagagtttcaggggatcatttctacttgcataggcaaaggtatttaaggttgaagagtttggggcactacttctataatacctcgaatggcaaaggccttgattttccagtaaggatctctctgcatcaggttcaggaggcattcaagcacctgggatggaaaaggcagtgttgagtggggaggaccagagcaagaatgaaccagaaacagctgggtgcggtggtgcacccctgtaatcccagcattttgggatgccaaggtgggcggatcacttgacatcaggagtttgagaccagcctggccaacatggtgaaaccctgtctctactaaaaatacaaaaattagccgggcatggtgtcacacgcctgtaatcccagctactcggaggctgaggtaggagaattgcttggacctgggaggcggaggttgtagtgagctgagatcgtgccactgtactccagcctgggtgacagagcgagtctccatctcaaaaaagcaaaaaaacaaaacaaagcaaaagaatgaatcagaaacagggaaaccacttatctctaaaaggagctataattgaaaaatgacctatcaattctggtgacaaatgagctggagcctaaagtaccaacctatatgcatagtgagtacattagctgaattatctgctattgattttctcagtctacagatctggggccatatggcttctcttgaacacttcaaacagatttttccctaataatggaattataactccatttatgggagttgatcctaaagcccatcagcacccaggtaatgagaagctagttaactgaggtgagaacaggattcaggggtgtgctctagaatcgaagtctgggctggctgggagctaaaccaagcttgtccaacatgtggcctaggacaacttggaatgcggcccaacacaaatttgtaaactttcttaaaacatgagatttatgccaggcgcggtggctcacgcctgtaatcccagcactttgggaggccgaggcgggcggatcacgaagtcaggacatcgagaccatcctggctaacacggtgaaaccccatctttactaaaaacacaaaaaaattagccaggtgtggtggcaggtgcctgtagtcccagctacacaggaggctgaggcaggagaatggcgtgaacctgggaggcggagcttgcagtgagccgagatggcgccactgcactccagcttgggtcacagagcgagactccgtctcaaaacaaacaaacaaacaaacaaaaaaaccatgagaattatgcacggaccttttttttttttttttagctcatcaactatcgttagtgttagtgtactttatatgtggcccaagacaattcttccattgtggcccagggaagccaaaagattggatgcccctgaaacagtcctgtttgaagtggcttatacacccccttcccagttccaatctctcattctgtgtccccacagaatgttgagcatactgtgcacaaccagggaaggtaatgccctcttcaggtcaatcaggtaagatgagaatatgtttccctgactcaccatcttgtcgcggatctgcagggcaccagctgccaaacaggctgcccgccgaactgctgtgaagtcatcagagaagcagtgcaggaagcttgggagaagcttggcggtcataagcttgagctcacctatcaggtagagagcttccacacgctcctgggaatttccttgacctagcttgaccctgtaaggcacaagttgctttcctttcacctccttaaactttcagtacctaacccccaacccccactaatgccctcatgataaaatccgggttctgtaggctgtcaatcccattcagccttatgctcatgagataagttttactgggtacagagctcgattgtcttctttacttgaatccctaatacatagctgttcagtaattaggtaatgcagggctttcagttacactgaatgactgaataaaggaaaatgtcaacttgcacctcttttcacagtcaagttctcttctccattgccctcacgtgtgccatgattatgtctgcatttggcttccagcctggaatgcctatgcagtctttttgtttgtttgtttaaattatttttatttattttattatttttttgagatggagtctcgctctgttgcccaggctggagtgcagtggctggatcttggcttactgcaagcgccgcctcctgggttcacgccattctcctgcctcagcctcctgagtagttgggactataggcgcccaccaccacgcctggctaattttgtttttcttgtatttttagtagagatggggtttcactatgttagccaggatggtcttgatctcctgacctcgtgatctgcccgcctcggcctcccaaagtgctgggattacaggcatgagccaccgcgcccggccttaaattatttttagagatggggtcttgctatgttgcccaggctggtcttgaactcctgacctcaagtgattctcctgcctcagcctgagtagctgggattataggcacttacccactctgcggctcctatgcagtctctctctcttttttttttttttttttttttgagatagggtctttctctgttgcccaggctggaatgcagtggcatgatgatggctcatgacagctttggacttcctggacccaggcagtcctcttgcctcagcctcccaagtagctgggactacaggcatacaccaccacactggctaactttttattttattttattattattatttttgagacggagtctcactctgtcgcccaggctggagtacagtggcgtgatctccgctcactgcaagctccaactcccaggttcacgccattctcctgcctcagcctcccgaatagctgggactacaggcgcccgccaccacgcccttttgtatttttagtagagacagggtttcaccatgttagtcaggatggtctcgatctcctgaccttgtgatccacccgcctcggcctcccaaagtgctgggattacaggagtgagccactgcgcccggccaattttttttttttttttttttaatttttagtagaggcaaggtcttgctatgttgcccaggctggtctcgaactcctgggctcaattgatcctcctgcttcagagtctcaaagtattgggattacaggcgtgtgccactgggctgggcctcctgtgcagtcttatccaccctctgtgaaacttggccttactcctctagccacgctgagtattccatttttctgctccagcagttatggtatatgccatttgttctagtttttaatgatttggtatttttaattaggtgtttgtatattttgcatgtggtcatcagaattgcgtcatacttttgaacaccctccagcaccgaaaccattgcctcacacctactgggcactcaatgcttctttccctagccacattgttagtttgtagggactgttaattttttacagtgggacctggtccagggtccgtacagaggagctcaacaaatgctgggtggctggatcccaggcctcctaagcactttttttttttgagacggagtcttgctctgttgccaggctggagtgcagtggcgcgatctctgctcactgcaacctccgcctcccaggttcaagcgattctcctgtctcagcctcccgagtagctgggatgacaggcatgtgccaccacgcctggctaattttttgtatttttagtaaagacagggttttactgtgttagccaggatggtctcgatctcctgacctcgtgatccgcccaccccgtcttcccaaagtgttgggagccaccttgcccagcctgcctcctaaacacttctaagaatttagaagagtgtctcctcatgttgactgggtcttacctgattatgtcgtgcacctctttcccgaggctcatttgcccaagcgcctgtgcagctgctctcctcacttccttattccagtcattccacatcagctggatcaacttatgtttcatatcctataaataggtatgatcattaggtatcatcacttaatgaatgttaattttgtgcttggcgttgtgctgttttttcttctttttttactcatcactgtactaatgaggattgtcctgagtgttttttcccatcgcttactctcccaaagaatccagtggggcagatattactaccatttacagatgatagaatggaggctttgatcagcttgtccaaggttaacctggtgagtgctggaaccaggactcaaacccaactctcccaagctcatcctttaaactatgtagtatcagtgccaacataacttgtacctgggagacttaaaatttgaaagtgatacttgatgaagtgactagctcattgcagtttgcctgggactctcctggttttggtcctgaaagtcccatggcctggacaaaccagaacagttggtcactctataagtgcacttctctcagagaggaatgggcaaagattactacacgatgatgtgtaaatgtgcccacgctgttcttcctgctagaagtatctcccttctctactcctacctggtacttgatgtctttgtagtcttcctttaggatttacctcaaaagcatctccttcctatctcttttattaaaaattttaaaaaataaaataaaaacatctccttagtgaagtcttctttgccccttgtaagcacaggaaatccccacaacaccttatagctgcttctgttctagctatttgtaacatttactaacggaagacttatccctgcacccccaggggtagcatagtgcctagtgcgtcggatgtggtcagaaactgcatgcttactgaatgagtgaaaagactcatagacatactgcctttcttagctccagcaatctgccatgaagtcctcatcatctttacctcaacccctgctagctctgcatgtctttttactttcagttgtcaattctaagtgacaagtgccaaggaggtgaaggtacaaatgaattggaagttgttaaaatgatattgttaagatgcagattctgattgagctggcttaagatgagatttttgcatttcttttttttttttttttttgagacggagtttcactcttgttgcccaggctggagtgcaatggcacgatctcggctcactgcaacctccgcctcctgggttcaagtgactctcctgcctgagcctcctgagtagctgggattatgggcatgtgccaccaagcctggctaattttttttttttttttgagacggagcctcgctctgttgcccaggctggggcgcagtggtgcgatctcaactcactgcaacctccacctcctgggatcacgccattctcctgcctcagcctcccgaggagctgggactacaggtgcctgccaccacacccgcctaattttttttatttttagtagagacagggtttcaccgtgttagccaggatggtctcgatctcctgacctcgtgatccgccctccttggcctcccaaagtgctgggattacaggtgcgagccactgtgcccggccgatttttgcatttctaataatgctcctaggtgacgcctgtgctgctggtccaggactttagcagcagggtgctatagcacttgagacagaactaacccaagtccaaaaccttttcaggtgattactgtactgagtggccagattttgtgcttcccatatcaaaatgtcagggttacagagtggaggttgttcacttatcatgggaatggcaatgttctgggctattctggagatatccaaagttataaggaaaagatgaagtagcacataggaagaagggaaagctcccatttggacagctgaagatgattgggaaataatggcaaaaacgaagtgttgcctggaattccctctttagttctagctgagccccaccatcttcaccgacagttggtttgtttttttttttagatggagtctcgctctgtcgcccaggctggagtgcagtggcacgatcttggctcactgaaaccgccgcctcccaggtttaagcgattctcctgcctcagcctccaagtagctgggatgacaggtgtgtgccaccatgcccagctaattagagatggggttttgccatgatgaccaggctggtttcaacctcctggtctcaagtgatccacccgcctcagcctcccaaggtgctgggcttacaggcatgagccaccgtaccggaccccttcacagaactttaaccaataaatttaacccacactaatctctctctctctgaaaagttttaaaagggtaccttatatttattgcttgttcttgaatcatttgtgtatattagtcttattgttcctaccatagtgttaattttgtgaaagttgggacaatggtttttttgttttgtttttttttgttttgttttttgagacagagtctcgcactgtcgcccaggctggagtgcagtggtgcgatctcggctcactgcaacctctccctcccaggttcaagcaattcttgtgcctcagccttccaagtagctaggattacaggtgccagccaccacacctggctaatttttgtattttagtacagataggatttcactatgttggccaggctggtctgaaactcctgagctctgatccacctgccttggcctcccaaagtgctggcattacaggtgtgagccaccgtgcccggccgggactatgttttatatgtgtgtgccgaacactctgagaagcagcacagacactcatttagatgggtttttgggtagtctaagtcagtgcttctcgaatgatctttgatgaagaaccaattttggcgggggggaaatatgtcattgactgataaagtctgttgatattgaggcaatatcaaattactataaacgtttcttttttttttttttttttgagatggagtctccctctgtcacccaggctagagagcagtggtgagatcttggttcactgcaacctctgcctcctgggttcaagcgattctcctgcctcagcctcccaagtagcagggattataggcgcgtgccaccacactctgctaatttttgtatttttagtagagatggagtttcaccatgttggtcaggctggtctccaactcctgacctcgtgatccgcctgccttggcctccccaagtgctgggattacagatgtgagccaccgcacccggcctactataaacgtttctaaactcctgtcagtttttgtgctatttcattgtggatcagttaccaacagtttatggaccaccagtgcactgagaagcattggcttccagacagacatattagcatttgaagataattctgggctagaagtaagaagtagtgatgtgggaacagagatctgtttggtaagaatggaataatacatagcagcaaaaagtagaaggcctctgtagctcagcctctcttaggctttctgtcctggaggcaaagaaagaggtttaccaagcagacatttccactgatccgggagaaagcctggcaggccacaatccggttcttccattgacagctgttcagctccacagcaagcatggtgtgtatcagggtctgaggaaatggaagacttgtatggatattcacaatcacttttagagatactagaaccttgaagttacattctgaaatggcatcctgcataattaatgtcaccagtgggcttacaagagatggggcatgtttccatcacagccaactgactctgggatcataaattggggaacaaaatacaaatttaataacttaaacagaaaactgggaccttcctttcctgactttaactgtttttttttttttttttttttctgagaaggttgtcccccaggctggagtgcagtggcacaatctcggctcactgcaacctccgcctctcgggttcaagtgattctgttgcctcagcctcccaagtagctgggattacaggcgcctgccaccacgcccggttaatttttgtatttttagtagaggcggggttttaccatgttggtgccaggctggtcttgaattcctgacctcaggtgatctgcctgcctcggcctcccaaagtgctgggattacaggcgtgagccaccgtgcccggccttctgtctttaactgtttttacccctaaaatgatttttatatgcctcaagcttatgactttcacatttctattgaaagtaactaaacacaaatataggcctctgcagttttcaatggtaaacttctagcagaagcaaattctacatgtcagaactcttcttgcatatgcaaatagagaccatttgcaacctaattctcacttttctctcagctaactattgtgacttccctttgtatacacctctacacccaggtttactcatgcttattctacgtttacttatgcttgagattgtcaacccaaccggctgcattttatctaattaattaattgtgtaattaattttttgaggcagggtcttgctctgtcgctcaggctggagtacagtggtgtgatctcagctcgctgcagccccaacctgccaggctcaagtgatcctcccacctcagcctcttgagtagctaggattacaggcacataccaccatgcctgactaattttatttctttttttgtagagacagggtctcactatattgcccaggctggtcttgaaatcctggactcaagggatactcccacctcagcctcccaaagtgctgggattacaggcgtgagcgaccatgcccagcccagctgcattttattttatttgtttgagacagagtcttgctctgtcacctaggctggagtgtagtggcgtgatctcagctcactgcaaccttcacctcccaggctgaagtgattttcatgcctcagcctcccgagtagctgggactactcagtgtggtaccactgcacctgtctaatttttttatttttagtagagatgaggtttcacccatgttggccagtctggtctcgaactcctgacctcaagtgatccacctgcctcggcctcccgaagtgttgggattacaggcataagccactgccccggccccagctgcatttcagattgcttacattcactgacctcaaagacctaattgctccccaaaactgtgtctgacccggtaatggacacatactgtcttctcactcagatagctcaggaggatataagactgttcctcagtgtcctcattcttctttgtaaacagctggtggaggatcctcttaatcacagggtaagtagcagtaccttccagagccaagcactgagctgcagcccagctatccacactgttacctgccacagttgggtgaaaaagagttcagaatggtgatgtgttttccccctagagaacagcctttggattgatacccaaggctgctaccccacctgatatctcacttccttgtgccccactcagtctagaaatacaatttcttatttaaaccatattgagaagaatcatattggctgggcacggtggctaacacctgtagtcctcacattttgggaggccaaggtgggcggatcacctaaggtcaggagttcaagaccagcctggccaacatggtaaaaccccatctctactaaaaatacaaaaatcagccaggcgtggtggcatgcgcctgtaatcccagctacttgggaagccgaggcaggagaattgcttgaacccaggaggcggaggttgcagtgtgagctgagatcccaccattgcactccagcctgggcaacgagagtgaaactctgtctcaaaaaaaaaaaaaaaaaaaaaaaaaatttagtccagctaccacttggtggcagtgtacctgttttgttaaagtacctagaaagagcaaattttctttttttccttttttttagagacagggtcttgctctgtcacccaggttggagtacagtggcaccattgtggcttattgcagcttcaaccccctgggctcaagctgactctgataagcatgtatatataggtctgcctcagcctcctaggtagctgggtctacaggagcacaccaccgcacctggctaattttaaaattttttatagagatggggtcttgttatgttgcccaggctggtttagaactcctatgctcaggtgatcctgtcgccttggcctcccaaagtgctgggattacaggtgtgagcgacagtgtctggtcctaattttcaaatggtctaacataaatctaaacccaatacagcagacattgcagagcatcacagtggagaggaaaggactgggaaagctgatagtgagatgtctatcccatatttccaggtcagaagtaacagggagttactcacccttcagaagggcagtctgcatgatgttccgggcaaggggattatgtgactgtatggcatattggcatattgctgctgccatccgcacatgggcattcttgtcacaaagagcagcctctagggcaggcagtagaacctccggcaagtcctggatggtcttgtctgtgatcaaaagagccaggtaagagagtactagcccctttgcttttctcacacacagcttccttcctacagccatgtggtggccaacctcagtcccagctgcagttgcttagtgctatgtaatataattacagtttagctgagcccttcagatgggcaggattttctgctcaaggtgttaaagctcacctgtgtgctggtatgccaattcccaatcctttatcatctggcctctaaacagctatatttaagccgaagaagaatgtttccagctaggctacagtgaactacaccattagttttagtgattaaaagcaaccaatttgccccatgagcccatatatatatatatatatatatatatatatatatatatatatatatatatatatatatttatttattttatatattttttgagacggagtcttgttctgtcacctgggctggagtgcagtggtgtgatctcagctcactgcaagctccgcctcctgggttcacaccattctcctgcctcagcctcccgagtagctgggactacaggcacccagctaatttttagtattcttagtagagatgggatttcaccgtgttagccaggatggtctcgatctcctgaccttgtgatccacctgcctcagcctcccaaagtgctgggattacagacgtgtgccaccgcccccagctgagcctttatatttgtaagaacaattatatttaggtagtgctttataatatagtgtttttacattatcttgttatctttcaaccttggttgaattaggcaaggtaggtatcattgtagagctcactagggagtcttttttggttcaactaaacagtaaggttcataagactgtcatgggccatgcatggcaccagaagaatatgggacaggagcatagtttgtcaacagggcagcagcatcaggcatccctgttggctggagtttttttgtttttgtttttgttttttttttgagatagagtttttgctctgttgcccaggctggagtacaatggcacaatcttggctcactgcaacttctgcttcctgggttcaggcgattcttctgcctcagccttccgagtatctgggactacaggcacctgtcaccacgcctggctaatttttgtatttttggtagagatgaggtttcaccatgttggccaggctggtcttgaacccttgacttcaggtgatccacctgccttggccttccaaagtgctggaattacaagtgtgagccaccacacctggctttggctgcagttcttgaggctgtcttgagcattccacagagtcttggggacagcacaggagcatgttgtttattcactgggtgaatttatgctttacaggaactaatatctcttataaaaactccatagacacaattctagggtccacaaagggcctgcctgttataagttacagtatccagggaggcccaaactatggtgtccctatcaagtatttatatttcacttatagctcttctcagtcccaatgtaatttatcaaacaggatttatatcataaccaatgttgcctataaagatagttcttatcaggtgtttaggggaacaggtgggcatttaactgaagttcaaattctcaagtaggaaggggaaaggtttgttatccctttgtctaccactagtctcattttatagataggtaatttgaagctcagagaggttagctgactgcccaaggagtggcacagctaagcccgtgaatcatattttaagattttgtcaggtgcggtggctcatgcctgtaatcccagcactttgggaggctgaggtgggtggatcacttgaggtcaggagttcaagaccagcctggccaacatggtgaaaccccatctctactaaaaatacaaaaaaatgagctgggcatggtggcacacgcctgtatgtagtcccagctactcgggagactagggcaggagaattgcttgaacctgggaggtggaggttgcagtgagcagagatcgcgccactgcactccagcctgggtgacagagcaagactctgtctcaaaaataaataaataaataaataaataaataaataaataaataaataaaataaaataaaaaagaatgggctcttggctgggcacagtggctcacgcctgtaatcccagcagtttgggaggttaaggtgggaggattacttgaggccaggagttcaagactagcctggtcaacatagcaagacacagtctctaccaaaaacaaaaacaaaaaagaatgggatcttcaaggtgggaaatgttaacttctctgcaggccactgagcaaacaaaaggtgatgaaatgtagttcaaaaattactggactagaagtctggaattttaatctcgtctctattgctgataagcatgtatatataggccagtctctaagtcttggtttccacatttgtaaaatgatctcagataagccctgggtccctaccagttcagatgttccatggctttatgagttgcttatgttctcaagcagttcagctttggctctcacctgagtctctctggctggtggcaatccggggccgttccaaagcagctgtggcacatgtggtgatagctttgatccgaacgtcatcatgcaggtctcccaagctctgaagcaggttctctactgtctcatggtgccactctatgactgagccgcagtgagggaaatgaaaagagaaccacctggttagggttagatattgtgctgcaggcaggtgacaagaagtctgcccttcacccagaataattcaagcaaaacattagctcagaagaataaagggcccagagatggggtctttagggagttatttctctgatgatccatgtaccctcacaagtaagttcccagacaaaacttctcccaaccccatcgtatctatctctctttctttaaatcacttttcgttgtaaccatctgggaaataaaagtgacaataaaacaaagtagttaagagtactttgttttcagacatacctggtttgggatcacagttattagctgtgtgactgtggataagttacttaaccctgagcctgagatttcttatttgtaatacaggcataatactagaacccacatattgagttattcttactgttaaatgagttaactagacaaagtgtttagcaaaatgcctggcaagataatgaaggttcaataaatgttaactattgtggttttcattaggttctttgtctttgagggcacttccatttggctttcaacatcttcctcattttagttgctaaatactcttttggcaggtatcagacttttatttcaaagctcctattatctgtaggtgtttccttcagtcttttttgttattgtttatctgatccagtttacctaatggattgcctctctttttcctgcactaactaagcttgtctatcatgttctgaaagccagcagctattgagttctcaaataccatagctttcaacagtccttgccaggccattactttgtcccaggcactcagacttctactctcctatctttgaaggcaaagtaggtataggatagccccaactctacgaatgaattttggagaggggttgctgataccatagtcaactatgacatggacaatggttggacagcatattttgttcttcccttcatacatcatttgctgagcataaagtttggaaaacaataagatagggtcgcctgggtgcagtggcttatgcttgtaatcccagcactttgggaggccaaggcggggagatcacctgaagtcaggagttcgagaccagcctggccaacatggtgaaaccgtgtctctactaaaaacacaaaaattagccagacatcatggcacatgcctatagtcccagctacttgggaggctgaggcaggagaatcgcttgaacctgggaggtagaggttgcagtgagcccaaatcaagtgccatggcactccggcctgggcaacagagtgaaattccatctcagaaaaagaaaaaagggctggcgcggtggccaaggcgggcagatcacctgaggtcaggagtttgagaccactctggccaacatggtgaaaccccatctctaccaaagatacaaaaagttaaccaagtgtggtggcgggtgcctgtaatcctagctactcaggaggctgaggcaggagaattacttgaaaccaggaagcagaggttgcagtaagctgagatcccaccgttgcactccagccaaggcaacaagagcgaaactacgtctccaaaaaaaaaaaaaaaaaaaaaaaaaaaaatggtctctgcctctgaagagtctgcagtgtaataatgagtttccacaaattactgaagtaatacccatccatgcaaaaagcacccagatatatgttaactgaagttcatctaacacccaatgtgtgaaaggctcttgtctagccttaatgaggcaaccagatttttacatttcacaaaggagggatggatttttcaaagactgagaaagcctagtcccagatgagaaccacttctcacaaacgtacagtatcacaggacctcccttcactcactcagagcccaggcagtcttccattccttcagcatcctccgcaggaccaccagttcccaggtcacatcctcctgcagtgattttgcctgcttcttcaatctcctggtcttaataggcacatccttctcacccacctgcagcagcatatccttggcgggggtgggcaaagcagtccagcgcagggctccttgcacaggtctgtaagctgtgcaacgtggcagtgtgaggtcttttcaccccactgccttaggccctgccacacagtggccccagcttgcatcccattcctattcctgactaataccaaagcaaaacaaaaccctcaagagtgaatttccccatgattatatggggaactgagtacatgtacacagggaattatggaaagtcctgactagacatggtaagccatgatgatgatgggggtgagagatttgtggggggaaattgagatatctacaaacctttctataagtttaaaggttatctttaggaacctaaatctttaggaacataaatatgtttatatgtaacgagatttgctcataatatttgatacgttgcaatttagtgtcattggccattatttctaaagtattaagttttccttttaatgtttttaatttggggagaataatagtgctataagctgtgaaattttaaagattttaacatctctgagtttttcctcaagacaacagaaatttgagaacagaagaagccgtaaatattagatatagttagaaaagctatagttggccgggtacggtggcttttgcctgtaatcccagtactttgggaggccgaggcgagcagatcacgaggtcaggagatcgagaccatcctggctaacacggtgaaaaccccgtctctactaaaatacaaaaaattggccgggcatggtggcatgtgcttgtagtctcagctacttgagaggctgaggcaggagaatcacttgaacctgagaggcggaggttgcagtgagctgagattgcaccactgcattccagcctggacgacagagtgagactccgttctcaaaaaaaaaaaacaaaaaaaaaactatagttatattttctgaacttaatgtttttcatggtgtcaaatttagaaagcctctttctcagaaaaaaagctctatggagaaggggaagggaaaaatgataaaaacatttccagatgtactaaattcattattcacactgcctattagtctcatgttctaatcagtcactatcagccatttctgtttttttccaagatttcattctgactcttaacacctttagatttgctctgaatcaattctttcctttgagcaaggaagacataacatttctttcttctaatgtaaaaagagtcctgtgaggcggggtgcagtggctcatgcctgtaatcccagcactttgggaggccaaagcgggtggatcacttgaggtcacaagttcgagaccagcctgaccaacatggtgaaaccctgtctctactaaaaatacaaaaatttgctaggcgtggtggtgggcgcctgtaatcccagctactcgggatgctgaagcagaagaatcacttgaactggggaggcggaggttgtagtgagctgagatcgcgctccaacctgggtgacaaagcgagactccatctcaaaaaaaaaaaaaaaaaaaaaaaaaaagagtcctgtgagactccagggcagtttagcaaagatgcccatacaatgcatctcctccaaatggtccccaccagcttggacgtgctgggggactcagccactctgctgaggcctccctcctttctggggtagggtgtgtgcaactaggagctgtggaaccacctctgacaggccagctcacactttgccatgtgacgctccccgacttctctcaggcgatttgaaatccctcctgaagagatgagaagtagctgaattaaccccatttctcctatatccctctgctcaaggagttaaaatggatttgcggtgagcaagtcttagatctctgatatttaacctcataggaataaaaaatacaactgccaacttttactttggttccagtcctttgggttatagctggatagaaacacatccactagccatcttccacatcaacagtcatcaaaaaaaaaaaaaaaaaaaaaaaaaagagtcctgtgagactccagggcagtttagcaaagatgcccatacaatgcatctcctccaaatggtccccaccagcttggacgtgctgggggactcagccactctgctgaggcctccctcctttctggggtagggtgtgtgcaactaggagctgtggaaccacctctgacaggccagctcacactttgccatgtgacgctccccgacttctctcaggcgatttgaaatccctcctgaagagatgagaagtagctgaattaaccccatttctcctatatccctctgctcaaggagttaaaatggatttgcggtgagcaagtcttagatctctgatatttaacctcataggaataaaaaatacaactgccaacttttactttggttccagtcctttgggttatagctggatagaaacacatccactagccatcttccacatcaacagtcatctaaagctggggtccctaacccccaggccatgggcctgtaccagttcatggcctgttaggaaccgggccaccacaacaggatgtgagtggtgggtgggcaagcattaccagtgagctctgcctcctgtcagatcagcagtggcattagagtcacgtagcatgaaccttactgtgaactgcacatgtgaggggtctaggctgcgcaccctttatgataatctaatgcctgatgatctgaggtggaaccatttcatcctcaaaccatccccaccccgctggtctgtggaaaaattatcttccacgaaaccggtccctggtgccaaaaaggttgaggactgccgatctaaagggagcacacaaagtaatgactcttggcagggtacagtggctcatgcctataatcccagcactttgtttgggaggctaaggtgggaggaccccttgtggccaggagttcgagaccagtctgggcaacatagtgagaccctatctctaaaaaagttaaaaattagctgagtgtagggtgcacacctgtggccctgatcctcctgcatcagcctcgcgagtggctgggactccaggtgcgtgccaccatgcccaactaagttttgtatttttttgtagagacggggtctcaccttgttgcctagactagtctgaaactgctaggctcaagcgatctgcctgcctcatcaaattgtatggtttaacaggattaattttatagtatgtaaattcaagctcaataaagctgttattgaaaaagaatcctctggctgggagagtggctcatgcctgtagttccaacactttgggagtctgaagagggtgcatcacttgagcccagaagtttgagaccagcctgggcaacacagcaagaccttgtctttacaaaaattagctgggtatagtggtgtgcacctgtagttccagctactcgggagagtgaggtggaaggattgcttgagctcaggaaggtaaaggctgcagtgagccatgattgtaccactgtgctcagcctgggaaacagagtgagaccctgtcaaaaaaaaaaaaaaaagaagaagaaaagagagagagggaaggggaggggaagggggaagagaggaaagggagacatgaaggaaggaaagggagaaggaaaggaaggaaaaaaaggaagggaggaaggagaaaagaaaaagaggctggacacggtggctcacgcctgtaatcccagcactttgggaggccgaggtggacagatcacgaggtcaagagatcaagaccatcctggccaacatggtgaaccccgtctctactaaaaatacaaaaattagctgggtgtggtggcgcgcacctgtagtcccagctactcgtgaggcagaggcaggagaatcacttgaacccaggaggcggaggttgcagtgagccgagatcacgccaccgcactccagcctgggcgacagagcgagactttatctcaaaaacaaagccaggttgtgtggaaatcctgtggctgtccacagctgtctggcgggtgcctccacagcaggcacagaatgtgcctgtgcctccaaggatagactgagcccagggaaggacttcttgccaagtggatgcaaaggcacaactagcaggccaggcaaccctgtcagccaggtgtggaggcatgcacctgtgattccagctaccctggaggctgaggcaggggaattgcttgaaccaggaagatggaggttgcagtgagcagagatcacgccactgcactccagcctgggtgacagagcaagactctgtctccaaaaaaagaaaaaaaaaaaaaaggaatgggtgacaactgctgttagtttctgcacaccactgggcccatctgaacagtaatcctacaaagagtcatgggaaatagagtcttgtggaagatgtgcacattttgtttcataagctaatttcttggtcaccttctttccctctttgtcttacagagtgaagaatgatgaacttgtgaaagttcaggtatgggtgggctgagtgtggagtgggagggtagagccagcccaagggaaaagggcagaatgctgggtcaggagtttgatgcactttccctgttaggtgcactttccctgttagcattgagataggagctgccttattggtaactagtggccctaaaccacttggttatacctaagttatatcagatctcaagtgattgtatgttcctgtgaggctcttcctagttatagttagtattttataattttgtgagattatttttagtacgtagaaaggggattgcctagatgctaatggtgcttcagcccatgaactgggagctctagcacatgaatagtgggtaatgatgggaagtagccacattcccgttattaacccctgccttccctgttagcttcctgcttacatgcttcaggaattgcctgggcactccacttttctggagtttcagggaagaccttagatagctgcttgttgtaccgatttaggttttccaggacaatctggtctctctttgcaccaatctggtggatgatctggacttcatctgtgaacagacaaagaaacaatgagtcccctataacctccctatttcctttctccctgggttcctaatcaccaggatcagacccaacttccttttgccctaatctaagcccctaggatccatgactgccatactctggggcatcccttgaaggtgaccattgcttagaaatatcacagtgataaatcactatagtgtctgtgggggaaaaaaaaaagaaaaaggaaatgtcatagctagtcacctcattagaggcctgggagccaaggatggtgatttccttcctaaggcagaacctatggccgggtgtggtggctcacacctgtaatctcagcactttgggaggccgaggtgggtggatcacatcatcaggagttcgagaccagcctgggcaacactgtaagacccccgtctctacaaaaaatacaaaaattagctgggtacagctactcgggaggctgaggcaggagaatcagttgagcctgggaggtggaggttgcagtgaagatagcaccactgcactccagcctaggcaatgggagtgaaaccatttcaaaaataagaaaagaaccggctgggcaccatggctcacgcctgtaatcccagcactttgggaggctaaggagggcggatcacaaggtcaagagattgtgaccatcctggccaacatggtgaaaccctgtctctactagaaatacaaaaattagctgggcgtggtgatgcgcgcctataatcccagctatttgggaggtggaggcagaggttgcagtgagccaagattgtgtcactgcactccagcctggcgacagagcaagactccgtctcaatagaaaagaaaacaaaagaaaagaacctatgtaaccacttagaggccttatcccttataaaaagctagatactaaaaaagaggcacctaattaatctcatcagtcatgaatacttagagtaattttgttaaacactttgagaagactttcagctgcagcagtttaggaacaagatggggcttgggaagaagaaacagcttggaacacgaagacctagattgagtatcctggaagcccaggcatctaagggacagcagtagggacagggaaggtggcaaacatttactgaacaccttaaacagacattgagcaagaagcattacagatgctttctcatctactctactcaaagtgcatttttgttaacatcacttcacaaataaggtacttgtggctcagaggaattatataatttactgaaggttactaaaaaaatactgagccaggatttaaacccaaatgtgcctgactccaaagccctgattttttccaacatagcaccttggtgggagaatatctcgaagtgggagaatatctcgaagtgagagaagggagaagggtagatagagaagagatggattgttcccaaagtcttgccaactttacagttccacccttcattgcctctttagtaagatagagggatagagaaagcggggagagagagcagttccctccctattagttatcactccccgacccaactcctgtgctagtgtgggtgctgggtcatgaacatgaaaacctgggtcatccagggcctcttgtccatacccacaactgtttccagcccccagcaatcttccaccttcctggcccatgtccccgtgtgcccctaccacaggggcccagctctattaccaaagtaaatctcctgttcaaaggtgttgtctgtggagtaggcaaactttccagctcggggagtcacctggcgaaagtagctctgggtttggggctgggagaggctcgtcttttcatggatatcctcagtgctcttgttgccaggcatgatctcaactgtctctgcttgttggaagtaactgggcaatcttggcaggggtgagaaaggagggaaaagggggaaagagtaggaggtggatccccctttccattaaatccacagctcgttccctttcctctttaagctcagctcctatacacgtgagcattgcagaacaccaatgtttaacttttagccttgtccccatggtgccagttgaatgtggagctgccagaagggcctgtctacagctgtcctgcctggctactaaaggatccatgccttctgcagccaccaagcagcagggcagagtggcggtgctccagcataacccttttttaacattcgtactcttagaggcggcatggccttggggaagggatcccacctccttcgtcatctcactctgtctattctgtgtgtggttatttaatgtccatccacctggtggtggacaggctgtaagctccttaaaggtacatatctgtgtctgttgcttttacattgtattcccagcactttgcagagtgcctggaaagtagcaagaacataatttatatttgtccaataaatgaataaataaatggatttccactgatttttagttcactcttggaaatcagggatagtgtaatagctccagtcttccctctagctataaatgagatagaagcaatctaagaaacatgtagtcatcttcttctctcaggttgtctggttctctgtcctgcagctagtcagtttttgagtcagtgacacactggttccttattcagagtaaggcaggaccaaacctcggtgctatgaggttcctgccttcctcactccaccaaggatacatttctgggagcacctggttggtaactacaccagcagtctgatggcaaagtctgctggagaaggttgagaaccaatccctttaagagcagtggttcccagctgggaatgactttgttcctcttggagacatctggcagtgtctgagacatctttggttttcacagctaggagtttgtgctctggtgggtatgagccagggatgctgcttgcatcccataatgaacagggcagctcccacaacaaaaattatccaacccagaatgtcagcagtgcaaattgagaaaccttactttgcagagctctcagagagcaggccggtggtggagaacatgaagttgatgggagagtgcattctgaaatcgggagtgtgagtccacctgggagtccctaaaggggagtcagggattatcaaaggtgcacttgaggccctggccagtatacctgtagtaaacgggaagcagcagttctggcttcttcttttcctgtgggggcaggatgacactttgatcctcaaactctgctgtctcttctgcctccagctgtttcaggagctccaggtcactggcagaggtaagctcatcccgaatgtgactccagtcgtactgctggcgcaggaagctctgccacttgttgggggatgccccaggccttcgaggacgcttgctctggatccatcgggctgtgcgctcgttcagcttttccagcacagtggcctcccacgctctggcctccttctcaggaggcagaagccaggcttctctttcctccaggttcacatctagagaaggtggccgacccagcatatctggatgcatgcagggatgatggatgagagggcggggtgcttcccggacggtgctggctggctttgatttcttcagcttcttttcgggattggcagagctttctgtcttcacagccagggaggtgtctcctgttaagggacttgaggaacccaggaacttgaagctaacaggtttctgaggccgggccttcctgatctggggagtatggatgatgtcattggtattgtagaggtggtcaaagctgtactggctataaggaatgctgggcaggcctcgctgccacaccacctcctgagagaaggtaaggtttgcagcagccattttcaaatattggctcttgcggtgtagacggtactgtgagctgaagaagaccataggcacactggagacagaggcacactcctccttgcctttcaattttgagtagtttaaaatcatgccccatcccagtcgtgggggcagtgactgatagaagcaatgggggagaaaggtctttcccttctgggtcctggtcataccgcgtcccagcaaatgcttccttccacactgcctggcctagaggaaaggcctggagatgagacctggcacctgttaagggaatgggaggaactgatgagaactctagagcagcagaaattggtagcccatagcagttcagaaagagaataacttgaaaaacagatggaaagggggtggggaagagccatgtgagttagaagaacaaaagaagaaaatggtgcaacatcctaaatatttcatgtatcagacccgtgtttttggttcttatacttgttcccaaagctcagaccctcatctccgtgtgagggatgactgcttttcagcagtatcccatgcttccagtttgtctttaaatgttgctttctttcattcaaaaggcttatagtgtaaagttcagactattcagcatggcattcagggttctccatgagtttggcctcagtttatgactttgtcctggcatgtaacctctgcttgagccagtccagtctcctggctgttctctgagtatcctctctccacataatgaagcttccttctgtgtcctctacatgaaatggcctttcgtacttgacacaaattctatccaatttccaggcccagctcaatttgtgctgctccataactctttcttgacctatccaggccaccaggtcatacccaagtttataaattcctcctggtctgtaccacttactttaactgttaatcctatgatacctcgcattgttaaatatttgagactctaattccattgcccagtgaccatgtctcccatttcttctgtctttcagagtcatccagcacacctattgctacatagtttttattgttaaaatatttaatagctgtaggccgggcgcagtggctcacgcctgtaatcccagcactttgggaggccgaggtgggtgggtcacctgaggtctggagtttgagaccagcctggccaacatggtgaaatcccatctctactaaaaatacaaaaaattagccaggcgcggtggcatgtgcctgtaatcccagctacttgggagattgaggcaggagaattgcttgaacccagggtgggggagattgcagtgagccaagatcatgccattgcacaccagcctgggcaacaagagcaaaactccgtctcaaaaaaaaaaaaaaaaaatatatatatatatatatatatatattatagctgtaacgtattttatcaaataggtaaatggttttgactcttcatgaattattggatgggttgtttccagattttagctagcatggcaaacactgtagataacaaatgcttagatttaatgttagtttagttttgttttgttttccttttgaagcattcccttggcctaataatgatagttttggaataaccttgctgaggattttacgtagggaagatattatgatcttcctttcctattttaagaagctgaggttcagagaggtaggtaaattgcttcagatcacatagcccgtaagcagaggagtcaggtttcaaatctagcctactagatcacaactctggagcacttaacctccgtgccacactggccttggcccaagcaccactccctaccactcactttgttggccttgcctctccaaggaacaggtaggcctccttatgtgtaaggatgaaggagagaccattattccatatgtttctatcctgctagtgtcaactcctgcccggtgtccaaggtgcccatgcagaccagatctgacttgtttctctttactccttaacacccagcacatagcctctctccctagggcatgatttctcttactgtcttccatgtgtaaaagtgaccgtattgtatttctttctgttaagggcaagttcttttttgtgtgttttttttcttttgttttgtttttttgagacagggtcttgttctgtcgcccaggctggagtgcagcactggcacgatcatagctcactgcagcctcaacctcctgggcccaagtaatcctcctacttcagcctcccaagtagctgggactacaggtgcatgcgccaccacacccagctatctgttttttatttttaatagagatggggtctcactatgttgcccaggctggtctcaaactcctggggtcaacaatctgcctgccttggcttctcaaagcgttgggattacaggtgtgagctacagcactcagcaaaggctcaactttcatctagatgccattaggccagaatcaataacctccctcaaattacgtgacacatgattaatatgctatcactccaggactttttgcacataaggctaaatgtaattgcttcatctcttcacaaccatgaaggcaacgtcttcatgaaggcaagttaagagaaagagggtggtcacaagatgatgttttctcctgaaacagtggctactcccactggctgaaaatagaaaggctagagcaagacggccaaacagacccctccagcgattgtctccatgcaggaacaccaaactgaacaactgtccccacaaggaaagcacctttaggccggatgcggtggctcacgtcagtaatcccagaactttgggaggctaaattgggcaaatcacttgaagtcaagagttcaagactggcctggccaacatggagaaaccccatctctactaaaaatacaaaaattagctgggcgtggtggtgggggcctataatcccagctacttgggaggctgaggcagaagaattgcttgaacctgggaagcagaggttgcagtgagacgaaatggtgccactgcgctccagcctgggtgacagagtgagactccttatttaaaaaaaaaaaaaaagcatcttcataagaaacaaaaaatcaggtgagtgatcacagtacctggttttcacatcgtatcaagaagaggcactgaagagggtgggaaagacggtcctgcatcgcctatgcccccctccctcacctctggcacaacagcttggagagagaatctgtgcatgtggtggagcgagaggagtgtgggattttgcattggaactcactgctgccctgtcacagcacagcactacactgagcagaattctgctggcacccacagaggacacatttagatcagctctgggccagaggagaatcctcaggtagagtgggacagacctgagtcccagctggttctgccaccagctgaccaaagtggcctggggccctgaatacatatgagtgacagtcaggtcacaaggactatattccttaggcaaaccctggagatgcactggtcatggaggcagtggactttgggtgtgtgtgaccgcgtgtgacaccaactgtggtgaacaagggagtgcctgcatcattcctcccccaactccagacagggcagctcagggagagactcctacttggggaaaggagagggaagagtactcaagttgcaagacaaagtccagaagactttgagtagcagctcagccacaggaaaataaagcaccaggcagaatcctgaggctcctgattccaggcctttgctcctaagctacatttccagacctaccctgcgccagaagggaatccactgctctgatgggtcagatttatcctggcaggattccccacctgctgactaaagtgcccttgggctttgagtaaatatcagtggtagctaagcagttctggccacaggccttgggcaggatccaatactgtactggtctgcaaagcttcaggtgtgacccagtgcactgccatctgtggtggccatgggagtgctcatgtcacccttccccccaactccagacagcccagtggggagagagattcctgactgggggaaagagaagagacaaagtgagagatgttgcctgggtaaccggggaattttcccttatcttacccaaggccaccaaagatacaggagtatccaggagttggcaacagttgcaggggtcataggcttagggcaccccctggtatacatcagctgcagagaccgtaggcttaagtcacagcacttaatcccctttgaatatatagaaagccttctcaaggaggatgggtacaaataagtccagactgtaaagacttggaataaatacctaactcttcaatgtccagacattgatgaccatccacaagcatcaagaacatccaggaaaacattatttcaccaaatggactaaataaggcaccagtgaccaatccaggagtgacagagatatgtgacctttccagacagggaattcaaaatagtagtcttgaagaagctcaaacttcgagataacaccgagaagaaattcagaattctatcagaaatttcaaaaagagattgaaataacaaaaatcaagcagaaaggctgctctgcctatggagtagccattcttttgtttctttacttctctaataaacttgctttcacttcgcaaaagaaaaaaaatcaagcatcacttctagagctgaaaaattaagttgactaaaaaatgcattggagtctctcaacagcagaattggtcaagcagaagaaagaattggtgagcttgaagacaggttatatgaaaatacacagtcagggccaggcaggatggctcatgcctgtaatcctagcactttgggaggccaaggcaggtggatcacctgagatcaggggttcgagaccagcccggccaacatggcgaaaccccatctctactacaaatacaaaaaattagccagtcatggtggcaggtgcctgtaatcccagctacttgggaggctgaggcaggagagttccttgaacctgacaggcagaggttgccaccgtactccagcctgggtaacaggggcaaaactccatctcaaaaaaaaaaaaaaaaaaaaaaaaggagtgatttaggatgtccccagataaatgccctttagcctgtgacgtaaagaatctttagttacaatgcaaacatcccagaaagaataccatattaccattatcaattattagaaattcttaaggaggctatgcgcggtggctcatgcctgtaatcccaacactttgggaggctgaggtgggcagatcacctgaggtcaggagtttgaaatcagtctggccaacatggcgaagccccatctctactaaaaatacaaaaaattagcgggtgtggtggtgggcatccgtaatcccagctactcaggaggctgaggcagaatcgcttgaagctgggaggcggaggttgcagtgagccaagatcgcgccactggactccagcctggacgacaagagcgaaacttcatctcaaaaaaaaaaaaaaaaaaaaaacttaaggaatagttattatctgatatgatggcttattaagaaggaagggaacacatgataggtctgttttgaaaaggaatggggacagaacaaaatattactaggtctgatcaaaagaggcttgttctggcttgtctttgtctgccttggagtcacgggacaggtgtaaggccaaattgtgcacttcccagtcatgttaccttgggcaaataatttaaaatctgtagtttcccaatctgaaaattgagtctgatacctgttctaatttagtgttgattgatatgaagctcaaaatcagaaacatgtatgaaagttctttgcaaactaaaatatatgtgtgaggaattgttattattagtttagaggatggactgttgtccttagaaggcaagtctctgggtcctacagttagatgcactgagcgcttcgggaagaatttagggctatggggtactcagcaattaaaagagagggtgcttagagaaggaagaaaggacttattaatggagtttggaggctccttattattgaaacttacacattacgtgaccagcattatgaggcagcacccacttccaacaaatagccctctagaaccaaaagcagagtggcaggtcctgggtccttttgtacacagcataaaaaattaagtcaatcggccaggcgtggtggatcatgcgtgtaatcccagcactttgggaggctgaggcgtgtggatcatctgaggttaggagttcaagaccagcttgaccaacatggtgaaactccgtctctactaaaaatacaaaaaattagccaggcgcagtggtacatgtctgtaatcccagctacttgggaggctaagacaggagaattgcttgaacccaggagtcggaggttgcagtgagccaagctcgtgccactgcactccagcctgggcaacagagtgagactctgtctcaaaaaaaaaaaaaaaaaaaaaaattaagtcaatcctggcataactgcagaccaggccctggaatgagcaacccaccagcattatctgcatttctaggaacttgggctagaaggggaggaatggggttggaagggttaggctacatgcctctagttaaaacctgatgaacttcctagatccccaactagaaaatgtaggagttggactaaattcctctcctgcctctaatattttatgaatacagaactcaactcaaaatgggtagtatctcagagattccaaatttagttctacttttctgtttgcttatcagtcgcttaccctcaccctctggtctgatacctttatcctgtacaagtggtcaaagtaggttgagtaacgtgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaactttttttgtagagacagggtcttactatgttgtccaggctggtttcaaactcctggaatcaagcgatcttcctgccttggcctccagaaatgctgggactgcgcctggaatagatacgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaatttctcaccatgcactcacacagctatacagctgtctccagagattactctggaaactctgctataaagatgacctggtctaatgccttgatttgttttttgtttgtttgtttttttgagacagggtctcactctcctggagtacagtggcgtgatcatggctcactgcagccttgacctcctgggctcaagcaatcctcccacatagctgggagcataggcacatagcacaccactctcggttaaatttttttttttttttttttttttttgtagagatagagtctcaccatgttgttcaggctggtcttgaactcctggactcaaacgatcctcccaccttggcctcccaaaatgctaggaatacaggcatgagccactgcaccaggcctaatgtcctgattttataaatcccaaaactggggcccagagaggagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctacaaggcagtcctcagagagaagcaaggttctgcatcttaaaccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctgtgagaaattgcatcttatttattgattatttattgaatggtagtttcatggagtttttcgtctttttttttttttttgcgagggagtctcactctgtcgcccaggctggagtgcagtggtgtgatcttggctcactgcaacctctgcctcccaggttcaagcaattctcctgtctcagcctcccattacaggccacaccaccacgccccactaattgttgtacttttagtagagatggggtttcaccatattggccaggctgttctcgaactcctgacctcaagtgatgcacctgccttggcctcccaaagtgctgggatttgcaactgtgagccaccacacccagcctcttggtcattctttgaaaaataaacctcagccaggcgcaatggctgacacctgtaatcccagcaacttgggaggctgaggtggcggatcacctgaggtcaggagttcgagaccagcctgaccaacatggtgaaaccccatctctactaaaaatagaaaatttaaaaagaaaatcagctgggcctggtggcgcatgcctgtaatcccagctacttgggaggctgaggcaggagaatcgcctggacccaggaagcagaggttgcagtgagccaagatcaggccattgcactccagcctgggcagcaagagtgaagtgcagtctcaaaaaataaaaataaaaaaaccctctagatgtatgcggctccatattctcccaccacaagggtttataaatcctgagaaagaggcaaagcagggaacacatgaccacatagctctggcaggcgtcagattaccaggctgataaaacagatggtaaagtagaagctgtccgttgacttttccattcccctttcagctcctccactgctacttaatctcctttgcccacacagttcaatcctattttccctgatctccaaatcctggctagattattagccattaacactagcttttacaaggagactcttcaatcttgtatttctagtagtataatttcacacgtacagaaattctttaagtcatagaagtcttacagatacagaaattctgatcttcaggagtcctgttgtgaaacaaactaatttatcctgacagcaggaaagatttctgggcctaaggctctgtctcgttgacccagctcatgctattcaggtggtccatctcttggttccaggcaagactgctgctgctgaccaacctgaatatggactttagcacttgggctcaagctgcactcagatggttggaccaccataaaagagcgagagggtacgtttttggtatgaaaagtaaagactaggccgggtgcagtggctcacgctcataatcctagcactttgggaggccaaggtgggcagatcacaaggtcaggagattgaaaccatcctagctaacacagtaaaaccccatctctactaaaacatacaaaaaaattagccgggtgtggtggtgggcacctgtagtcccagctacttggaggctgaggcaggagaatggcgtgaacccaggtggtggagctttcagtgagccaagattgggccactgcactccagcctgggtgacagagcaagactccatctcaaaaaaataaataaataaataaaaagaaaagaaaagtaaagactaaaaaaattaaatattataaccctgctaaggcaggaggatcctttgagcccaggagtttgaggctgcagtgagctatgatggcactactgcaacccagcctcagtgacagagggagaccctgtttctaataaaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggccaggcgtggtggctcaggcctgtaatcccagcactttgggaggccgaggagggtagatcacctgaggtcagaagttcaagaccagcctggtcaacatggtggaaccccatctctactaaaaatacaaaaattagctgggtgtcctggtacgcgcctgtagtcccagctacctgggaggctgaggcaggagaatcacttgatcccaggagacggaggtttcagtgagctgagaccgcgccactgcactccagcctggggggacagagcaagactccaaaagttctggaaatggataatggtgatagttgtacaacaatgtaatgtacttaatgtcactgacttgtacacttaaaaatggttaaaatgggcttgttccagcagctcatgcgtgtaattctagcgctttgagaggccaaggcaggatgatcacttgaggccagagttcgagaccagtctgggcaacatagcaagaccctgtctctaaaaaaaaaaaaaaaaaaaaaaggttaaaatgaggccatgcatgcctacaatcccagcactttgggaagatgaggtggtagggtcacttgtttgggaagaggaggtgggaggatcctttgaacccaggagttcaaggctgcaatgaaccatcatggtgccattgcactccagcctgggtgacagagcaagacctagtctctaaaaaataagagttaaggccagacacggtggctcatgcctctagtcccagcactttgggaggctgaagcaggcagattacaaggtcaggagtttgagaccagcctggccaacatggtgaaacctcgtctttactaaaaatacaaaaatcagctggccgtggtggcatgtgactgtaatcccagctactcaagaggctgaggcaggtgaatcactggaacccgggagccagaagttgcagtgagccgagatcagaccactgcactccagcctgggcgacagagcaagactctgtcttgaaaaaaaaaaaagaattaaaaaaagaaacatggccgagtgtagtggctcttgcctataatcccaacactcagggaggccaaggtgggaggattgcttaagcccaggagttcgagaccaggcaacatagggagaccccatctgtacaaataatctaaaaagttagccaggtgtggtggtgcatgcctgtggtcccaggtgctcgggaggctgaggtgggagaactgtctaagcctgggaggttgaggctgcagtgagctatgatcgcaccactgcactccagcctgggtaacacagtgagacaccccgtcttaaaaaacaaacaagcaaataaacaaatactatgcataaaacctcaaggctcaagaaacaacagtttgaaatagttagatgtgtgttttttttaattttcatgtcttatcttttctgcttttttttttttttttaagggatgaggtcttgctctgttgcccaagctggtatcgaattcctcctgggctcaagcaatctcctgcctaggcctcccccctaacagctggaactacaggcatctaccactgcattcagctactgggggagtgtttgactagtctttttaaaaaatatgttaatatcttggtaaaaagtatatttatactgttctctaacctgctttttttcatcagtttcatggaagaatgctcatcatatattcttctgctttataactaaactgctttcatttatgacatcacaattaaactggtaaaaccaaatttatattgctaacttgtttctaattttttctctattaaaatgatatgattagcatccttgtagccaaatatttacacatatttatgaagttatacttaaaacaaattcctagacgtggaactgtgagtcaaagagaagggatcttttaaatatttttgcatagattgccatgaaaaggtcataccagtttatatatccaccaatatgagtttcttttccaaatcttcttcaacatcctgtgagagacagttaaacatagttgttcagagcccagccttgagaatcagatttcaaacatatgaaccctctccctttttcttttctttttcttctttcttttttttttttttttttttttttttttttttttttttgcccaggctggagtgcagtggcgccatcttggctcactgcaagcactgcctccagggttcacgccattctcctgccccagcctcccgagtagctgggactacaggcgcctgccaccacgcccggcgaattttttgtatttttggtttttttttagtagagacggagtttcactgtgttagccaggatggtgtcgatctgctgacctcgtgatccacccgcctcggcctcccaaagtgctgggattacaggcgcgagccaccgcgcctggcccctttttcttgttagagacagggtcttatccaggttggtctgaaactcctggccttaagaaaccctgccacctcagcctccaagtaaactgggattataggcgtgagccacctcacccaacttccacttcccagctgtatgatcttcagaaaatcagttaaattctctgggccttaatttactactacggttcttgtaagtattaacaattagctactattatttaccttctttagttcctgagacttctatgcacagaatatacttgatgtgtgccacagaacctatacaaaggtaattacaactaacagggagttgtatgataatgacatgggacatgggacatgagagcatttggaaagagataaaaaggcttaccttgaggacagccttattaggagcagaggcaaacacaggttttgtgagtttgaagcttacgcatttataggtttctctaattaccaagataggaaattatgaaatcaggtacaagggcttgggaggggcctaaagcttaagtttgatgaaaaaaaaaaaccacctctggttggaaccaatagcctatgaaaaagtagaaaaaagcccaatgcatggggagcgccggtagtcccttgaggtgtttgagaggctgaggcaggaagatggctttagcccaggagtttgaggcttgtaagtgcgcagtgatggtaaaccgccgctgtactccagactggcaacgtagtgagaccctgtctctttaaaaaaaaaaaaaaaaaaaaaaaaagatgagaggtaacacttgcctgactgggacaaaaatgagaaaccagtataagaaaataataactattggccgggcgcggtggctcatcgcctgtaaatcccagcactttgggaggccgaggcgggcggatcacaaagtcaggagttcgagaaattaataactattacctcatttggctatttttacacctgtaaggaataaagctcagaggtcacacagctagtaagaagccagcacccttcgatgtgggagtgatgtggaggataggcatatacagagaacacgaaagcaaaacaccatggtgcagattttgaaagaaaagccctaagattagtaatgagtgtgaattattcaacaaagtgatcaaaaccaactccagtcctgcattcctcttcgccatcaggagtttggagcctggagactgctagctgcctggttgttgttgtttttttttttttctgagacggactttcgctctgtcgcccaggctgtagtgcagtggcatgatcttggccaactgcaagctccaccccccgggatcacgccattctcctgcctcagcctcccgagtagccgggacgaaccagtcctggcccagcccattccgcgagccagcaagcttctgaaaagcaaacctaggaagttgctttccaacataaagtggaggtttcaacacaggagactttaagcaagttccagtgtgtctatatttggtctggctgatcggctggactctggccttccccgctcacattagcagacagctctgccctagtgggcgtttagcctgcgacggcagcccgagaggaagagttgggcagagttgcaggggtctccacagctgaggcagtttggccggattatttgggttcctgctcggatggcggcgacgctgatcctggagcccgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacacccttggcgagctggacctggagcgcgcgcccgcgctgggcggcagcttcgcggggcttgagcccatggggctgctctgggccttggagcccgagaaacccttggtgcggctggtgaagcgcgacgtgcgaacgcccttggccgtggagctggaggtgctggatggccacgaccccgaccccgggcggctgctgtgccgggtgcggcacgagcgctacttcctcccgcccggggtgcggcgcgagccggtgcgcgcgggccgggtgcgaggcacgctcttcctgccgccaggtgactcacctccgctaattgttcccctctgcccatccctgttcctgcgctttccactgtgtgtgtgtgtgtgtccccttcgccccgccccgctcttttcgcttgtgtgtgtgtccctcctcccgccccaccaccaccaccccgggctatgttgcccaggtaggtcttgaactcctggacccaagctatcctcccgcctctgcctccccaagagctaggattgcagggtgagccactgcgcccggccctttgaggggagttacacttatttttttatttttattttttttcgtccctgcgcttttcatacggagaaaggatgtagcttccaacattccggaggttagtgtaaggagacaggaatggaatggaaagttggttggggaattgcccctgccgctccaaaactgagaggtccctcaaacctagtgctcagttaaaagacattgtaagggctgggcgcgctggctcacgcctgtaatcccagcactttgagaagccgaggcgggcggatcacgacgtcaggagatcaaggccatcctggctaacacggtgaaaactcgtctctactaaaaatacaaaaaattagccgggcgtggtagcgggcgcctgtcgtcccagctactcgggacgctgaggcagaagaatggcatgaacccaggaggcggagtttgcagtgagccaagatcgtgccacgcactccagcctgggcaatagagtgagactccgtctcaaaaaaaaaaaaaaaaaaaggcattgtaaggaaagagaaaagacacataatattaaaaacaaacaaaacaaaacaaaaaaaacaggccggacgcggtggctaacacctgtaatcctagcactttgggaggccgaggcaggcggatcaagagttcgagaccagcctggccaacatggtgaaaccccgtctctactaaaaatacaaaaattagccaggtgaggtggtgcacacctgtagtcccacctactcgggagtctgaggcaggagaatcgctggaaccctggaggcagaggttgcagtgagccgagatcacgccattgtactccagcctgggggacaagagtgaaactccatctaaaacaaaaacaaaaacaaaaaacaaacaacaacaacaaaaaattttcaagtagtttcaatgttcttatttatgtatggaccaggaagtcacttttttttttaataaaaagaattccaactggttttctcactgtatttccatggcagctaggaggtgccaggtggctgggcctgtgacagtgcagaggttttggtgcctgcccgcccaccattgctccagctgcagctgctgccccctgcagggcctgttcgttcctgctgcctagctccctgctggctggctatgatctccgtcctgttaccattccaggagagcagccacctccctgtgcatggcaggaccaggtactgattgtggcctctcctcttggcctcgaatggtatccttgtcatcagtgagcaagtccccaaagaccacggtcttgtccattgtcaggataattcactccacaagctgggactccaggtgctgctctacccagcggtgcttctcacccacacagtggtcatactttggcaggggctggtgcagtgtgaagacctcggtgttttgcatgtgcttcatctcttgcaaggccctctggggttgggcttcaagactagggaaaagcctagggcttcacacccatgggccactttatccaccaggtccggcagcagggtgaggtactgcttccagaccaggaagctgcggtgctgctgcagtgtcacatgcagctccctgagaagcggcggctgaagccccacaggatgccgtctggaagctgccagcacgcggtccctgtccatcagcacacgcgtgggctgtgctcatcgctgccggggcactggggtttctcgggatcctaggggtatggggcccagaaatgttctttaaaagtttctcatttttgcaacttttctttcaattcacacagtatgttaaggtttatgtaaattagcatttacaataggaaagcctcttcctgtcaaatggaaatttgaggttactggatacttttatattacataaagagcaatcagccagtgtagaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagtcaacatattcatctgctctgggcaacaatttgtcttaacttacaaagttaaatatgttattctacttgtacatgtgcaccaggaggcatattccttataagaggaaagccattgcagatgagcagtctggattaatttaaaaaaagagcaaagtcaactggaaacagtccaaatgtccatcaacaatagaacagattaataaattgaggtatatttccagcagtcaaagtgattgaactacagctagaagaatcaacatctatcaagatatacaaaagaaaagaaaaaaataaaaaagaatcaacatggatgaatctccaaaccactgttgagtgaaacagtcaaacactaggagaacacattcagtatcattccatttagatacagttcaaaaaataggcaaaataaaatattgtttaaggtacataatctaagtggtaatactatgaagaaaaccaagagtgatacacagaaagtccaggatactggaaagagaggaaagggcacaggggtctgtgggacgttgatggtttgcgggtatcagcactgaactatgtcttaaaagtgttgcctgtaaggtgtttgcattctttttttttttttttttttgagacagtgtctcgctctttcgcccaggctggagtagtggcacaatcttggctcactgcaacctccaactcccgggttcaagcgattctcctccctcagcctcccgagtagctgggattacaggtggccgccaccacacccagctaatttttgtatttttagtacagatggggtttcaccatgttggccaggctggtctcgaactcctgacctcaggtgatccacccgtctcagcctcccaaagtgctgggattacaggcgtgagccaccagacccagcctgcattattattctttaattttgtgtgaaacacaaaacctttaatgtaaatgataaaaatattcagtaagtggagtcattcagaatgagtagccttttgagtctgtctccattgaataagtgcattctgttgagtgcactggagaggaatttgtgctcttctatgtagcagtctttctttttgtttcttggtggtgcaccattaaatggattcattcaccagttaaaggacatttgggttgtttccagtctttggctacaatgaataaagtcactataaacacttgccagaagtttctggacgaacacaggttttcatttctcgtgggtagatacctaggagtgggattgctgggtcacatgtgtggtaagtatatgtttaacttggtaagaaaccatccaactgtttcaggaatagcttagttttgcattttgttttgtttcttcccaagaacctgggccctttcctggcattgtggacatgttcggaactggaggtggcctgctggagtatcgggctagtctgctggctgggaagggttttgctgtgatggctctggcttactataactatgaagacctccccaagaccatggagacgctccatctggagtactttgaagaagctgtgaactacttgctcagtcatcctgaggtgagttcttctctcagatttatgggctatgatgtatcaggtctcttcttaaatggtctgggttttcacagaagttagctcattcatgacagccattccctaccccaacacacactaccttttttagtcacttcttatagacagtttctttctttcttcttcttcttctttctttttttgagatggagtctcactctgttgccaggctggagtccagtggtgcgatcttggctcactgcaacctccacctcccaagttcaagtgattcttgtgccccagcctcccaagtagctgggattacaggcacctgccaacatgcctggataatttttgtattttcagtagagacggggtttcacaatatttgtcaggctggtcttgaattcctgacctcaaatgatccacctgccttggcctccccaggtgctggattacaggcatgagccactatgcctagcctaatttttgtattttttttttttagtagagatggggtttcgccatgttggccaggctggtctcaaactcctgacctcaagtgatctgcccacctcggcctcccagagtgctggaattacaggcatgagccaccacacctggcctcttatagacagtttctattcaattctatattactatatttcctgctagtaaagatatttgtagttggtattatgcaattttaaattccagtatgttttttctttctttttttttttttttttttaagacggagtcttgccgtgtcaacgaggctggagtgcagtggcatgatctcggcttactgcaacctccacctcccaggttcaagcgattctcctgcctcggcctcctgagtagctgggactacaggcgcatgccacttctgcctggctaatttttgtatttttagtagagacagggtttcaccatattggccaggctggtctcgaactcctgacctcaaatgatccacccgcctcagcctcccaaactgttgggattacaggcgtcagccaccacgcccggccatgagatgacgtacttgttgatgacgactcagtttagttatgacagtgggaatgggtggctcaggtgggagacagaaaaagatcatgggagataatgagattaaggaactgagaaaccagagtaattgatagatcttccacatggttatcaccaagagtggtgatggacaaattgtggaaaggaagagatagaggggaggtaaattcccaaagctgcaaatctgggtaaatggtagaacccagattcagactcaggttcaactaacttccagggtgggcacaactcaccatattccactgtttgtggagccattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattctttctcataacttcttaaagtttcttcccctcattattaaaatgaatttaccagtaagaatgagtttttaagatttttataaactgtatactttatcagtttgggaagggagtaactgtaggaaacacaagaagtggaaaaagtctcctcttcctatctcaacacacaactgataaggctttagttctgaaaggaaaagtgagtaacatcaattaacagtgtctggtacgtaaatggagttcaataattatttgctgaatgagtataagtgagccaggcgtggtggctcacacctgtaatcctagcactttgggaggccaaggtgcgcggattacttgaggtcaggagtttgagaccagcctggccaacatggtgaaaccccatctctactaaaaatacaaaaaattagccgggcgtggtggcgcatgcctgtagtcccagctactcaggaggctgacgcaggagaattgcttgaacccgggaggcagaggttgcaatgagctgagattgcactactgccctccagcctgggtaacacagcaagactatgcctcaaaaataaataaattaattaaataaataaatgattacctactgtggaagaaaagcacataatataaaaagtatatcagatttgagtttctcctttaagaatggaagttaacatcttgcctataaactgattactagttagatataaaactactaaaacttttcaaaaccaatacatatttagttctttgatatcttctccttggattaataaggattctcctagtgcaaataaattttatgttcctgtttatacatatggacctttaggatttaattgtttcaaaagctgataaaacattattgagatgaattacataagcgattttaacaatgacaaatgtgaaattcaataacaatttaggcttggcatggtggctcacacttgtaatgccagcactttgggaggccaacgctggtggattgcttgaacccaggagttcaagacaagcctgggcaacatggcaaaaccccgtctctacaaacaaataccagacattgtggcggatgcctgtagtcccagctactggggaggctgaggtgggagaactgcttgagccctggaggcagaggttgcagtgagccgagattgtgctactgcgctctagcctgggtgacagcaggatactgtctcaaaaaaaaaataaagaaaaagaaagacaatatttatatcacttgatataaatagttacacaataaacttgattttttcttaaaccttagttgtatttaaaagaaaaaaaaaaccttaatttattattattttctttccttttttttttttggaggcagggtctcattctgttgcccaggctggagtgcagtggcacagtcacggctcactgcagcctcaacctcgtaggtttaagctattctcccacctcggcctccctagcagctgagaccacacaggcacacaccaccatgcctggctaatttttaattttttgtacagatggggtctcccaatgttgcccaggctagtcctgaattactgagctcaaacaatcctcctgcctcagcctcccaaagtgctgaaattacaggtgtgagccaccgctgccagcttccggcaccttttttctaaaggaattcatggttttgtagcagtagaatataaccagatctacagtagagagatgataccctgagatgaagctacctcctgtgttactctgcaacccaggaatgcagctggtgccatgtctccaaacttccacaagaatgccagtgctgggcatggagccccatttagagtacacatgacctgaggctctgaaaactcttagagatgatgcaatctgggacagttgctcatagctggcctggccaagtcccaccccaagatgccaggccacaacacaaaatttcaagtcatattgttttatcttttcccttgcaattatatagtatatgactctcttagaaaagtgcaatagttaaaacttgttttagtagatgctagatcccaaacttgagtctgctgaagcccttttgagaccttagggaccctattctccattcttagaaattcaggctggtgaatattagattcaaaagcaccacagatgagccggtggttgtagaagtacatgcctgtaatcccagctacttggaggctgaggcagtagtagtattgcttaagcccaggagttcaagccagcctgggtaacatagtgggacaccatcttataaaaacaatttttttttgagacagtctcgctctgttgcccaggctagagtacaatggcttgatctcggctcactgcaacctccgcctcctgggttcacgtgattctcctgcctcagcctcccaagtagctgggattacaggcgcccaccaccacacccagctaaattttgtatttttagtagagatggggttttgccatgttggtcagctggtctcgaactcctgacctcaggtgatacacccggcttggcctcccaaagtgccaggattataggcgtgagccaccgcacttggcaaaaaaatgttttaataacatgaaaaattttaaaaagcaccacaagggttcagattacctatcagcctcttgacatttcgtattttttttttttttttgagacgagatctaactctcacccaggctagagtgcagtggcagtaacatgatctcagctcactacagtcttgatctccaaggctcaagtgatcctcccacctcagccccctgagtagctgggactgcagacacatgtcaccatggacagctaatttttgtatttttgcagagacaaggtttcaccatgttgtccaggctggtctcaaaactcctgggctcaagcagtctgtccatcttggcctaccaaactgcttggattataggcatgagcaaccgggcccagcctagttagtctttattagttatttgaaagacatttttcttttcactttcaacccatgcacactgtgaacactgtgaaatacacagaaaagttcattaaactaacatgctccataatgattcacttatttatttgaaaacagaggttgggtgcagtggcttatgcctgtaatcccagcactttgggaggccgaggcgggcagatcacctgaggtcaggagttctagaccagcctgaccaatatgatgaaaccctgtctctactaaaaatacaaaaattagccaggtgtggtggcatgtgcctgtaatcccagctacttgggaggctgagacaggagaatagcttgaacaaggaggcggaggttacagtgagccaagatcacgccactgtactccagcctaggcaacaagagcaaaactccgtctcaaaaaaagaaaaaagacccggtgcggtggcttacgcctgtaatcccagccctttgagaggccgaggtgagtggatcatgaggtcaggagcttgagaccagccaggccaacatggtaaaacgccatctctactgaaaatacaagtattagccgggcgtggtgctgggcgcctgtaatcccagctactccggaggctgtggcaggagaatcacttgaaaccggaaggcggaggttgcagagagccaagatcgtgccactgcacgccagcctgggcaaaagggcaaaacgctgtctcaaaaacaaaatagagatggggtctccctatgttgcccatgctggtcttaaactcctgggctcaggcaatcttcccaccttggcatctcccaaagtgctgggattacaggcaatcaccactgcacctggccatcatgaataattttaaagggaaccacaacataaccaatacccaagtccaatcggcatggtttttaaaagcatatttaaagtgtataacatggaccaggcacagtagctcacgcctgtaatcccatcactttgggaggccaaggtgggtggatcacttgaagtcaggagttcgagagcagcctagccaacatggtaaaactccatctctaccaaaaaatataaaaatttgccaggggtggtggtgtgcacctgtactcccaactacttggcaggctgaggtgggtgaatcgcttgaacctgggagtcggaggttgcagtgagccaagattgtgttactgcactccagcctggacaacagagtgagaccctgtctcaaaaaataaaataaaaataaagtgtacaaagagatggttgtggcgggttgtttttgtttttgttttaagagacaggctctggccaggctggagtgcagtggtgccatcatagctcattgtagcctcaaactcctgggggcccaacccatcctcccacttcagcctcctgagtagctgagactataggcacttgccaccatgcccagctaatttttaattttttgcagaaacagggtcttattatgttgcccaggctggtctcgaactcctggcctcaggtgagcctcctgtaatcagtagaagggtccagctgccagccacttgtaaaaagaagccaatataataagagtgaggtgtgataaagagagtgagttttattatccatgctagcaaggggagaagtgagtgtagttatttgcaaatatttccactcttcaatttgtggagggaatccaggagcttttgaagagagagtttggagtgcagaagaggcagcggaactaggagttgtcgggtggcgtgacctgctccactggcttgttttgaagtattgtttcatctggtgaaggagccagtgccatcattgtggctagaggtgtctggtccatatccagatccagtccctgaagctgaaggaaatatatgaccaggtaatggtgtgtacttaacaagcatctaggtaaatacatgtgcataaggcacggaagcacagaatgggaaaagaaagggcgtggaggttcagcacattctgagggtgtatttcaagatgaaaggaaactcatatgcagatggtctcagagttctatcttgagactcactgggggaggagaaaggggaaaggaaaaaaagtcttaaggtttgaggctaagctgctaacctgcttagttacactcccaccttggcctctcaaagtgctgggattataggcatgaaccactgtgccaacccaacatggtgttttgatatgtgtatattaacacactgtgaaaggattcacaggtaattaaccaggtaattccaggtaattaacctatccatcgcctcacatctttctctctctctctcttttttttttttctggtggtgaggacacttgtcttagtctgttcaactgcagtaacaaaatgtcttataccgggtaatttataaacaacagaaatgtattgctcacagttttggaggctaggaaatccaagatcaaggcaccagcagatctggtgtctgctgagggcctgttcctcatagatagcaccatcttgtgtcctacctagtggaaagagcaaggcagctctcttcaacctgttttataagggcaccaatcccattaatgagggttccaccctcatgacagtcacttcccaaatgcctcgtgatgtgtgtgtgtgtctgtgtgtgtgtgtatctcaggggcgtcaggcctcaatttcctcatctatacaatgggtataacaacaatcccatcttgttgggaggaattaacaatcatgcatcgagccctgggcctcaggcttcaatgtattagttattagagctaatcattatttaatgttttaaacacccccaggaagtagagaacattcctgtcacattctgcagaaaaagaaattgaggcaaggggcaaagccatttgccaaggtcatagatcctgcaagccaatggcaaggcaggatctgaacctggggcttcagatcctggggctttacctgattaaataccaagagagagtgctgagatttttttggtggtggacagtccctgaggcaagccatttttagagcatctgggccacttggggaattgaatctttaccagggcttcccacctcctgttgccccttctctgaaggtgacccccctcccacagtagcaccccaaccactcagaacccccaagccaccttctttgcacatgctgaagctaatattgccctccactccaccccaacatcagggaccctggcccaagcccttccctgggagcccttcctcctctcatgaggcctccttcccagcccctcagaacagcctcctttatgagagtggccaagatcccactgaaaccttccctatcaactttataaaattaatcaggggagaagggaggggcgaaatggaaatcagcccagcttgcagcacacacagcattggtcatgaggtcagctgctctctgacccacttgctcagagttgtttgctgcctgttgctccagagtctcatagaccctgtcacaaggtcatagttccccttcactgctcatagataacaactggaacattataaaacattaacttttccatttgagatattctttcaggtcctgcatagcaatgaaactgaggcaggataggtagctaagggagtgaccgtgttctcgggatgcagcgaccatggcacccatacagtcaacacagtgagcctcagcattcgcattgtcattgcgctcattcaagcaaagctgtcttcattagggaatttcccccatagacagcatgagcattttgattttacctgtcctcaaactgacattttgctcattataatagtagaagacagccctacatggagatgtaatatgctaatgagacatgtgacatatgaacaagcatgtacagctactgtgcatgtgcacacagaagaccacccggaacatgcttattagcaacacctcttcccaccaccttatgaataatcatgtaagactcccataaagggagtctccctactgccagtctctgctgtctcacccttatgagcagcctgccttgaaccctctctctcacagtatacagtccattctgcatgtaaatttcaaaatattcttcttcctttgcaataaattactctatgctgcacttctttgctgtgtgtctcttgtttaaattcttttaaaccaagaagacaagaaccgaggtgtcacatcagccgccaaagaaactgctgatgccagcctgaatgaaagaccccacaggaactcactcactaaagaatgcagtttttgctgggcgcggtggcatggctatagtcccagcactttgggagacagaggcgggccgatacgaggtcaggagttcgagaccagcctggccaacatagtgaaacaccgtctgtactaaaaatacaaaaattagccgagtgtggtggcatgtgcctgtagtcccagctacttggaggttgagaggctgaggcaggagaatcacttgaacctgggaggcacaggttacagtgagctgagatcgtgccattgcactccagcctgagtgacagtgtgagactccgtctcaaaaaaaaaaaaaagaatgcagtttccacctcctgaaaatttaatcccctttaccccaactagtcaatgagcccaattttctagccctttaccctccatgatccctttaaaaaccctgttacaggtagttagacatgagcagggaaggagagggcttttctccctcacccactaggaatgtcaggtggtggttgacagttatcacgttgcctctctaaactgaaaattcgcagttggtgccagagggccagagtgagacaagctcctgatgatccacaggtgttaacattaaagtgttaattgaatgcaggtgccagggagaagcaacttcctgggcacgtgcattaagagacaaaatggcaggccaggcgcggtggctcacgcctgtaatcccaacactttgggaggctgaggtggatgggtcacctgaggtcaggagttcgagaccagcctgaccaacatggtgaaacaccgtctctactaaaaatacacaaattagccgggtgtggtggtgcgcacctgtagtcccagctactcaggaggctgaggcaggagaatcgcttgaaccccaggaggccgaggttgcagtgagctgagaccacgccattacactccagcctgggcaacaagagtaaatctccgtcttaaaaaaaaaaaaaaaacagacaaaatggctatgtatgacctctccaggacactccactggaaaagggaagaaagcctcagatgggcacgtatacaacttcctacacacactgtgcatgctcacttccgaaaggtaaagagagcacagagcatgagggcagctcaccctcagagaagaatcatgagaaagaggcgagcctataaagtcctaggatcacagttaaacagggctcttgaccttcaggtgcccggtcaggtctcttccaagtgaactttcctttctttcatgtcctaaagactttttaaataaacttccactctgctctgaactcacctccgtctctttttctgccttatgcccctcagtcaaattctttcttctgaggaggcaagaactgaagttgctgtagacctgtacagattcgccaccagtaactcagacaccttccactggtaacaaccccagcccagaattcttcaaggagatggatttgagggtctcctcccatctccttgctaggtgccctgtgatcatgaagctctttctgtgctgcaaaccctgctgtctcagtgtaattggtctgtaacagcagagtgggcattctgcagcctcttccttgcccggggcctgttgggagcccccagcactgcctgtaccatcataaacccaccctggcccctttcccaggctccaagctcagaggaggcagaggcttcattctaaactacagcatcccctccctaatcctcatttgccttctccttctgagcttgggccccattttttgagaccctaccagcccccattcccacaatcccctgtgccgacacaaatcaacctccccatgtcccaaccactgtcaaccccaacttagaccagtgcatcccacagctattctagcaccccataaacactccagtgtcccccacttcctgatcccacaacaccttgggccctccagataacccgctgctccagcctggcagtttgtcaaccccctcacccagacccccaacacctcatgcctgtcttatgccatgagtctgaggcccctgacccctacacctcttgggtgccacccaggcctgtctgtgtgggcagctcccccaccagctcccttccatcccccatgggtcctatccagggtttccccgacccaagcacacactattcggcattcctgactcccactgttcctggctcacggcctggccaccttgtctcgctcatctgccatagcccctgcctggcccagcaggacaggcctaggtcagggcaaggacaggtcagcaccagggctggtgccccaccccgaaggacacaagcctcctgctcaggacactttctggggtcctgtgcctccccttcttctcccccaggtgccaagtccccactttttaatactatcgcattgaggctgggcatggtggctcacacctgtaatcccagcactttgggaggctgaggtgggcggattacctgggctcaggagttcaagaccagcctgggcaacatggtgagaccccatctctactaaaaatccaaaaaataattagctgggcttggtagcactcgcctgtaatcccagctacgggggaggctgaggcaggagaatcacttggaacccagaaggtagaggtccagtgagccgggatcgcgccactgcactccagcctaggcaactgaacaggactagatctccaaaaaaaattaaaataaaaaagtattatcacattgggtattaggtttgttaaataaaaattattgctgtggaggatacacttgaagggaatgaaaaaaagtataggagactattgttttgctttttttttgttttgtttttgagatagagtcttgctctgtcccccaggctggagtgcagcagcgcaatcttggcacactgcaacctctgcctcccaggttcaagcaattcttgtgcctcagcctccctagtagctgggattacaggcatgcactagcatgccccgctaaggccattgttttggactaggctctagcactaggccccaatagacaagactaaaaaccaaaatggcgtcacctgtgctaaagtttcacccaacctaaactgaagtgttacctggccttctgagaaatcaggagagaaataacagccaatttcccaaacatgccagttttgatctttaattatcatgacaatgaggttcccctctgctttaatctgtacacaaaagaattagccagctgggcatggtggcttactcatgtaatcacggcacttcgggagcccaaggcaggcagatcactagagaccaggagttggagaccagcctgcccaacatggtaaaaccctgtttctatgaaaaataaaaaaaattagcaggcatggtggtgggggcctgtaatcccagctactcaggagacagaggcaggagaagcgcttgaaccagagaggcagtggttgcagtgagccgagatattggattaggcagtcaaaaaaaccaagcaagcataaaaggtcaataagttgtaatcttgatagtaaaagtggaaaacttattataaatggaaagaaagttttgatttccttttttgtttgatgggcagtatgccatattatacccaaagttcgtttaaaaaatatttccatcaactatttttatttgaaataaatatttgaggtaagttaccaaggcagcttttttcctcaaaagtaacctgttcctctttggaatagcacattttaggggcatggttaatacctgagatttttactcagtaaatcctgatggttactatgtgtaaaatatctttaagtaggattgaaggcctctgtggggaataaaatattaccaaagtctataaaaataaattttacatgttctcctttatgacagagagcagcactggttctgctacttttaaaatgaataattgatttcttgataggtgtttgatatttcttccctcactgctgattcttagatagaaaccattctttatatttgatagactgttttcagaaaacccttatcaacaagtgtacaatacttatctgaaactatacgtttagaatggagcagtttaatactagatctcagaaatttgaaaaatagcaaagaagactggatttggaaagcatggtctacaattgcttgtcaaattctgaagctatgaagaataaatgtttcaactttggattatgaaaccccatttatgattttttaaataaacttgaaataaaaatgattaaactaaaaaaaaagaatgtagagggagagatcaatgtaaaaatttatttaaagaaatagtaacagagaactttctaaaactagagaaagatatgaatatacaggtataagaaggtcataaaacaccaagccaactcagcctcaataagactacctcaaggcatataataatcaaactctcaaaggtcaaggctaaaaaaggatcctaaaagcagcaagagaaaagaaggacatattaataacatcataaaggagctccaatatggctggtagcagacttctcagcagaaactttacaagcagagagtggggtgacaaagtgctgaagcaaaaaaacttccaatctagaatattatattcagcaaaaacagccttcaaacatgaaagagaaataaggatattcttagttaaaaaaaaaaaagtgagagattttgacatcagacctgtcttataagattcttgttaagaggagttcctcactggttgagtatgaatggtcaaatgaaaagaacattaatattctcctgccttgcatattcttctaaaacattttacattcctaacacatcagtgtgtccacatcttgcttctaaggcagggggcaatttgatcc

SEQ ID NO: 121 - DNA, 108953 bp, Homo sapiens
ctaaaaataaaaattgaacatataactcctgaactagtggatgaaaatgaagaatgaagaataaaattaaatacaaaaaaaatgaagagtaaaattaaataccaaaattagccaagtgttgtggtgaatgcctgtagtcccagctactcaggaggctgaggtgggaggatcacttgagccccagaggtggaggttgcagtgagctgagattgcgccactgcacttccgcctgggtggcagagccaggctttgtctcaaaaataaaaaaaaataataaattaaaaacctgaatactaaatggaagttaagaaggaaggaattaaaaaagaagaaaagtaaaataaaatagtaggaatagtgaatccttagttatgttagatgttcagtgatttaataaatctgtaaaaagacggagatgagatgatgcaatttaaaatgtttcggctgggcgcagtggctcacgcctgtaatcccagcactgtaggaagccgaggcgggtggatcacgaggtcaggagatcgagaccatcctggctaacacggtgaaaccccatctctactaaaaatacaaataaaatgtttcatgctatttacgagagaagcatttgcaacaaaatgccaaagagaaggtgaaaatagctggaaaaaaaatgcgcaaagcaaataaccaatagaaagaaagccaagttgggctagcaaaatcagacaaaataaccttcgaggtgcaaacaactttgaggcccaaatagaggttcttcccactaaaagaatgattccctgaatgataatggaatcttgacccagcctgcacctcaggttaagttaaaagtggaaatttaaagatctaagtgtgagattttaaaaagcatttccccagaaataccaggatctgtagatggaaatgttattaagaataaagatgtggagctgggcgtggtggctcacgcctgtaatcccagaactttgggaggctgagactggctgatttcttgagcccaggagtttgagactagcctggacaacatagtgagaccccatctttacaaaaaaattaaaaaaaattagtggacatggtggcatgcacctctagtcccagttactcaggaggctgaggtgggaggatcacctgtgcccaggctgaggctgcagtgagccatgatcacgccactgcactccagcctgcgtgacagagcaagaccctgtctcaaaagaaaagaaaaaaaaagaagaaagaaatgaaaaccgtagctcagagacagagaaactgagcaatgcataggttcagaagggtttgaaacagactgaattgtgtcttggcatatgagagaggtcgcagctataaaacaatgagagaagaaaccaaattccacataggcaggactgagacaattggctgttcttgtggatgatacgtgatcaaatctcaacctcatgcgatacttttttttttttttttgagatggagtctcgctctgtcacccaggctgcagtgcagtggtgtgatctcacctccccgcaaacttctcctcccgggttcaagtaattctcgtgcctcagctgggactacaggcatgtgccaccacgcctggctaatttttgcatttttttagtagagacggggtttcaccaagttggccaggctggtctcgaactcctgacctcaggtgatctgtccacctcggtgtcccaaagtgctgggattacaggtgtgaaccaccacacccagcctcatgtaatacttaaaaatgaactacaggtggattacaaacctgaatataaaagaaaacttttttttttgaaaaatagagggaaatgtcttataacctcagagttaggaggtttttcttagatacaatacaaaaagcataaccacgcccatagtcccagctactcaggaggctgaggcataagaatcacttgagctcgagaggtggaggttgcagtgagccgagatcctgccattgcactccagctgaggctacagagtgagagtataaaaaaaaaaaaaaaaaagcataacctttaaaaatgggttagcctatgtctacatttaaataataataataataataatgttccaacttcaggctctgaaaaaagtcaaaagatgagctgtcaactagaagaggctccttactgctcataccaccagggaaagtttaatatgcaaaatgcagtcatccttcagaattcatgggggattagttttaagacgccttcttccccgcagacaccaaaatccacagctgctgaagtctctgatataaaacgtgcagtacttgcatataatgcaagtatatgttcctgtatatttttatttatttatttggagacagaatctcactctgttgcccaggctggagtgcagtggcgtgatcttggctcactgtaacctccacctcccgggttcaagagattctcctgactcaacctcccaagtagctgggattacaggtatgcgccaccacccccagctaatttttgtatttttggtagagacgggttttaaccatgttgtccaggctggtttcgaactcctgacctcacataatctgcccaccttggcctcccaaagtgctgggattacagggatgagccaccgtgtccagcctctggtatactttaaattatctctaggttactcataactcctgatacgctgtaaatgctatgcaaatagttgttatactatattattttttatttgtattactttttattggattgctatattttattttttgaaatattttcaatacaagactggttggatctatagatgcagaaattctggttatagagcacaaactgtgtatagatagctcctaccaaaacagacggatggtgaaaaaaagaaaagaaaagaaaagaaaaagaaaatggaggagagagactatgaggcgactaaaagaagagggatatgatcattccattcgctgacaagaaaaattcaaagaagagggaattatgcaattgaccagctgatgtgtgttagaaatgctcagggtcacacatattcattgaaagccaatttaagccactatttaaatttaaaccgatttaaacaattgggcttttttttttttttctaaaaaaaaaaaaaagtcaattaggccaggcgaggtggctcacacctgtcatcccggcactttgggaggccgaggtgggtggatcacaaggtcaggagtttgagaccagcctggccaacatggtgaaaccctgtttctactaaaaatacaaaagttagctgggcatggtggtgtgtgcctgaggctgtgagactgaggcaggagaatcacttgaacccaggaggcggaggttgcagggagcggagatcatgccactgcactccagcttgggcgacagaccaagactctgtctcaaaaaaaaaaaagaagaagtatattggttccgtctggaaaggtggagcacttgaagcaaaggcaggaagactggaagcagggagagggttttcaggtcacaaacaggtgagagacaaaacagttgccttcttttgagtttctgattagcctttccaaaggaggcgatcagatacgaatctgcctcagggagcagaggggggactttgaatagaatgggaggcaggttggccctaagcagttcccagctggacttttccctttagcttagtgacttgggggtcccgagatttatgttcccttcacagtgtatgagtgagagcacttggaaactgagagtggaagtgtcgcaggccaggtctcactaacacaggcccccacaacacctgtttcagtattgactgagtggttaaatattaaaagccagtgctgttatacaaaggctggaatgtaacaaaagcccaccgagagtttttcccaggactttcccgggccttaaagcatgacaaaataatgaatgaattcttaacaggacccatttaggattaaacaagttttactgggggtctgcagaaactccccaggcctccacaaacaagtttattggggctttgaaggaactctgcaaacctcctggatttagcaggagacaacatgagggtaatcaccccggcacctggacccattagattaagtcaatttactgaggctcctgaggaagatcctcaggactcagaccttagttatagattaaaagaagttaatcacttatgtctttagataaatgcacacacatatctccacatagcttggaaggtatataagctctggaaaactataattttgagttagtctggtgataatttccaggccttctccctgtaacaggttgcagaaataaaaactctcttcctccccagttcatcggtgtttcattattgggctgtgagaaatagcaacccagttgggtccgggaacagaaggtttggtgttatcttcatcacaggcactggactgtcggtaaatttattccatgacaattcttcctaggtttcttttttatattacttgcttccatcatggcagacagctacactggcttcttgccatgaaaacgaacttctagtaacaaaacggaaacctttttttttaagtttcaggtttcaaggttttacttctatctgcaaagtgatttttaaccagacaatggcaatctataaacacaccgtgggcagcaaatcagaacaaactgcaaggtcgatagtcacgctgatgagcttgtttctgcagcctgctcctaagggaaggacaattttcttttctaacagtgcaatgttgtttcctccacagatatctacccaaagccaaaaccaccttactacccacagcccgagaatcccgacagcggtggaagtaagaatccgcaggcctgaaactctttctcaatctggtttgatgatgtttgcctttttatttactagcaggtttagcctggttgcatttgaaatatgtgtgtaatagctcccttactgggaatgtagtttctttcctcactggggggagcaagaaagtccaacggacagaaacaatcttattttccctttgctttgacatctagaaaccactaaggtgtacttgtaaccacccaactggttcactttgttggctgcctagacagagctgatttatcaagataggggaactgcaatggagaaagagtaattcacgcagagccggctctaagggaggctagagttttattattaatcattcagtctctggaacatctggggatcagggttgttaaggataagttggcaggtaggggcttgggaagtggggagtgctgaccggtcaggttggaaagggaaccatagggggttgaagtgaggttttcttgctgttttctgttcctgggtggatggcggacctggttgagccagattaccgggctgagtggtgtcagctgatccatccagtgcagaggctgcaaaatatctcaagcaccgatcttaggttttacaatagtgatgttacccccaggagaaacttggggaggttcagactcttgcagccagaggctgcacgagccctaaagtgtaatttctaatcttgtagctaattttttggtcctgcaaaggcagactggttcccaggcaagaagggggtctttttgggaaaggggcattcttaattttgtttcagagtgaaaccacgaactgaattcgttcccaaggctagtttggctcacacccaggaaagaacaaggacagcttaaaggttagaagcaagatggagttggttaggtctgacctctttcactgtcatcatttcctcagtcataatttttgcaaaggccgtttgatactcaaaggacactttgcattatcatcacagaaagctaatcaggctgagagacaagtcctttctctcacttgttttcagtgctccaaatacctttggcttaaccattcccaaacccccacgtgtgctgtgcactttatgtgttttagagttggtttctccattttttctaacatttggcagacagtttttttccacagatttattacactcatcattgaaaaatatgcaattcaaaaaagaaagagagtgaacgagagagagaagagtggggaggggggtgggcatggagagagaaagagaaagagaaaagaaaggggaaagaagaaaggaaaagatagattctggccattaaagttatcagcagttcaacaaccttaaaaacttaaatgtttgccaggcagagcagcgtgaagctggctaaatcaagaggggttctggaagcttcctggtagtttgctctggctttaaactttcacagcttaacagcgtgtccattcattgcagacacgcacatccagatggacagaaattatctcctcttacaaggaatcattaaaaacagagaccaagacccaagggaggtgacacccacttgaaaaactacacctcaggccgggcgtgggggctcacgcctggaatcccagcactttgggaggccgaggcgggcagatcacctgaagtcaggagctcgagaccagcctggccaacatggcgaaaccctgtctctaccaaaaatacaaaaattagctgggcatggtggcatgcgcctataatcccagctacttgggaggctaagacacgagaattacttgaatccaggagaggaaggttacagtgagccaagattgtgccactgcactccagccggggaacagaatgagattctgtctcgaaaaaccaaaccaaaccaaaccaaaccaaacaaaacaaaaccccaaaacaccacctcacccttaactgcattagttaagccagctagtctttcttttttccccctctttcatgatgaaaatcccaaataccacccacctttttctcctgctatttcctcctagtcttttaaaaaccattgtcctgcggatcatggctatgttgcaaggcactcatgggaattccacagggaacgtgtttcttgctgaaacatacttgggaaacgcccagttaaacagactgccgtgggcttccctcccagagaattcatcaggacttaaaatgtgtggctgggcatggtgggtcacgtctgtaatcccagtactttggtagaccgaggctggtggatcacctgaggtcaggagttcaaggccagcctggccaacatggtgaaaccccatctctactaaaaatacaaaaattagtcgtggcctgtagtcccagcaactcgagaggctgaggcataagaatcgcttgaacctgggaggcagaggttgtagcaagctgagatggcgccactgcactccaggctgggcaacagagcgagactccgtctcaaaaaaaaaaaaaaaaagaataagaaaaaaaaaacttaaaatgcgagatcctttaagatgggccatcttcagagtgtgaacactcagcccctcccacagcaaagtgattcatgaaccccaataggaggaggagtgggggaagagaggctcaggctggggaggtgaccccccatgactcaagcctcaatctcctgatgcttgtcccaacaaagaggaggcttcctttccgactttggtttttcatgttgtgcttaaatccagccacactgatgcctttaacatggcagtcctgaattattaatcaatactgtgtgaatccaaaatatctgagacaggtctcaatcagtttacaaagtttattttgccaaggttaaggacgtgcccgtgacacagcctcaggaggtcctgatgacaagtgctcaaagttgtcaggacacagcttggttttacacattttagggagacaggagatatcaatcaatatgtataagaagtacattggtttgatctggaaatgcgggacaactggaagcaggggcttccaggtcacaggaagatacgagacaactagttgcattcttctaagtccttgatcggccttttactgaaaactcaatttacatgtgagacagggcaaaggaatagtacttatgcctcagtctggcccagtgaatctgcatttttcatcaacaatagggcagaggaagcaatcagacatgcatttgtctcaggggagcagaggggatgactttctgtcccacacctgtgaagatgagctgttggtgtacattgccagggtgaaattccacagaactgttttagggtaaacaaaacagtttactttcctcagattgtgaggacagtatgtagcttttaaaaaacttaaaaaaatttttttgtagctatcttatttagaaagaaaatgggaggcagatctgactaactttttttttccagcttgacttttcccttggcttaatgattttggggtcccaagatttattttcctttcacaattgaacatcagaacatggagtatttaacacaggaaatgagcaaatttaacgtacacacccaaggaaaaggaaaaatgaagctggttggaagttaattatggatagtgtggtatatgagcagaaattccccttaaccagtgttcttgcccaggctagcccaaatgagcccaggctagcctagattcccaagtgtgtatcttgagaacgaggaagagccctagaaaacaatgtgtaacgtccctccaagatggggtgttctggaacaatccctcagacaacgaaggcaattgttgatgggcaacattgggaagaccccagagatggaatgtcctaggcctttccatgttctctttctcattctccctccattgacttgataggtggctgggggatttataagtatttaccacacaccagccagctttctccggatggctccaggcatgcttggagcccagtggtctctttcccttagaatttgatctggaggaacccaaaattctctctgtgtcctttgaaattcagcacatttttcttggcttccatgagctcctgtggcatttctcaggccaactgttgactctgcttcctatgtctgtgcttgtccctttgagagatgtcagcgttgctcaccgattcttttctctgaccccagcagctcctatccatgttgtctttttttttttttttttcagacagagtctcactgtattgctcaggctggagtgcaatggcacgatggcatgatcttggctcactgcaacctccgcctcctgggttcaagcaattctcctgccttagcctcccgagtaactgggattacaggcgtgcaacaccacacctggctaatttttgtacttttagcagagacagggtttcaccatgttggccaggctggtctcaaactcctgacctcaggtgatctgcccaccttggcctcccaaaatgctgggattacaggtgtgagccactgtgcctgtcctcatgttgtcttgaaagtaacaagacaggcacggattctttttgatgcaagctgttatgggatgaattatgtctccccgcaaattcataggatgaagtcctaacccccagtttcctcagaatgtgactgtctttggagatggggcctttaagaaggagattaatgtaaaatgaggtcactagggtgggtccggatccaataggactagtatcctaataagaagagatgaggacttagacacacacagaggaaagattatatgaagacacagggagaagacggcatctacaagcccaggagagaggccttaggaggaaccagcccagaccatatcttgatctcacactcccagcctccaggactgtgggagaatcaatgtctgttgtttataagccacccagtctatggtgttctgtgacagcaacctgaaatggactaagacacctcataagaaggggagatgaggacgcagacacacacagagggacaatcctgtgaggacacagggagaagatggcatctgcaagcccaggagagaggcctcaggaggaatcagcccagcccacacctggatctcagacttccagcctccaggactgtgggagaatcaatgtctgttgtttataagccacccagtctttggtattctgtgatagcagcctgaaatggactaagacatctcataagaagaggagatgaggacacagacacacacagagggacgaccctgtgaggacacagggagaagatggtgtctacaagccaaggagagaggcctcaggagtaagcccaggaatcaatgcagttggaggttctgtgtgtgaatggaggagggaagctcacagatgaaggcgttttgagggaggactgaccttacagtgaggtacccagagacttcctgaaccaagccacgaatatgcagctcgtgctccgggcagtgccttctggcctggaaaccaaagctcccttgtgtccagtccccactcctctgtttggcccccaagtttccataatcccccacagttgtatcattttagagacctcaaaagagagtctaggctgggcgtggtggctcatgcctgtaatcccagccctttcagaggccgacgtgggtggatcacctgaagtcaggatttcaagaccagcctggccaacatggtgaaaccctgtctctactaaaaatacaaaaattagctgggcatggtggtgtatacctgtaatcccagctacttgggaggctggggccagagaatcgcttgaacccaggaggcggaggttgcagggagccgagattgtgccactgcactccagcctgggcaacaacagcaaaactccttctcaaaaaaaaaaaaaaaaaaagagagtctaggcagggcatggtggtccatgcctgtagtcctagctatactcaggaggctgaggtaggaggatcacttgagcccaggaggtggaggctgcagtgagctatgattcaccactgcactccagcctgggcaacagagcaacaccctgtctcaagagagagagaaagggaaagagagagagactattttgagaagtgaaaaaccagtcattctcagcccagatttccagtgttctgagacgtctgtcctgaggaaggactttgagaacagcatccttgccttttttgtgaattaaagtaatttcactcttgagccaatgtggataagcacttgacaggtactggcagtgccaggtaccaggaatatagaatgggtacagaaaataaagtttctagtccagcgacaaaaaggtgctgaagatacagactcatgtcgtgcaaagagcttgcactgattatttcatttcggcttcttgaatagggtcaaaggacatttaagctgagacaggagggacgagctaattaatgcttttccagatgacaaatggattcttcaaatatttagggagagtgtaaagtgatggacagggaacaggaggggtcatgacagaaggaatgccacctgcaaaagtcctggggcagggctgggcacggtggctcatgcgtgtaatcccaacactttgggaggccaaggtgggcagatcacctgaggtcagaagttcgagaccagcctgggcaacatagtgaaatcccatctctactaaaaatacaaaaattggccaggcgtggtggcacacacctgtaatctcagctactcgggaggctgaggcaggagaattgtttgaacccaggaggcagaggttgccgtgagctgagatcacaccactgcactccagcctgggcgacaaaagcgaaactccgtcttaaaaaaaaaagtcctagggcagaaagctcatggtaaacttgaggaacatgcaaaagtcattgcaaaaagttttaagaaattcaaatgaagccaggctcagtgtggctaatgcctatgatgattccagctctttgggaaggcaagacaggacgattgcttaagaacaggaatttgagaccaacctgggcaacatagcaagaccttgtctctacacaaattttaaaaattagccaactatggtggtatgcacctgtagactgagctacatgggtggctgaggtgggaggattgtttgagcctaggaactcgaggctgcggggagctatgattgcaccactgcactgcagcctgggcaacagagcaagactctgtctcaaaacaacaacaacacaaattcaaatgaaacggtgtaactcaagcaagatggaaatacaacacactatcaaaaggtcagatgtttcatcctaacatttatagaagtgactgacttctgtaaatggtgctggcatctgtagtagccctaaacagggaaaggtcaacaacgcactttctgccctgttaatttcagagagccctggacttcttgcgaaagcaccagtggtgtaagtttttgttttttcattgtaagctctgaggtggtattatgaatattgtctacatgattaataagctccgtaaaagcaatgggcagtaacatcttttctgtactttggcattcttatttatagatggtatctacctgaaagatgtcattatttttctgaaatcatactgttgttttccaacagatatctacccaaggccaaagccacgccctcaaccccagcctggcaattccggcaacagtggaggtaatgagtatttatttatttatttttattttattttattttattttattttactattttatttgattctatgttattttactttattttaccattttatttgattctatgttattttactttattttatttgattctatgttattttactattttattttattatttattttggagacagggtctcgctctgttgccctggccagagtgaagtgatgtaattgcagccttgaactcctgggctcaagcaatcttcctccctcagcctttcaagtagttaggactacagatgtgtaccacctacattgcaccacctatatttcaccacctatattggctatatttcaaattttttgcagagacaggatcttgctgtgttgttcaggctattcttgaactcccggcctcaagcaatcctctgcctcagcctcccaaaatgctgggattacaggcaccagctattgtggcccagcctgataatcagtattaaagtccattttagaagtgtttggggccaggcacagtggctcatgcctgtaatcccagcactttgggaagccgaggtgggcggatcacttgaggtcaggagtttgacaccagcctgagcaatatgatgaaaccctgtctctactaaaaatacaaaaattcgccgggcgtggtggtacatgcctgtaatccagctactcaggaggatgaagcaggagaatcgcttgaacccgcaaagcggaggctgctgtgagttgagatcacgccacagcactccagcctgggagacagagcgagcccctgtctcaaaaggaaaaaaaaaaaaaaaaagaagtgcttcacgcctgtaatcccagcactttgggaggccgaggtctcctcaggcagatcacctgaggtcaggagtttgaaaccagcggccaacatggtgaacccctgtttctactaaaaatacaaaattagctgggcagagtgacgcgtgcctgtaatcccagctactggggaggctgaggcaggagaatcgcttgaacccaggaggcggaggttgccttgagccaagattgtgccaatgcacaatctatctaggtgatagagtgagactctgtctcaaaaaaaggcgggggggtggttggatacaagtattatttaatgacttaaaaattctcatctccatggtgaaagaccaattgcttttgaaatgcacagacattgttttgcgaggagttcagttctactatccaccagcacctggggattacatttagttgatagtaaataaatttaaatgtttttgatgacattgactgaaaaataccatgcacactaagacatttcaagttatgatggaggaaggcaattttttcttgtttttttttttgttggtctgtgttctactcacttattcttccctctgcaagagttatctgcggccactttgcctgtgttcctacagcacttcccatctccgccttggcaattgtgtctcacgaacgtgagacactcaggaaagagatgctggtctgtaaagttggaagagtctcagcgattccattggtggggcaaatgtgtgcagattgaggaagctaagatacactgggtgtcttcctctctccacctgctttaaccattgggagttcccctgattgtgattgtttcaggacgttgcttggatgttgtcatattcctagggttcaaggcactccgtgaaatccaaggaaacaagctttgggtatgtcccagtgccttttcccttgggtcttgcaactgaagaattgtgtttcttccctagaaaaacgaacacacttttgcccactcacccacctcctgcaagtctccaaaaccacagcgttgtatcctagactatgttcccccaggaggtggttcctccctctgcattcccgtactccatactgcttgatatgttcttacatgcaacaccgtgcaattgtgtttagttgattcctgtgaattagaatgagaactctacatgggcatggatttttgcctttcattcactgctgcattccctagtctggaaagctgtgcctggcacacaatgagtcctaggtgaaggtcagtgaagtcattaatgcttgagtcccaacaggcaaacagctggattcatgaatgaaagacttaccgctacatcccttcatcagggtgtatagcttcaactccatttcctggaaagctctacaatagttcttcctcctcaaaaggctctggtcttgtgattcatagcattcgtccaccaagacatgaacaagggatctttatgtcagaggttccctgttcaaagctgttttagaggccaggcgtggtggctcattcaggtaatcccagcactttgggaggccgaagtgggaagaccacttgaggtcaggagttcgagaccagcctggccaacatggtgaaaccccatctccattaaaatacaaaaattagccaggcatggtggcatgtacctgtaatcacaactacttgagaggctgaggcaggagaatcacttgaacctgggaggcggagttcagttggagttgcagtgagccgagatcatgccattgcactccagcctgggtgacagaacgagactccatctcaaaaacagtaaaaataaaaaagctgttttaggaaacatcccttttttattattttttctttgagtcagggacttgcttggttgcctaggctgaaatgcagtggcgggatcacagctcactgcagcctccacctcctgggctcaagcaatcctccgactttagcctcctgaatagctgggactacagacacacagcactccacctggctaattttttcttttttctttttctttttctttctttttctttttctttgtgtgtgtgtgtgtgtgtgtgtgtatgtgtgtgtgttgggacagggtttccctctgttgcccaggctggtcacaaactcctggccttaagtgaccctcctgccttgacctctcaaagtgctgggattacagatgtgagccactgagcccagccctaggaaacagcctcttaagccaagtgcaatgactcttgaactccccagagcctctgtgcatgctacctcgacttcagcttcacagatgtatgcaactgcgggatcaggttaggggcactcacttaccggcagtcccaaagctctggagagtctgtgctgagggaatggtccatgttaaagcaaagcagaacaaccactctgccttttgtattttatacttgttttttttttgaaacagggtctctctgtgtcactcaggctggaatgcagtggtgtgatcatagctaactgcagcctccagttcctgggctcaagtgatcctcctggcagatgggactacaggcgcacaccaccaagcccagataattttttgtatttttttgtagagacagggggtctcactatgttgcccagactggtctccaactcctggcctcaagcaatcctcccgcctccacctcccaaagtgctgggttgcacccggcttgcatttcacacgtttaataaactcaatcagcatgtttcctaccccctagagtgacaatggtgcacattagcatggatttcttatagatcgagaccaaagacctaattacttatctatagaccaatcttggagaggaaaggcagactccaagggttaattcggggtccaggaaccacagaaggaaggtctccttggatctcgtttgagcctgaagtagctcagtctatgacagacaccatcagagggcagaggcacaggtgaacgcagcagtcggaactttgtcagagcagcaaaggacatcttaggaaatgaggcttgcaaagcagccttgggttattgagaaagctctctcagcgtggattctcagggctctgggatcttctctgccttgcaggtgcctctttgttttttgggaggaagcaggtgggtctcatgtgtcagggcagtaaggagcaggaatgaatggatgaaacaaatctgttggggtgggtagcggctgtgctctggggagccaagagagagacagggggatggtgctggtttcagacaagatagttgagcaggaacttgaaagagaaaaggagagtggatcgtggggacctgagaagctggaattctccctggggaatcggccactgccaacgtgagggctggggttaggagcatgcctatggtgatggagaagcctgggggaggtgcctggttgatggggcaagaggagccatctggagagaaggaaaagcctggagtctccttccgggcttgcttaaggactagggaggggcaggacatgagatgatgttggaggattctgagcaggggatgggcctaggtgggaggtggggcagaaggagagctggacgaggacatggtgagaggtgatgttggctcatccaggaaggacggccaggaggaagcagagggaaaggggcatgcaaaggtccagaggcaggagcaacggggaacatccagggaaggagggaagggcaggggatttggagatggggcaccctgagagagggatccaggcagcaggcagacacgacagcctgagcttcaccccagctcacggttggccctgggagggctttgagcagaagaggggcaaacatcagcaatatgaggccacactgcagacgttctgggccctgcacacgcctccttgcaggcaaggcggccagcccacaaggtaatttaattcctggtgcctgtgggcgtcctgcaaagagccagttggcgtcggaacgctcttctccaaaacctgtgccagtgcccccagcgcagacctggtgtgaaggggacctttggagaggtctcatgagcaatgccgcgtgctctgccccacaggttacttcaatgatgtggaccgtgatgacggacgctacccgcccaggcccaggccacggccgcctgcaggtaggtgccgagcctccccagatgcgacacattgaatttgcacagagagggtgggatgagaggcctgaagttggggatgagagagctgaggttggggcagagttggtgacgagcagacgataagctggtgcaggggatgacagagaaggccccatggccgcatcagtggggtttgcggtctgggcatctgtccgcctctccaggctgggggactggatggaaacaaaatgaacaggcagaactggagggtccactgaaacacttgcggtcatttctgtttagacttgtatatgtgtaagtgtgggtgtacatgtccagacacacctttatatatctgcatgcttatcaatcttcatttgtgtgtatatagatgtttatgtatctttatatttgtgtgtatatatgcttttaaatatatataaatgcatctacatatgtaggtatatggtttttttcatgtgtgtatatacatgcttttgtatatatacagtacgtggatacctttctctgtttttatatatgtatatcctgactttatatatatccttatatatatctttacataggtacatgttttatatgtgtatatatatctttatatttatatgcagatatatgctttttatatatatttatgtatatgtatatcgtttaatatatctttttaaaaatatatcttcatgtatatctttaaatacatatacattttatatacattttaatattttatgtgtatgttatataaatatatatctttacatatataattaaatatatgcctttatttatatacatctttatatatgtacatatatacctttacatgtatgtgcctttatttatatatgtatatatttatatatacacttttatatatacatatgtgtatatctttatatgtgtgtataaatgcctttatatacgtacacatatacctttatgtgtatatacttttatatgtgttatgtatgtacacacaactttatatatacatgtgtatatatctttatataggtatataaatgtctttaaatatgtatatacatatcttttgtatttatttatttttttttgagacggagtctcgctctgtcgcccaggctggagagcagtggcacaattttggctcactgcaacctctgcctcccgggttcaagtgatgttctgcctcagcctcctgagtagctgggattacaggcgcctgccagcacgcctggctaacttttgtatttttagtagagacggggtttcaccattttggccaggctggtcctgaactcctgacctcgtgatccacctgcctcagcctctcaaagcgttgggattacaggcgtgagccactgtacctggtctatatgtatatcttctaatgtatctttatatatatctttaatatatctttatatacatgtacattttatatacatttttatattttatgtatgttatataaatatatacatttatacatatataattatatacctttatttatatatctttatatgtacatatatacctatatatgcttttatatatgtatgtgtacatttatatatacacttttatatatgcatatgtatatgtctttatgtgtataaatatcttcataaatatatttatatatctatacataacctttatatatgtataaatatcttatataaatatatattttatgtgtatatatgcattatttgtataaacacatatttgtaaatgtctttccatatatatgcatatatagcttacatatgtttctatactgttatatataggtgtatacctttacatatgtatgcatactgttttatatatgtgtatataggtcccttcatgtatatatgtatatacatttaggtatatgtgtgtgtgtgtgtgtgtgtatatatatatacacctttatatatgtacatttatctttatacacacagacatatataaacacttctaatataaagttttctctgtaattggaggtgaatgtctatcaataatctttcatatagaaatacaagtacagactataggagacagagatgcatacaacattgggctgaagagtgtgatgtttgaggctttattttcaagcatgtgaggtttctggcctgtttagttctgcaattttattttagaagacataaaggacttgtcccagatattttgcaaagctggacctgcatctttcggacaaccagattgcatccagtcatcttttctgccgtgtttacttgcaataaataaagagcgctgtcttaggatttattacaataacaatcaggaataaactaaaaattactagttatttttgaaaggagaagctgagaacatttacgattgagaccatctgctggaaggtcctcctaatccggcgtcggcgtggctgatctcatatcagtttctcggcaggaagcgggtgcgcctgcgtgaatttggagtccccagggtaaatgttagtcccgtgacggcaaagtgtttttgatagctagagctcagtgttggcatgagttttcccacggggaagaggaagctttggtggggccacccttgactctcccctgctggtcactctttggagctctcttggcagtgacacgttcacacgacttgttgccattcccaatgagctggacagaccaacacctgcaggaaaccccacgctcagacacctgaacatccctcaactctaccttctctgtctaacaggaggtggcggcggtggctactccagttatggcaactccgacaacacgcacggtacccctacatctgggcatgcgatggtgggtggagggtgggaggggtcatctttctagggctcccgcttgcactctgccctgggccttctacctggagtctttggtgagtagggtgctgtgtgctggtgcctggtcttctgagaacctgtctgtgctgggctgttctgcttctgttccccaggagggtgggtgcagccacacatacacacacgcatacacacatgcacacacacacacacacacacacccctttaggtaaaagtaaacagagcaaagaactatacaactaattagagaaagagagcatccaacaaactggagagcatccaacaaattctttaggggcgcagctcgcttacttcaagcagaatagaaaacactttcaatggctgggcgcggtggctcatgcctgtaatcccagcactttgggaggctgaggtgggaggattgcttgagcccaggagtttgagaccagcctggacaacatggaaaaaccctgtctctacaaaaaatacatatatgcaaaaattagccaggcgtggtggcatgtgcctgtagttccagctactcaggaggcagaggtaggaggatcacttgagcccaggaggtcgaggcttcagtgagcagacagagataagatcgtgccactgcactccagcttgggtgacagactgagatcctgtctcaaagaaaaagaaaagaaaagaaaagaaaaaaagcaagagaactcttttggtcggtgcttatgcccagagtgaaagccgtgttctacagaagccataaacaggctcttggcttggttgagtttttctcatggagaccaggggaccttgaaaccctcagatcctctccggtttggaaaacgactgaagcaaaatgtcatcactgagaaagaaaacaataacaaaacactctgtaggttgattttaaaccatcatctccgttttaacattttccctttgttaagagttttgtacaccttcaatgaattgagtaaccatcttttcttttttttttttttttttttgagacagagtttcacttgttgcccaggctggagtgcagtggtgtgatctctgctcactgcaaccttggcctcccgggttcaagtgattctcctgcctcagcctcccaagtagctgggattacaagcatgtgccactacacagggctaatttttgtttttttagtagagacagggtttcaccatgttggtcagattggtcttgaactcttgacctcaggtgatccatctgcctcagcctcccaaagtgctgggattacaggcatgagccactacacctggctaatttttgtatttttagtacagatggggtttcaccttgttggtcaggctggtcttgaactcctgacctcaggtgatccgccctcttcagcctcccatagtgctgggattacagacgtgagccaccatgcccggccttgagtaaccatctttttggttaaaactaatatgtgccaagagctctggtaatgtgggaagtacttttttttctttttctttctttttttttttttaagatatggtctcattaggctttgtgagagccaaggctgttggccccctaagttttctctgaatcactgacatgaggcagcttaattaacaggagaaaaagcgtataaatttattgagtggatatacacgcaaaccttcagaaccaagactcaaccaccaatgggatgcaaaagcttatagaccatcttttttaactttgatgttaggttcaggggtccttgtgtagggttgttacataggtaaattgtttgtcaccggggtttggtgtacacattatgtcatcacccaggcaataagcatagtacctgataggtagtttttccatcctcactctactcccaccctctgccctcaagtaggccctggtgtctggtgttcccttctttgtgtccatgttgtcaatcgagaaaaatgacgagacgagcgtaaaagatttatttgccaaagttaaggttaagggcgcgccccaggagacaggtctgtggccttctccgaagatgattttgaaggctgcaaatttaaaggggaaagggtgggggtagggaaaaagagttattcatgcttttgtctggctcagtgaatctgtgtttttttacataagatggcatagacaaatggggcagagggaaaatgcagggaatctgcatgttgcataagataatctggacaaaatggggcaggggagcaatcacatatgatttgtgtctgctgggcgggggtgactgcaaagctgtcgatttgcatattgtcatggtgaaatcttcacagctcactaggattttccttgtgggcaaaatatgggggagacgtgtagcttttcatcttgtagccattttatttaggaaccaaaagggggaggcaggtttgtgtgacccagttcccagcttgacttttccctttgactaaatgagttcaggatcacaaaatttaatttcctttcacaatgcgtactccgtgtttagctcccacttgtaaatgagaacacatggtatttggttttctgttcctgcattagtttgctcaggagaatggccaccagctcgatccatgttgctgcaaaggacatgatcttgttcttttttatggctgtgtatatgggccacattgtatatgggccacatttcccttatccagtctaccattgatgggaacctaggctgattccatgtctttactatttgagtttgctatttgttgttctttgcaggaagaatgtgggctcagagcatggccccaaataggtgacgttggtaaagcaggtttaacgggtggcaagccaggtgatgagagggagacaggaagaggcctgcttagcaagggggtccttgttatgcagatgaaggttcccaggtagcagcgctcagagacgaccatggtaaatgtttcttttcagacctgtaaaggtgtcagagtctccgtttctctctcctacatccaggaaaagcttagaaagggaaggcctggctgcaacagcaaagatcctctacagatgccaatttccccacctcagtctgctggccctggagcggcaatttcaaaataaggcaaagcaatatattttggagtaaaatattttgatgtccgtcatcttcgttacctcggaagcgagtgttgtcatcagatccatttaacaaaatgaaagcaatgcatgacgctcgactgtccacttcaaaggagcaatagctgtggccctataggtagcccatcctcagaactcactccctatgacacagacaagcttcaggatgggagggggctcatgacaaagtgctcattacctggggtcaagaactgtctacttttggccgggcatggtggcccacgcctgtaatcccagcactttaggaggccaaggtgggtggatcccttgagttcaggagttcaagaccagcctgggcaaaatagtgaaaccctgtctctacaagaaaatacaaaaattagctgggcatggaagtgtgcgcctgtggtcccagctactcgggaggtgtaagtgaccctggaagtttgaggctgcagtgaaccgtgatagcaccactaccttccagcctgggccatggagtgagaccctgtctcaaaaaaaaaaaaaaaaaaaaaaaggacactaaaaaagaattgaccaccttcaactcaacgtactatgagatgagttccttccaccatctttctggaactagctaaggggttccccttacctactacctaggtagacctgatttattaagacgggaatcgcaatagagaaagagtttaattcacacagagctgactgaacgggagcatgtgaagcagctatgctgtctggggtacatacctggggttcattgttgcacgctgagaaagaattcaggacacagacacatgtggttgggttaaggagttgaaagtttaatagaagaaaggagagaggagagcagctccttgcaagagagagagggagagagagaaagagagagagagaaagagaagcatctgaaaaagttgggaggttgtggaccgcagcagcttttgtaggcaggctggaggaggtggtgtctgatttacatagggcttacagactggttcgatcaggtatgacttctacatagtgcgtggggaaggctggtggccccaccctaattttgttatgtaaatgggctttccagttggtcagtgccatcttgtctgctacttactgtacatggggctgacaaagaggagggaagatgaagctgccatcttgaacgtgtctaggccctagttcctgccggcattcacccatgtaagctcctagctggcttgtctatgtctgcagctcaactttattttttattttttatttttttttgagacggagtctcgctctgtcgcccaggctggagtgcagtggcgtcatctcggctcactgcaagctccgcctcccgggttcacgccattctcctgcctcagcctcccgagtagctgggactacaggcgcccgccaccacgcctggcaattttttctatttttagtagagacggggtttcaccgtgttagccaggatgatctcgatctcctgacctcgtgatccgcccgcctcggcctcccaaagtgctgggattacaggcgtgagccaccgcgcccggccacagctcaactttacaggctgctctttgttagaaaatgatttggggctgcttttcattaaaaagaaaagccttaccaaggactcccatacccttgctatgtgcctaagtaattaactaattccttcttaactcctatatcaactggaggttttgcttttttttctttaaacagggtttcattttgttacccaggctggactgcagtggtgaaatcatagctcactgcagcctcaacctcttgggctcaagcgatcctcccgcctcagcctcctgtgtagctaggaccacaggtgtatgccaccacacctgcctaatttttaaaaaatttttgtagagatggggtctcactatattgctcaggctggtcttcaactcctggcctcaagtgtttctccgacctcagcctcccaaagagctgggattacgggcatgagccactgcacctagccaagactggagttttatgactcaaatcagcttcccccaaaatttggacactgggctttttaacgtgtaatttggctggtaggagacccgggcgtggggagtgctgagtggttggttggaggtggaatgacagaggacggacatgggttctttttgttgtcttctgttcttgtgtgggacggcagagctcgctgagccgcattaccagtctgggtggcgccggctggtgcatctcaatgaagggtttaaaaaatgtctcaacttcaaccttaggttttacaatagtgatgccatccctaggagcaactgaagaggtttggaatcttgtggcctccggctgcatggctcctaacctattaatataatttctaatcttgtgactaatttgttagtctttcaaaggcagtctgatccccggggaagaagggagtttgtttcagaaaagggctgttatctttgtttgaatgttaagctggaacttcctcctatggttatctgagtctgtgttcaggaatgaactagggctgttcgagggctacaggcacgatgcagtcggttaggtcagatctctttcactgtcgtaattttctcactgttataatttttgcaaaggcggtttcaatttaactgaaaatgtcaggcaaagaccaaatttaatatttttacagaaagccactgggagtagttttttattgttttattatttatttatttagagacagagtctcactctgttgcccaggctggagtgcagtggtgcaatcatagctcactgcagcctcaaactcctgggctcaagcgatcctcccacctcagcctcccgaggagctggggctacaggcacacaccatcatacccagctaaatttttaagaaattttttgtagagatggggtctcaccgttgtaactgcccaatgggtttaccttgccccctgcctaaacagggccgatttatcaagacagaggaattgtaatggagaaagagtaattcatgcagagccagctgtgcccgagaccagagttttattattactcaaatcagtctccccaggcattcagggtccagagtttttaaagataatttggcgggtaggggcttgggaagtggggagggctgattggtcaggttgcagagggaaccataggggggtgaagtgaggttttcttgctgttttctgttcctgggtggatggcggaactggttgagccagattaccgggctggctggtgtcagctgatccatccagtgcagaggctgcaaaatgtctcaaacaccgcgcttacgttttacaatagtgatgttacccccaggagcaatttgcagaggttcagactcttgagccagaggctgcacgacccctaaaccataatttttcttttcttttcttctttttttgtttttttcgagacagagtatcactctgttgcccaggcttgagtgcagtggtgtgatctcggctcactgcatcctctgcctccctggttcaagcaattctcctgcctcagcctccccagtaactgggactacgggcacatgtcaccatgcccggctaattttcatatttttaccagagacggggtttcaccatattgttccggccggtctcgaactcctgacctgaggcgatccaccctcatcggcctcccaaagtgctgggattataggcttgagccactgcgcccagccctaaactataatttttaatcttgtagctaatttgttagtcctacaaagtccaactggtccccaggcaagaaggaggtgttttcaggaaaaggctgtgatcagttttgtttcagagtgaaaccatgaactgaattccttcccaaagttagttgggcctatgcccaggaatgaacaaggacagcttaagggttagaagcaagatagagtcggttaggtctggcctctttcactgtcatcatttcctcagttacaatttttgcaaaggtggtttcgccacgttgcccaggctggtcttgaactgggctcaagcgatcctcctaccttggcctccataagtgctgggattacaggcctgcaccaccacatccggcccaccttggagcgtgttatataaagcgagccgtccccacacccctacagcctacgaatgagccttttcaccccatgcacgattctctgaaactgctctctgtaaggagctattcgggacacgttcttttgttctctggcatactcatcaggtagaaagaagtgattcagcaagcggctcccctgagagccctgatcgtttcctgttttcctgtgaagttagtctcgggaggtctgcgctgtgccatttttgggggaccattatctggctcccgaatggatcaaagcttactggtcagggggctgctgtatccctggggcaaaactgccagaaaatagcaggtagccctgtggtccttggcagggccagggcccggtggaagcagcagctgggccaagaacatcaggcgtgcatgaggcacagcccagttttgggagcatgacgcttgttttcgaggatgcctgtgctccccttcctgcctggacccctgctctccagccccggcagagcgaggctgtgagtcagcgctcggattagcatcagcatggaggtgccggctgggatgcaagccgccgccatgggatgagtcacgcggcttctccccgaatccccaaaggaggcagagcgtgttaggcttgttctggcttcatgcagagcactgaggggtgagggctgaccgtggctggccgcggagggaagcccaaagtctggcctccctgcggagactggggagaaaatgttgcgctcgtcgtttttaaatactgggggacaagtttcccttgtctgctaaggctgccattgtaaattacaagagtcaggagggctgaagcaaaagggatttcttctcccacagtcctggaggctggaagtctgagatcaaggtgtgagcagggctggttcctcctgaagcctctctccttggctcgtcgacatcatcatctccctgtgtcctcacagggtcgtccctctgtgtgtgtctgtgttccaatctcctctccttatgaggtgtcttagtccatttcaggctgctatcacagaatactatagactgggtggcttagaaacagcagacattgattctctcaccgtcctagaggctggaggtccaagatcaaggtgtgagcagggctggttcctcctgaggcctccctccttggcttgtagacaccatcttctccctgtgtcctcacagggtcgtccctctgtgtgtgtctgtgtcctcatctcctcttcttataaggtctgtagtcctattggattagggcccaccctagtgatctcgttttattttaatcacctctctaaggacgttgtgttcaaatacagtcacagtctgatgccctgggggttaggactgcgacctgtgaatttggagggggatatagttcagcccatagaacccactatccacataagtcattccacttcaaaatcagcacaaagcattagttttaaaaatctcaaatctgtatttttaaaaattgctcttaacacattagaaaaatatagaaaaactttttttgctgtttttctgagacaaaatctcactctgtagcccagcctggagtgcagggacgtgatcatagatcattgcagcctccacctcctgggctcaagcaatcttttgcctcagtcgtctcccaagtagtagctgagactacaggtgcacatcaccacacccagctattttttttttttaagtagaaacggggtctcactatgtttctcaggctgggctccaaatgagctcaagtggtcttaccgccttagcctcccaaagtggtaggattacaggtgggagccaccacacccaacctggaggaactctttttttttaaaattttaaataaattactatttgtggcctgcgttttcatcctattctctttttttttaaccaacatttgctggcatttttttttatgccgaagaaaacacctttgcccatctatgtcaggcctccagaccctcagggatgtacatctaatgcaccttcagccaccggtgtaaacagtaaacaggggccagatggcgcctgtgcaccttccctggccttgggagagcattggaatctctgcagcttttaagagcatcttgcttcaggtttgctgacctgcttgcttctgtaagatcatgcagacttcctgagcaatatctagcatttcatggtctcttttctatcctgcaggaagagggggctatagactcaactctcgttatggaaatacttatggtaaaggaattatgtcttacagaatatgtgaggcaaaactgtccatttgcaaataactaacacactgtctgcactgatgggaagctgatgctttcatccagtgcacaaccaactggccgttcgagtctctcatttgcattttccttggtcatccatgctggggggagatgttgtgcatgccctgaggacttcatttcttcaaaggaactatggcccacttacaggtgttactgggtgcatgtgtgtgcacgtgtgtgtgtatacatatgtgttcacacacaggtatgcttgtgtgtattgtgtgtgcatgcatgtgtacatgtgcatgtggattttgtaatcatgtgcataagtgcatgtggatttcatgtgcatgtgtgcaagtgtctgtgcacacatgtggattgagcacatgcatgtttgtgtatgtgcacagatgtgttggcatgtacttgtggattttgcatgtgtgcatgcttgtgcttgggttgcatgtgcattgcatgtttcccatgtgtgtccattcacatgcatacatttaggggtgtgcaagcacatgtgtgcatgtggatagatgcaggagtgtgcatctgggtgtgctcgtgtggtatgtgcatactgcacgaatatatcatgtgcatctgtgcatgtggattgtgtgtatacatgcgtgtgtacaggcatgcacacacacacatgaatgtgtttgtgtgtgcatatttgtgtgtacatgcatgtgtttatgcatacaggtgtaaacatgtgcacacatcggtgtgtgcatgtgcacacatgtgtacatgtgtatgtttaggcgaattgtgctttatatgtgcttttgttgcctgtgtgtgtggtatgtgcatgtgtgtgtatgtggggatgtgtgggatgtgcatgtgtgtggatgtgcacattgcattgtgcttctgtgttgcatttgtatttacatgttgcacatgtgtgtaaatgcatgtgtgtgtgcacgtgtgtatgcgtgcttgtctgcctgtgtgttgcacgtttgttgcatgctgcatgtgtgtatgcatgtgcacacacatttgtgcatgtcagtgtgtgttgcatgtgcttgtgtatgaatggcgtgcgtgtgtgcatgtgtgtccatggggttgtcagcctgtgtgtgttttgcatgcgcatgtatgtagactctccaatcctgaaattaaagctgcatctccctctccctggtattatccccattctgctaatgaccattagacatggcatacacattcacattcctcctccttatgctgcttggctgtccccctccccccacaagaatgtaaattccctgaaaacagggatctgtgtgctgtgttcacagtcgcatcctcaacagtgcccggcaatataaggccctccataagctctgctgaataaacacgaacatccttttccgcttacaggtggagatcaccattcaacgtatggcaatccagaaggtaactgattgactcacccggtcccaacctttaataagagcacactctcctagatcagtgctgggaggagctgtgtgggcttctgtttcccaacctcatgactttcacggagcactcatactttgtatgtatataaagtagctcctgaataaaaatatctgaccttcagcacaggaccaatcagagttcagagaaaggagaggcaagcattggttttcactgcagaagatgccccttagctctcaaagcaaggctgtgaatgagtgctgagactattacatttctcccagtaccaccattactcccctttctttgaccagcactaacttgaaacccaagaaggacaggagaaaggaaggtatgaacactctgcccaaagaagccatcagagtgcactgtcaatcccgtctcaggtcaaaggagggagaacttgaagcccagaaggctgactttgtgtcctgtattgttgggagaacaggttccccattccctaagggtcatattcttagagatttgggctgacacctgcttgagtttaagttgagagtaaacgcactcaaccccaaggctcttgtgagttttcaattatgggggaggagaaagtgattgaaggtgacctctacctttcaatgatcatgcagagtactagtatcaatatttttggggtatgttggcatccttagaaaaatttatggtttcacctttttccctctgtggtgtaaagtgaggtccagagatggaaagggcaaggcaaataaacaagtaattgcagtcaaatctgatgaataatttcctggaacatatgggatcctgtagcaaggcagaagggatactcctagactaggttaggtgagggaggtagggtttcctggagagaacaatatccaagccaatcccccaaaatatgggtgggaggtgcccaggagaagagtgaggtgtcagggaagatggtgcactaggtagagctggatacacacgtggggacaccggaaattgtgtagccaggatgtggaatgcaacgggaaccagggaaggatgcaatggtgaccaggaaagacctccaggttagcagaggtggagtctgcacttcatagaaccttcatgggaaggagcctgcccctgttgatatgtaggtgaagaatggacctgagggggctcactaagacccagggagacaccctttcagaccagttcagtactccctggaaatgatgacaggctgaattaaagcctgggcaaaggaggcaaagagaagcagtcagcttggatgaccacttggtaatgacaattgattgtacttgattgatttgtaagagatgagagagaggaaaaggtatgtatcagtcagctatgctgtgtcacaaaaaaccccaaaacttagtagctggaaataacaaccatttattatgttcgtgattatgtgagtcagcaatttgggctgacaccattctagtggtcctcctggtctcttctgaactccctctcttgtgtgcagtcaactgtaggtgtggccagcgctttgaccatgtttcctgggtcttcttatgtatctgggactttaggtggaatggctcatctcagcttcatgtgggctctcacatccctccaggaagccaggccaggcttcatcacatggtgaccagacagggtaccaagagcatgaagagaagcgtgcctgggcttagagccaccatgccttcacttgtgtgacattctgttggctaaagcctggattttcagaatgaagatgcagctccacctctggatggggaacactgtgaaatcatactgtggagcgtgttcatgtagggaggggaagaatagagggctgtctctcccaggaggcagggtgtggcgggcggcagcatcagccgtagagcaggttcttgcgttcagtgacaacactcttccccccagcatggcagcctcattcgtggagcagtcttgtgtccctcacctatgccatgccatgtattggcccaggtgttcaaccctgtctgaagaaagccatgcatggaaagggtggctatttcaaatggaaacggtgatttcttccttttttccctttggaagtgttgatttttgtcacatcaagctccttcttgttctttgtgcaggagtgccaaagctctggagcaatttgccatcgaggcattgaggatgcttgtgtctagtgtgtgcttgggtctagagttccagcatgcctttgaaagcaagcctatctggcagtttttagtggaacaatatttttgcatgagtgggcattctacatctaaaaaggcacaaaatagttttgacatgtgcctgtcatcccaactactcaggaggcggaggcaggaggatcacttgagcccaggagttcaggacgagcttaggcggcatagtgagaccccatctctaaaaaaataaatcaggccaggcgcggtggctcccctctgtaatcccaacactttgggaggctgaggcgagtggatcacctgaggtcaagagttcgagaccagcctggccaacatggtgaaaccccatctctactaaaaatgcaaaaattagttgggcatggtggcatacacctgtagtcccagctattcgggaggctgaggcaggagaatcgcttgaacccgggagaaggaggttgcagtgaactgagatcacgccactgtattccagactgggcgacagagcaacattccgtctcaaaaaataataagaaataaataaataaataaataaataaaattaattaaaaggcatacatgaattgacttcaacaaacaaacaaaaatgccaagtgcctcgtctgtgcaaatcctggccttggatgtcttcagtggtaaaatgtggttgacaagcttggctctttgtgaaaacagaattacttcctaaggtttttttttctttttttttaaattaagtttctcttttttttctgtgaatacaagggtgggaagggacgtgatggagaagttactagatagatgcaaaagttattgcagtttttgtcattactttcaatggcaaaaaccgcaataacttttggaccaacctaatatttaagcagttttcctgcagccatgtttttttctcggatgagcttgctttttctccactcctgcaggcaatatggtagcaaaaatcgtgtctcccatcgtatccgtggtggtggtgacactgctgggagcagcagccagttatttcaaactaaacaataggagaaattgtttcaggacccatggtaagtttggctctaaacattgttttgcttgttactaagcctgatttaaaaaaaaaaattactttcagatgtctgtcactagcaaggttatttctggttaagttcaatatacataacttgcctaataatgtgattttttaaaatttatttttattctttttgagacagagttacactgtgttgcccaggctggactgcagtggcaggacctcggctcactgcaacctctacctcctgggttcaagagattctcttgcctcagcctcccgaacagctgggactacaggcatgcaccaccacgcctggctaatttttgtatttttagtagagatggggtttcaccatgttggccaggctggtcttgaactcctgacctcaagtgagctgcccgccttggcctcccaaagttctgagattacaggcgtgagccaccgtgcctggccaacaattgggttttcatggtcaggtgtgagctgtaccttcctctaaaccttgttacaatgaggctggcacattatctgtctaatgtaaaagaggaggagaaaaaaaggaaagaaaaagaaacaaacaaacaaaaattaccaacctacattgcaagactataagcatgacggttggtttaactacctgttctgttttgtattcagtgaaattttcgtcacaggcgagtcaggaaaaatacctgggttgaatgtgaatgttttgcccagaaccccacccgcaaagaaaactaccgaaacactgaattataagcctctctgaaattccgaaggtgcgctcagaccataggggagaggaaagatctgctgtggcttcctggttcaatgccggctccacactcctgggtttgaagaatcacttgggatttgagagcagaggatgccctaaagaaatctctgaaacaacagtcagggattgttttatagcctaaagagtgactcagatctttaactgggtgtctctggaggcttggtttaaacctcaggccacccacgtcagaatctgtctggagtttgcccagggccctctaactcataccttctttgtgtccccgaaggaaaccagaaaggggtgcccattcctacggtgtttgctttaggatttgcatttggcctcaaaaatcctaaaaccttcccatgcgctccctctgctggtgaatgggcagtatcaaccgttagctaatgaacctccgtttggggtgagcctccgtctacattacgccccgtcctgaaattttaggaggaaactgagtttctgaaaaactgccttattttcctggcaacctgagagcagattcttgggttcagtgacaacactctttcacccaacatggcagccatcattaacgaacaccacgtgttaacttcagtagcttttgtggcagtgatttgtaagcctttgttaaccaagggctgaaactgagtaagcagagagaggcacccatctccacaagcacaaaatgtaagggcggggtacaggggtcccccacaaactcaataatcaaggcaaatatattttagtgcaatattttagaaggaaaatcattggaatgggggccagttgagtttctgaaataggtgtagttttaaaaacgtggatgatgcctgccccatttatctgaggtggaaggaagcacgtttttgctaaagaggtataatgtcttgaagctctttcatgccttttggctgcctggtaagtatttttgtctactttctccattgtacttcgatgataccctcaccaggtattcccaagcaccaagtttatcttcccctcccttaaagttcctgagatcagaaaggaggatgtagacagagtgagctgatgttagggagatctcttcaagggtgagcagtgacatttatgtggatcctgggcctatatcacctcgctggctgtaaagcctttatactatctaggaaatatgtgcatgacagcaaatacgtatgggtttggtatcaaatggggctcagagctctgcgaacttgactctaaagttccaggctgctgctaatggtacccagctgtccacctctccttagttaggtcattaattttctctgtctcctaaaggatgacgtacatggtatactaaccatatccatggtgatgtggtgcagtgcacaacctgtggaactgtgtacctgctgaggccatacactgaagcttgcacactttgtagagaaagagttgtagtaacagagctacacagatagaagcagatgtctgtcacttgatgtggacttttaagaatcatactttgcttttattttataaagtggagcaaatgacaacatcacttcagaagttataaagaccaacaaggccatattcgaaaaaagaagttcctacaaatattagttttaaccaaaaaggaagttactcaattcatttaagatcatcaaaatccttaacaaatggcaaaatgtcaaaaacaatgttttcaaaacgaatatttgtttccagatatgattttaacagtttttaaatattttctatttttaatttttcctgctttattgaggtatagttgacaaataaacattgtatatatttaagatgtacaacttcatttctgcatcatttatttgttctaatctatctccttctgccgaatgtaaagcaggtgtcatgtagacagcacatagtctgatcttggttttcttttttttaaaatagatttttcattcttctagctttattaaagtatgatagacaaacattgtatatatttaagatgtgcaacttcatttctgcttcatttttttctgttctaatcttccttctcctaaatctagagcaagagtctcttgtaacagcatagaattggatcttggttttctttttctctgtttaataagacttttttttttgcccccacaatgacatttgtttctaatcttcctttcagaaccagaaaatgtctgaagatgttaagatcccctgattactttgagaaaaacaactaaaacaagaaccgtgtttatcactgttgtggagatttccttttattcttgacacaatttgatgacctaaagtgtgttttcttctgtgtaaagtacatgagctgcctcactaagcattcccaactcattgaatgtgatgtggttataaagataagttaggcagctagaccctgcgttctaaaaaaggattgcttgcaatgttggtttggctattcatttgcacaaagagactgtggctctctgttgtgagatcttcagctacctcatggtgcaataacacacacacgcttaaccatgttgatggcacaaagcggtgagcagtagggaggtagaatatcttggtggggaggggatgttatcagcttctgggagatgaagaatattgttgaggttccaaagatgctggacctgtgctaaattcttcagtgatatgaaaaaatcattgagcattcattattgcgaatgaagtggggatgcattatttctgacacccacaagcagggtttgatcatcctttcagctttgagatatctgcacataaaattattattacctgaagaaaataaggctgcattttgaaatgttaagtgcaaaatgactgatgttaaaaccatctgggggaaatcttgggatgctttttcctaggaaatcatatggttgtgatatgttttggcgcataggagacagaaatagtgattatcaggcgttgagcctttttgtagtatttttagtctttgatactctgtaagtgctagttcctaaggcaccaacattgcattccttggtttatactttttctattcatcagggtaggaagtcttaaatccttaggcatccaagaagtatactagctttttgcttctcttttagaaatacttgtggggagagaaaaaaggatggtttgggcatattggtatagtttgagtaaactaaggttaatgttcatataacatttagactttgccataaatatcagaaccaaagatcaagacattcatgtacagtctggaatgtatatatggggcccataaaaattcccagtatgcatgttttatgctcaccattatgaattggggtcttcaaagagagaaggttgaaagtggaaagcacttgaaagggctccccggtttgtaaaatatctttaatcattcacattaggtacctcggagttgcgggtctcaaatgtggattcatgcatcatttgtgcagtttgaagatagtccatatttcctatttcagtattaggtcctgcaacacttttcaattcttgtagaaggtttttttcaggagtggtgatgtctgatgctcaattactattttccctataagagtttcagcatgagcttaattaaattcttgtgaaaaaacctgtgtttttagttacacacacacacacacacacacctacttaaatggaatctaaacatttttagcctttaatccattccattttctaaaactgtcataaactatttttaatcattttaaataaatgtaaaagaaaaataactggatttgattattgaatagtttttttctatatttcacaaataaattgtatgaaatgactgtagaagtggccccaaaattatgaaccttcgtagctgtgaatatgatgccataaatctcttttaaagctcaagatagactatgaacatatgaaatacatagttacctaatcatgagactaaattcacctgggtgacaaggctaacgttcaagctacttaagatgaaaatatttgaatcatgattgcttgggggaacctctctttgaggggtcatgaggaccacctgctgggcattctgttttcatgctgagaaggtgagaattgaacagatgagaaaagccttgataaaacgtcatctccatgtaatttagagaaggataaccttgactgtacagctgacccttgaacaacacagggctgaactgcacatgtccacctgtatgtgagtttgcttctggctctgccattactgagacagcaggaccaaccctccatctactcaatgggaagatgataaggatgaagacctttatggtgatccgcttccacttaataaatagtaaattcattaattttatcttccttatgattttcttcataacattttctttcctctagcttactttattgtaataatatggtatgtaatacatatacaaaatacgtgttcaactgttaccagtaaggctttcagtcaaccagtatgctatgagtagttaagtttttggagagtcaattcatacagcccttgatttttttttttttttcaattaagttcatttagatggtcagaaatgtcagttaagcgtcatttgaaggtaataactaaccttgaaaaactagtggcttgggtatagttttccaaaaagttaggctgggcgtagtggctcacacctgtaatcccagcactttgggaggcctaggtgaggggattgcttgagcctaggagttcaagaccaggctgggcaacatagtgagacccccatctctagtaacgatttaaaaattagctgggcgtcgtagtgcacacctgtagtcccagctacgtgggaggatcacttgaacacagaaattcaagaccatagtgagctgcgatagcaccactgcactccagcttgggcaacagagtgagactctcaaagaaagaaggaaggaaggaagggagggagggagagagggaggaaggaaggaagaaaggaaggaaggaaggagagacagagaaggagggagggaggaagggaaggaaggaaggaaggaaggaaggaaggaaggaaataaatttgattcttttcgcccataaatttgtgatgaagcaccagttttggaaagcttccctgctttggtagaaatagcagatggcaagattctgatatcttctactatgaagttcaaagcagtcagaagtgggcagcttggtttttctgaaatttatcattctgacatcggactgagacctagaggagattttttaatgccatctgacagatctaaaatacatcttctaagagtactatgcaaaagtggcagctgtcctgtttgcttggcttcattgatccaaaccacagggttgacaattttccttcacatggatacagtgagggattctgcagttatatgaggcatttgagtcaaggtgatacttgcttcttgattccacagatgccactttttgcctttgaggacttgctaaagagttcagacttttcctactgtatgttttctgtgcagaagtcatgttgtgtggtgaggaccatggattttatttcatttcttaacctttctatgcaaatgagaccttgaggctgcagagaacaaaattattgggatgcacaaatccaaatggaaataggctcagtttagctaaggaggacacttgtgttatcttgtgattctaatgacgttcaagctttaatcacaacattttcgtgcaaaaggaaaaatacatatattatatacgtgtgtgtgtatctcctgtaaaataaaaacaatatattgtattaaggaggccttgcagctgttgtccttatagcttcagaaattttatttttttcaatatattattcttaggtctgtagtatgaaagttcttttaaaataaactgtacaacaatttcacaaaatattcaaaataaaaaagagggagtgtttggatattaattgtcactaaatttaataattaaaatactaaaaattttacaaaggggtgaccacactaaaattcatatatccccaaagatctcttaaaaattagatttttcaggctgggtgcagtggctcatgtctgtaatcccagcactttgggaggccaagatggggggatcacttgaggccagaggttggagaccagcctgggcaacagagcaagaccccatctgtacaaaaattttgtaaaaattagctggatgcagtggtgtgtgcctgtagttatagctacttaggaggttgaggcaggaagatcacttgagcccaggagttcaaggctgtagtgagttatgattgtgccactgcattccagcctgaggaacagagtgagagcttgtctctaaaaaagaaaaaaaatagatattttgaacattgcaaaagcctacaatctttttaatattgattactttagttaaattcttctccatttaatgtgattttagaagtaatccttttacatctggaaaatggagaataatttattatttcacccagagaatgataaatcaatcaatcaaaatatagcaatctagaaagctaataaataatgttctaattagggagacctactgccagtaggagtaatagataataacaatactatttgctgaatcattttattttagtagaaaaataagctttcaaagtaatttatttacttatttatttatttttgagatggaggctcactctgtcgcccaggctggagtgcagtggcacgacctcggctcactgcaacctccgcctcccgggttcaggcgattctccctgcctcagcctcctgagcagctgggattacaggcacccaccatcatgcccagctaatttttgtatttttagtagagacggggttttgccatgttggccaggctggtcttgaactcctgacctcaggtgatctgcccgcctcagcctcccaaagtgctgggattacaggcgtgagccactgcgcccagccttttaaaataatttacatactttacacatgtacacataaaaatggatgttggttggatgtggtggctcatacctgtaatcccagcactttgggaggtcgaggtgggtggatcacttgagcacttgagccttggagtttgagaccaagcttggcgacatatcgagactctgtctctacaaaaaaattaaaaaattagctgggcgtggtagtacatgcctatggtcctagctacttcggaggctgagacaggagaattgcttgagcctgggaggttgaagcagcagtgagctctgattgcacaattgcactgaagcccaggtgacagagcaagaccctgtcaaaaaaaaaggatgtcagtgataatgagttgtttataaagatagaattagagttccagggatgactggagaggtatagtgtattataacccctaccatgtgcccgtcagggactggtacttaaaagtcaaaacagtaactgcagaatttgagaggtgtacaaagatagtctctcaaatagtgctcagttattagttcagcgatggtcagtttgtgcatagctatgaaactagcttatcacggtaaaaagtgtgtacgcttcactatcttgtagcatttagtttcccagcagggccatgcgacacccagtggacatttctaaattgtacattcaaaaaaatgttaccactggctgcaacatttttttcattaaacataaaagttggtcttgggggtgtcattcaatgccttttctgcttccttcagaattctaaaggcttccaccacaactttgatctgagcccagttatgaacttcatacaaagctgcagggaggagcctgtgtctgttgaagaaaggctcacaagatcccatggtaaggggagaggagaaggggtaatgaggaagaaaggcagctttccaggggccgagtccggaagaccagacttgtcagagaatggaactagcttgtccagtctcagcccatgagagagtttcacgccacgtgctattctggttctgaacattgagcacttgggtgacttggaatggcctccatctaagctgcatcttcccccatagttccaaatataaatgcaatgcattccctgggttcctgccagccattgtcacgtttttgcttcacagctgtctcctccctgctccccgtcctattcatctgccccttgctagacaggtattcatgaaacatgactgcttgtttatgaatagctgggatgtagacatgacatacggaaagagaagctgccaatttttccccaaccaaaagtgaaaacagtgcttggacctaacaagcatagaatgtttgatcccatagcagagctggtgggaaggctgggggcaaaatctgacactgtccaccattggctgtagaccaaagggaggctgcagaccaaagggaggccgcagggaggtgagatcatttcaatcgcaggtccccacccactacgagcacttcctcacccacatcctctgttctaatcttttctgtctatctcttatcaacttccaacatatgataacgtatcaccttttattgtttctctcccggctccatccccactagaatgcaactgctacaaaggcatggatttgtccccagtttccagaaacatgactggcatgtagtagatgctcattaaagacttatttatttatttattgagacaatgtcttgctctgccgcccaggctggagcgctgcagtgtgatcctggttcactgcagcctcaaactcctgggctccaacgatcttgtcacctcagcttcctgtgtagctggcacaacaggcatgtcctaccatgcctggctaatttatttattgtttttgtagagacggggtctcactgtgcttcccaggctggtctcgaactcctgggctctagtgattttcccaccttggcctcccaaattgctgggattacagacttgagccaccacgcctggccctaaagacttattaaacacacgggaaaatgaatgaatgaagccctcgttcaggccacaactttaataatattaaagaggagatattttcttttggtattctagctaaagacttttgggatgagatggatagggatattaacaaatgtgtgtgtttttaaaaaatatacatattatgaaataaaacatctggaagacctccataactcaatgaaccaatattctacaaatgacccatgtgtgaagtggcagaatcatgaatggataaaaggtttgtctgaagcttaagataaacctgtgggttttaaatgtgtagactttaaaaattcagtgataggatttcagattccacactaccttatctttgagaagctattgatgatcaagttttgtcatcaaaggagaacattcacagttatttgaaaagattactaaaatactttttctaactatgtatctttgtgaggctagattttcttcatctactttaacctgaacaacataaggaatgctgatctgagaaactggttgtctcctcataagtcagatattaacaagatttgtaaacatgtaaaacagtacactcttcccctatgaaaatttttctgtttgaaaaaatatatcccatttttcataaaattatgttatttatgtaaaatgtagtggatttatctttaaaattattaaatagtcaaaaacttcattttaattttagaaaatatagaaatattaattttaatttattacagcgttaaatttaatgcaatataatttaattacagaacatgtagacatttacaatgcacaaaaacaaaagttcctctaggcccttaatcattgttaagagggcaaaagaggcagggcgcgacggctcatgcctgtaatcccagcactttgtgaggccgaggcgggcggatcacctgaagtcaggagttcgagaccagcctggccaacatggtgaaaacccgtctctactaaaaatacaaaaattagccgtgtgtggtggcacgtgcctgtagtcccagctactcgggaggctgagataggaaaattgcttgaacccgggaggtggaggctgcagtgagctgagatcacgccactacactccagcctgggcaagacagagagagactctgtctcaaaacaaaacaaaaaaagaaggcaaaggaatcctgtgaccaacatgtttcacaatttctgcttgatgttataaatgatggcactttcccccggaaatctctgcagttttatcagtctccctccctgtctgaccacctcaatccttttctatctctgctgactcaaaatggttgaagcaataaagacagcatctgtaacaagatgtacttagattcaggacctctgggctgggtcagtttgagggcttaacaatgtcctccagtagccaggttctctgtgtcttgcagtcctgtgtttcataagtcatcggcccatttcactcatggcagaagatggctgctgtacctccagccatcacagcctcatctactaatatctggaggcccaattaggatcatttcctcccagattttctcttttaagagcaaagacattctttcagggatcaagcccaattcctcatccctgatttacacacagcccctaactaaaagtaatcaggtgtaggccaggcatggcagctcacacttgtaattccaacactttgagaggctgagtcaggaggatcacctaaggtcaggagttcaagaccaacctggccaacatggtgaaacctcgtctctactaaaaatacaaaattagccaggcatggtggtgggcgcctgtaatcccagctacttgggaggctgaggcaggagaatcgcttgaacctgggaggtggaggttgcagtgagccaagatcgtgccatttcactccagcctgggcaacagagtgagactccctctcaaaaaaaaaaaaaaaaaaaaaaagcctgagaaagcatgaaggaaccctgggaaaaaatacaggctccaccaacaataaggaaaaatgatggttgactgggtagccagtagcatgtgctgcaaatcatttgcttattttgtgtcaagttgtttgccaatgtagctctttatatattatatattattatgttactctttaccaaaatataaaatattgagatgtaattgtagttgtgacccacacacatacatgtaaatgcatgtattgcaaatgtgttctctcattctgtatttgtcttcaattcttagaacctttgtcacaatcatgtcgtgcaatcaagtagcttggcacaaacatctgttctgtgccttctgagtttgattttttgttgttgttgtttgagacagagtcttgctctgtcacccaggctggagtgccgatcatggctcactgcagccttgaactcgcaggctcaagcaatcctcccaccttagcctcctgagtagctgggactacaggcgtgtgccaacactctcagctaatttttttatttttattttttgtaaagatgaggggaatctcactatattggccaggccggtcttgaattcctgagctgaggcgatcctcccactttagcctcctgagtagctgggacaacaggcgtgtgccaacactctcggctaattttttaaaaattttttgtaaagtcagagggatctcactatattggccaggctgttcttgaactcctgagctcacgtgatcctcctgcctttacctcccaaagtgctgggatggcaggcatgagccaccatgcccagctgcctgccgggtttcaatccttcctttcccagcacacatgtaattttaaaaaggtcttgtaactaactctccaataaagttgtcccaggcatataaatgtcttgacgttttcttcaaatgcctccctaggaaaattggcacacacctattcccggcaacagggaggagagaaaggtttactctgaatgcacccatgacaaagcttacctgctgccaagctctccatggcttcctggagaccaacacacacaggaacagaagcccggcaacccccgggggaagatgcctcctccgggtttaaaaacagagctacccttttgcccggggatcatgagggttgccttgtgacttagtgccttatactctgctttcggagcaccaattctcagtggaacgggagaaacaggcgggtgaggaggggtggggtgatttatggggcagagaatggtgcaacacctacccttgtttgtgttgggagaccgaggcctcctccatgccctaaacatgctgtttaaacatccctgcaatttcgccaacgtctctttctctctggctgcctcaacccttttctatctctgccaaatccatgctccactgtctccggccctcctggctccagctacccctccccaacaccctcaaatctcagaaatgcaagcagtgcctctcaagcctgcgcattaggaactcctggaggcctggttcacatagcggggttggaggaagccccgagacgcagggttctgatttcagagttcggatgcctaagaatgtgcatgacacagtttcccaggtgacgctgatgctgccggactaggactgagcctgcacatctcaccctgaattcaaaatcaaaagatggggtgagggttctcggcaaaacgcagcctgagattctattttggagacccctgttccagagagaagagcagtgctcctgacacttggtgggtggggcccagggacgctgctcaacaccctgcagtgcacaggacgccccccacagtcattcaacttaaatgttattagtgataaagttgagaaagactctatctattgtctatctatgtatccatctatccacccattcatctatcatcatttatctattacctatgtatcatttatctattatgtctatacatctagccatccatcatccatcatcattatttattatctatcatttatctaatatctgtcttcctgtctatcttcatcatcatcatcatcatcatcatcaatctcttatctatttatcatctatctccatatatgtatgtatctatgtatctctatatctatgtatcatctatttatcacctatctatctctctatcctatctatcatctatctgtccattcatcctatctcatctatcatctacctatgtatcatctatcatgcatctactgatctatttatctatccattatctatctatttatttatcatctatctaaacagtggcttacagcctaagaatgattctgcccctgctcctaccaggggacactgtgcaatgtttgaggtcagttttaattgtcactactggaaagtgtgccaatggcacccggcagatggagcccagggatactgctcaacaccctacagtgcacaggatgggcccacctcagagaatccagccctgaatgccacaaacgccttggtgaaaaactccagtagtaacttccatctaaccttgggaaagggatcaggttgacagtcacatcattctgaacagtccaggaggcaggagctgtctgagtcttttgtaaatgcccctcttgttagaacactcataagaccctttcccgtaggaggatcctcccttacccagagcaagagcacagcactccacggtttccctgctggagcaatgagaagccaacacaggccccatggaacgagttggcagcacaaggctgtgcagacatctggcgactattggagccaacaaggagaaagcatagaagctgggagagtctccccttccttgcacaagaactgagacttccttggaggggccagcttcatcctggcatttctcttctttggggctggcatccagaggatagaaaactgaggtcgtactggcaaagggggctccgccggggcacttcttggctcctaaggatttccccaatgcctcaggggctggacggatttgaaagtggaccccctatggaaaatgatacagagatttctcaaagaactaaaattttatctaccagttgatctaacaattccactacaaggtattcacccaaaggaaaacaagtcattatatcaaaaacacacctgcactcatatgtttattacagcaccattcacaatagcaaagatacggagtcaacccaggtgctcatcgacaggtgattggatacagaaaatgtgatttatgtgtacaatggaatcatattcagccatgcaaaagaatgaaattctatcttttgcagcaacatggatgaaactggaggccattatcttaagtcaaataactgagaaaaagaacgtcaattaccacgtgttctcactcataagtgggagctaaataatatgtccacatggacatagagagtggattaatagacactggagatacaaaagggtgagagagtgggaggatggtggagaatgagaaattacttaataggtaccatgtacactattcaggtgatgcttaccctggaaacccagacttcaccacaactcagtatatctatgtaacaaaattgcactttaccccataaatttacacaaataaaataaaataaatcagtaaaattggatatgtcaacctgtttaaaacaaacgaatgcagaaaaaaaacatgttgtaataacatataaaaataaataaagatggcttcttgatgtttaatatgccctgcagatatcttacaaagccccagtagtcacgagttaaattcttgcctgtagcctgctggaggtcagagatagcctccactgtttatgtacagctctggccccatctatgaagtagagctaaaaacaccaccgatacctgtccccaaggctgagctgatgcaggaacagccctcagcacagtgcctggtatccacagaccatcgatcatcctaggtattcatctagatcaggaaggcctgactgtagcttgcgttgattgccattgacagtttcggcaagaatctgggttcctttgctgtctctttcggatggacacgtgaaggctcttctccaagtaagttcactcattcgactcatgcactcatacatgcatgcactcacaccatcatcactcattcaactcatacatgcatgccctcacacagtcatcactcattcaactcatacatgcatgccctcacacagtcatcactcattcaactcatacatgcatgccctcacacagtcatcactcattcaactcatacatgcatgcactcacacagtcatcactcattcaactcatacatgcatgcactcacagtcatcactcattcaactcatgaactcatacatgcttgcattcacacattcattgattcattcacttaattcactcatgcatgcatgcatgcattcacactttcacttattcattcatgcatccattaacttgtccatgcattcaattcattcattcactcatacataatacattaattcctgaagtgtatgcagtcttcactcattcactcgtgtgtgtgcattaacacacatgctagtttgttcagctcattcctgtactcatacatatttattcactcagtcattcggccacgtattcacttgtcatgtattctcttcattcactcacacacacatccattcctgtataaatgcatgccttcacgtgctcaatcaatcctgcatgcatgaattcactcactcatgcaggcatgaactcacttgttcactcactcattcatgcactcactcatgcttgtacgaattcgcttatttactcattcatacactcatgcaggcatgaactcacttgttcactcattcgtgcactcatgcatgcatgaattcacttgtttactcactcatacatgcacttatacatgcatgaattcacttcttaagtcattcatgcactcaatcacgtatgaattcgcttgttcactcattcatgcactcactcatgcaggcatgaattcgcttgtttattcactcatgcagtcactcatgcatgcataagttcacttgttcacttattcatgcactcactcatgtatgcatgaattcacctttcacccattcatgcactatgcatgcatgaattcacttgttcactcaatcattcatgcattcaactcattcattcactcattcatagattcatgccttcacgcatgcatgcatgcattcacctatattttccacacagtcacacctccattcacgcatctatctctaaattcattcatacatgcattggctcgttcatgccttcaactcatgcattcatgtgtgaatgcattcattccctccttggcgcaaacattgattcaatggttcattcatttcctggcctgctcattcatgagtagttgtttgttcattcacgcctcacatgcattcacgcatacatgcactcacgcatacatgcactcaccgcgtgcgtacagccactcgctcgctatgcattcaacagctgaagcctgaaaccctcatttattctttctttcgtgcactcattcattcattcagtttatgcgtgtaagtacgcgcacgtgcatttttcatgcattcgacaagatcgcgtataagccctgccttctccctctgggaggcttccagagcggcctccactcttgctgcgcgctggccttgggcccagggccttaagtcatcgcaaacgtttactttggggctggctgattaaaggttaaatgtccaaacctagaaaccgccgactgccgaaggggccgcggcgggcgaggggcggggcgcgggcgtggatcgcagcccccggcggttcccgggtctctcttcccggcagccggggctgggcaccaggcggcgcgcgggcttgcgggcaggggctgcagggaggaggagaggacccgcgcccgcgggggctggcggaggcggggccgggcttccggacagaggccaatcgctgccctcggggcctccagcgccggctctgggccgaggcagccagagcgcggaagaggtgcggggggctgtagggggctgcaggggaccgtgggcagtggaggaggcctgggcgcggcggggggccggggggcgcagaggctgcccgaacgcctaggaggtctcgagggtgggtggcgtacagcggggcgggggcgcaacccagaggccgaggctgggggctgggggaggggcgccggactggagtgcaaaggaggggcgaggggcgcagggggctggaggtcagaggttgcccaagcgcgaaggaggggaggggtgcggggcgcgggagtaggccaggagcgcttaggggtgagtgcgccgagccagggcaccgagtgctggggaatacaggccgtccaggcgcggcggggcgcggggagacggaggctgccggagtacggaggacagacggggcgcgggcgtagggctgggaggcttggggaggggggcgcgggcccaaggcagaggctgcgggagcgcggggcaagggagaggtgcagagcgtggagggggctcgggggcgcttggggaggatgggcggcaggccgggtcggggaggaggggcggcgagaggcgcaggggtaggccggggggctgcactggagtgacgagggagggggcacctggccggggggcgcgggcagaggcagcccaagctcggaggaggtgcagatactggcgtccgggagcgcaggggtggtccagggagtggagaggggtgaccggggggcgccagctggggtggaggaagaggatgcccagaactccaagcaggtgcgcggggcggcggggcagctgctgacaccgctgaggtcgggtggtgtcccgggggcgttgtcgttgctgggcgcatgggtgttaagacgcagcggggtcgcaggtgactgtggggaggacagggggtcaaggggcccctggccagagggcacgaggctgacctggagcgccaaggaggaagtgcggggcgtggaggtcgcaggggcatcgggggaggcaggggccccgtggggcgcaggtgacatggagtgggtaggaggccgggggtgacactggcggggcctgcagccgagggtgtcgagactgccacgctgtcgcccccaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcgggtgagtagctcaagctgcttcagttcagcctgcctgttcctactggcttgggtgacagattggtctgcactggggagaaccccactttgaccgcaggattgccccaaaccccgagtctcccccttactgcctcgcccaggtctctctggggctggagggaatggagataccagcctcagctgctgggagggggtgatttacagcaagtgaagggggccttgggatttcaccagtttccttttgtaaaatatagtcctgaaactttcaatgggcttgtttcttgggaatagcattgaactgcctgagactgtcactgcctggaaggccgatgggaagaagtctgttctcctgaaatggccctaaagctctgggaagaggctgccttgagttcttagaactcagaccacggttttaatttctgtttccagtacagatacagggatggcccggcttggtggctcaggcctgtaatcccagcactttgggaagctgaggcgggaggattgcttgaggccaggagtttgagaccatcctgggcaacatagggagaccacatctctaggaaaaaaatttaaaaatcagctgggcattgcggcacctgcctgtagtcccagctactagggaagctgaggtgggagggtcctgagcccaggagttccaggctgcagtgagctatgagtgcaccactgcactccagcttgggtgacagagtgagaccctgtctctaaaaaacaacaacaaaataagaatccaggttaatcctcctgcaggcagagggctggctggcaagaatggcaggaaaggcctgcccccgccaaggaccggtgagccccatctccctgcccttgggttttgtggacatcagatagactggttgacttaagaggcctagatatgtgaacagagtgtaacctcttcccataagaaagatgctggttctattttctatcattaaatcattaagacacctccttcttgtaccagaccacactggatcattctatgagtgcattttatgtatttatttttaaatgtatattttttaaattttgtagagacagggtcttgctatgttgcccaggctggtcttgaacttctaggctcaagcagtcctcctcctttggcctctcaaagtgctgggattacaggcacgagccaccacgcctggccatgagtgcaatttaaaacacacaaacagaacagatgacttttttattcagaggagagatttggtaaatcacagagctgcttctctcctgtttgttcccactctggacttagagatgaaaattgtcggggcagggatcttaagggctgttttcatgaggtgtactggaagagtctgttccaaggaatggcagaaaagattctctgttctagggacgcgtttggagctctctaaagtgaaagccacacatttccccaagcctgctagggtctgtataatagcagcattcaagacggacattcgcatacatcttggtcagcctcgtgccagaagagaagactcaactctttgcagaaaacaaaaaccacctttgagtagaaaagggctgagaaggaagctgctaaggttattttggggggtgatcagaagattccttgagtgcaggggggcaggcaaggggtagaaagaaactgttgtcacagattcataaaattctcagccactgtaatctccagactggacttgattttgtgacaatgtctcctttttgtgggctgtggtgcagtgacaggttttcttgctgtttttccactccatgccgttgctgaaagtgtccgccgcagtggcacttggagtggaaactccctctttgaatgcagtagcattggataattgtggatgttctctggcgtctggcgccgcaccaggacttgatcaccagttgtttcttcaaggcaaggcgatgtggaagctaagccctgtcaatcaatgtttcatcttctgttctatttcaatctgctggtctgtctttgcactttagatgggttttacagtgtcctggatgggaagcggctaaccttcaggaggtgcacatttttgttccaaagcaaaagtctgagtctcggatcccttgttgctggagagagctcgtgtgccaactggtgttgtcttgtcattgtgtgactgtggtcaatattccctccactctaaaccaaagagagaaacagggtatccagtagttccataaaactctcactctaaatgcagccctgtctgcattctcttttgtgtttgagatcaaggtgggtgtgggcagggctggttcctcctgaggcctctctcctgggcttggtcctcacagggtcttccctttgtgtgtgtctgtgtcctaatcgcctctttttttttgagatggaattttgctcttgtcgcccaggctggagtgcgatggtgcaatatcggctcactgcagcttccgcctcttgggttcaagcgattctcctgcctcagcctcctgagtagctgggattacaggtgcccgcccccatgcccggctcacttttgtatttttagtacagatggggtttctccatgttggtcaggctggttttgaactcctgacctcaggtgatccacctgccttggcctcccaaagtgttgggattacaggcgtgagccaccacgcttggcctaatctcctttcttataaggacaccaatcctattggatcagagcccaccctagtgacttaattttatcttaatctcttctttaaagaccccatctccaaatacagtcacattctgaggtcctgcaggttatgatattcatatatgaattttggaggtgcacaagtcagcccataataggataactcatttatttgaatactactgtgtttttctgctggggctgccataacaaagtcccacagactgggcggcttaaacaacacacatttactctcccacagtcttggaggctggaaatctgagatcagggtgtgggcagggctgtttcctcctgacgcctctctccttggcttgtagatgttgtctttctctgtatctccacaaggtcatccttctgtgtgtgtgtgtgtctgtgtcctcatctcctcttgtagtgaggccagcagtgctactgtattagggcccaccctagtgacctcattttaccataatcacctctttaaagaccccatcttcaaatgcagacacattcagaggttctgtggggtagggtttcatcctaggcgtttcaggatgggttatcatccgtctataacacccattaatcctcatgttttccctgaggtccccatgaagagctataaagccagcgcatgtggttatcaatcaatgatcactctgccatttctcttagttgtcactgagatcctcatgaagagattaaaaaaaccagcgcacatcgttatcaatcattgatcactttgccagttcgcatagttgtcactcacgtcctgatgaagagataaaaagcccatgcgcatggttatcaatcattgatcactctgtcatttctttcagttgtcactgagatcctcatgaaggggtaaaaaaccagagcctgtggttatcagtcactgattgctttgccatttctcttagttgtcactgatgccctcatgaagaactataaaaccagcacaggtggcgatcaatcactgatcactttgccattcctgtgtgttgtcctctgcaccttgctttgggccaattcacttgcatcatccttttctctagacagccagagggccctccctggcaatggagatgagaccttcttacaggttttggaaccctcaaatagctcctcataagcctcaggataatagaaaaggctgcatatcacctttgtaatccgggccctctgaccccatctcttcctgtgggtccttgttctccagctgctgttgctacgctgtgaggaatgcaggatgcagcatgcaacctatcatctccacctctggccttggctggtggattttttctgcctcttccttctttgccttattatttttggttcagtttcttattggaggcaggagacagtagctattttgagggcttttgttggtgttggagtcagaggtgacctcggacatttaattactcgttgaagccccggtttacttgtttttgaagcacatgtctgtgttggaaagggaattaatgagagcgcagaggtatgccctatctacacactcctggagggatgggagccatattcattcttgtttgttgctccactgatttcttgatggataagttcttcctggccatttatccctgagcttggatggtgccctttcaaaaactgctgccagccataggacttgccttgcagtatcgaaacacccatttcttagggctaatgtttctcatggagctgtgggtgtctgaggacagagcttgtaccttgtcagctgctgggcccagcacctagcagattctcgtgcctgggaattgcctgggacgtgaacccacagtgaacgtgtaatgcactgagagcacgtcattaggcccacacagacatcttctgccccttcaccttctttgtcttctgcctccagcttcaatccttcactctttctctaagcagatgcccttatgtgtgcagcttatggcatagcactgtggactgggataagcagtgtcccccataaaactcatgtccccccagaagctgtgaatgggacctgtgaacccaaaagtatctgagacaggtctcaatccatttagaaagtttattttgccaaggttaaggacatgcccgtgacacagcttcaggaggtcccgacaacatgggccaaaggtggtcggggtacagcttgcttttacacatttcagagacatgagacatcagtcaatacatgtaagatacacattgctttgatctgaaagggtgggactacttgaagcaagggggttgcggggggtggtgccaggtcataggtagatttttaaatgttctgattagtcgaaagagttattatcaatagaagagaatgtctgggttatgataagaggttgtagagaccaaggttttatcacgcagatgaaacttccaggtagcaggcttcagagagaatagattgtaaaggtttctcatcagacttgaggtctgtgtggatgtttatggtggtcagcttttcctgaattccaaaatggaggaggttatgatgaggcatgtctgaccctctcctcattatggcctgaactcgtttttcaggttaactttggaatgcccttggccaattaggtagttgcgaggcctagaattttagtttaggtttacagaccttattgggaaatagggtctttgcagatgtaattagttaagcatctcaagataagattatcctggaatatttgggtgggccctaaatccaatggcaggtgtccttctaagagatagaagaagagacacagacacagaggaggccatgtggagttggaggcagagattggagtaatgtggccacaagcccagggacatctggagccaccaggagctggaagaggcaggaaggacccttctctagagtttggttttggaatcctggccttcagaactgcaagagagtaaatgtgtgttgtttaagtctcccagcgtgtggtactttctcacagcagccccaggaagctcattcatgggtttgctagggaaaggagtcagcgatgagcccaccagtaagcaaaatgagcacagcaggtaagatggcacaagagatgaagggtcctgtgtcataggaggtgagggactgtgatgagaagggtcgtcttggggagcagggtttgcaggaagatctctgagggatgggtggttttttccatggccaccatgtgctgggaggagagcaagttccaggtgagttaagggagtggtagtagccccatggtagtagcacacatcataggatgtgcttgaagacccagaggggttgagctggacgtggggactgagtgtgggggatgagatgaccagcagtctggacccagcttacatttgcagacaatgagaaaaccattggcgttgggttggctttcagggcagctgatggctttcactgtgtgttgggggagaaaatgtggtttttaaggaccgaggagacagataacagggaccagaatctacagggtggagcagagaatgcaaaggagggaagctgtggctcagggtggttgatgcagagacccattttaaatgttttctagtctggtgcggtggctggctcacacctgtaatcctagcactttgggaggccaggacgggaggattgcttgaggccaggagtttgagaccagcctgggtgacagagcaagagaccccatctctacagaaaagttaaaaataaattagccaggtgtggtgagcatctgtagtcccagctactcaggaggccaaggcaggaggatagcttgagcccaggagttccgggcttcagtgagctgtgatgctgctgctgcactccagccctggtggcagacagagcaagaccctgtcaaaaaaaaaaaaaaaaaaaagccaggcacagaaggacacctgtagtcccagcactttgggaggctgaggcgggtagattgcctgagcccaggagttcgagaccagcttgggcaacataacctgtctctaccaaaaatataaaaaatagctggatgtagtggtgtgcacttgcggtccctgctactcaggaggctgaggtgggaggattgcttgctctcaggaagtcgaggctgcagtgagctgaaatcatatcactgcgctccagcctgagcaacagacggagaccttctctcaaaaaccaccaccaccacaacgtaatgaacaaccccaacattttctgttgtgcctctcggttaagatctcaggttagttatgcaagagtagaatgtgggattggaggcaagtggacttctccttaccccagaattcatgtcataaatgctctgcacagacgaggcttctgggactcttggggagacctaggaggtgggtaatagggatctgaatctacacggtggagctcatgacccaggtcagatgatgccaagtttcattttatacattctctgttcttcttctctgctccttaagagcgcaggtcagtaagtggggttggaaacagtggactcttccttactggggtataggagttggcacgctaaatattctgcaaagcttgctcttgcaggaccaagcatctaaatagtaaggtctaacctcagtcatctgtttctggaggaaaatcccaaagcatggcctttggagtgtgatttagccctcattctcagattcagtggtgaagttcagaggggagccaatccctctgagcatctcgaaggtggacagaacagtcagctcaggaggaaatctcaaaacaacgcccctcctcgggagttctcttacctttgtcattgtagttcctaaaggatgcactccttttcctttctattctttaattcacagggtccttaaacatggttcctcagatttcaataatctatacattggagatcacaaagaaatcttaatactgccaatgaaaggctaaaaattgtaaatggcactttattttcagtttgacattactttgctgatgattcttttcataatatatatgatttgatttaccttattttttactttgccatctgctttgcaattaaatacacacacacacacacacacacacacacacatacacacacacacacgttttctttttaaagacagggctctgctctgtaacccaagctggagtgcagtggcacaattatatctcactgcagcctccaacttctgggtcaaacaatcctgccgtctcagcttcccaagtagctgggactacaggcatgtgccaaaaaaaaaaaaattaaattaaatgaatgcaagtccattctcagtatgaaacacatactgaaataactgcctgagaaatggtacgtggtagataaatgtgcagcagatgtgctaattggcctgggtatagaaatttagctatttggtctgggtatacaattttaggttgaggaccattgcactcagagtttagatatggtggtttgttttagtgtccactattcatgataagaagtctcagtctcatccttaataggattgacctgtatttttattttactttcattttcttggcattttcacaatgttctccttagccttggtgtttttaaattccaggaatatattgtcaggaaaaggactgctgattttctttctttctttctctctctcccctcctctcctctcccctcccctcccctcccctcccttcctctctctctttctttcttttttctttttctttctcttttgttgcatactctctgggctttttaaatctaaagactgactttctgctgttgagaacatttcctgtttaatttctttgaaaacttttcttctctctattttttttttctattctcttattctgaaactcatgttggtgaaccttctgaatcactcctgtaggcttctagctttctgaaattttccatttgtccctttattctactttctgagagatttcctcaatgatgttttccaaaccttctgttatttcgttttcatttcagcaaatcatatttttaacttctaataactatttcttatccttggagtgatcttttctatagcatttgattcttggtttatagatgtatccctctccccctgatcttttgaaagaatactaattggtgcagtcagaatttttatgtctgcctgtctgttccttgaacttctattccatgaaatgtctggtatttctggggttcttcccattccaccccataacttttcagttttctcttttgtggtgaaggtgtttttcaaatatctggtaatggtttatatctatatgtataaaaatgaggaatgtcggttgagctgtacccacttgccgactcgtctgaatttgtcaagcttatgctataggttgggaattccacttctgtgtgatggtaattatttttttcttgggctttttgtttcctttagaatagatcctatcatctgattttgcccctggtgatgggtatatttggcctctgagaattctgcagaatttcagtgacttctccagtttctcttattggctgatggttttctcctgcctctttgttggcttggggttcacacttgccttccttagcacactttttagtctgttctccttttatctcagaaagaaggaaagagaaactaggagctccacatccaccatctttgcttggaagattcctggtttacacttttaattacgtgattgaattgatgaaaatggatggaccttgaaaacatcatgctgatggaaagaagtcagacacaaaaggccatatgatgcttaattccatttacatgaaatatgcagaacaggcaaatccacagagataaaaagtgattggtggttgtcacaagctagggaagggagaaaggggagatactccttaatgagtgcagggtctctttttggggtgatgaaatgtcccaggattagatagaggtggtggatgtgcaacattgtgatgaattgtgttctttacaatggcgaattttatgtcatgtgaaatttactgtgataaataaaaaggaaatatgaaattattccattttcaaaaggctacatagtgtttgattccatttataggaaatatccaaaataggaatgtagagacagaaagcggactcatggttgccagaatggggagtgactgcgtaatgggtacagggcctccttttggagtggtgagaatgtcctcggattgcctggagttagtggttgcacaacattgcgcatggactaaatgcgagtcacttgtgcactttaaaatggtttgttttatgttatgttaatttcccgttaattttttgagagtttgcatggaaaggtgaagctctaagcaggtcgtatgtttaggtgtggggatacccattatgctgcttagaaatatgttcacacttagggctcagcactgggggttctacttggtaattctttctgcttccacactctttcaagatatgggtcagagaaaccctggtgaggacggggtaggggattggatctctggctctgttttgggcattgtgtgattttcgaggtctgtgggtgaagctcacacagtacctttaccttggccagctctgggctttgcagatgccagtcccgaatgcctgcttcctctcccaactctgtcctctgcttagagacaaaagaagccttacagacagctgaatgggtccatgacagctacgcctgttcttgggaagtaattttgatcagagctcaggcctttggaaatgtctaaagaagtagtaatcaccattattatcattttaaagctagtaactaagaaaactatagatagattatagataatggtagagataatttataatctatagactgtaggtagataggtagatgattgaaagattgatagatataaataagtagatacatagaggacatatatatgataggtagatggtaggtatagatagatggatggctaatagaaagatgataggtagagagatgatggagatagatggatgatagatgatagatatatagatgatagataaatagatatagatgatatatgataaatagatgatagagatacatggattagatagctagatagataatagagatacatgatagtaagatagataataaataatagatgtgaagaggattggtagatgataggtggatagatggatggatagatgataggtagatggatagatagatgatggatggatggatagatagatatatgatagatagatgaatagatgatatagatagatagatagaaggatggatagatagatgataaagatagatcgattatagtaagatagataatagatgtacagagaattggtagatgatggatggatggatgaatagatggatagatagatgatagatggatggatgtatagatgatagatagggatagatagacaatggatggatggatatatgacagatagatggatagatggatggatggatagatagagatagatgatagtaagatagataataaataatagatgtgcagagaattggtagatcataggtagatggatggatgaatggatggatagatagatgatagataggtagatggataatatagatattatccaatgatagatagatgatggatggatggatagatagatgatagataaatagatgaatggatggatggacggatggatggatggatggatgatgggtagatggatagatatggactgatgaaaggtatcttttgttctacagaattaagttgtaaagtttgctgtctgtaattctcactcccaatggagatgtcaggaattctcgttctttcttcgttcaagggtggggaggaggagtctacaggagcagctgtaacaggcacattttggaatttaccccattggaatgtaaaggtcaaggaggcagccctgtaccacacgtctgggacgcttgtgtttgttatatttagtgcgaattgtgggttggctttgcttggagtgctgcttccgggaaaggcgctgtggtcgcctacatgctgagcattttaatttccatagacagtacactgggctgcacactgcatgggacttctcggcattgctggctgccctcctgactgttgtctttctcctggcaacaggggcttgggtgcccaagaatcaagtggtttaaaagtcattaccaaagttcacatcagtcttgtgcacagagaattaaaactgctgtaaattatatctgctgtgagagctccttcctctcatactgaggcattaggaaattgaatccattctacctaatgaaacaatgtacttttccttatgttgtctctaccgcctcatacatccctgagttgaacttgaagtctttgtaagaaatggtctgtccagaatttaaataacatgtttggctgcttctttatggagcacgattcttttctttcctttctttcttttttcttttttctttttttcagagacagggactcactctgttgcccaggctggagttcagtagtgtgatcatggctctttgcagccttgacctcctgtgctcaagcgatccgcctgcctcagcctctcaagtagctaggactacgggcatgcaccacctcgcctggctaatttttttttttttccagtacagatgaggtcttgctgtgtttcccaggctggtttcaaactcctgggctcaaatgatcccccttcttcgaccctagcactgggattacaggcatgagccactgcacctagcccaaagcacagttcttttgagtgagttgggttacatctttgctgtaactcaggtcatcaagccatcacttccactttttgccttttgttttcacctaagatctaaacactttgggtgagttttcaagagtcaaacacaacataaaataagggatagtagctatgagtttccatggcattgcagcatcaggaaatgggcatagcagttgggttgactttgtcccttgtttaaggttccttcatactcctcctgtgttttgttttgtttagaatgaaaggaagcatgtatgcgaattagaatactgaatattcactgcaagtcgtgattttttttttttttttgagacagggtctcactctgtcatccaggctggagtacagtggtgcaatcacggctcactgcagcctcaaactcccaggctcaagtatcctcccacctcagcctctccgagtagctgtaactgcaggcctgccaccacgcccagctaatttttgtatttttcgtagagacagagtttcaccatggtgcccaggctggtctcgaactcctgaggtcaagcaattcacccacctcagcctcccaaagtgctggaatgacaggtgtgaaccatcacgtctggcccaagccatgaatcttgggagaggagaggaggtgactatggccccgtcacccctgctgtccctcaggagtgtaactctggtgtttctgttgattttcacagtgactgatcaggcttttgtcacactagccaccaatgacatctactgccagggcgccctggtcctggggcagtcactgaggagacacaggctgacgaggaagctggtggtgttgatcactcctcaggtgtccagcctgctcaggtaaggctcagagatgcggcttgtgcccagctgggtcctatagaaggagggtcacctctcccctaagaggtcctaggagttattctgacgactgactgcccttcttcataggcctggatggccggcagtcatgatgggcatctgacgtttgtaaggaaccttcgaatcatgtgaaaatataggcgtgtgatcggcttcacaatactttaaaaaacaatactgggtttggttacagttcattctcccaaccatggaaactgaaaattcaattcttttttgtttgtttgttttttgagacagggtctcgctctgtcgcccaggctggagtacagtggtaccatcttggctcaccgcaacctctccctcccaggctcaagcgatcttccctcctcagccttctaagtagctgggaccacaagtatgtgcccccatgctcggctatttttatttttatgttttgtatttttggtagagacagggtttcgccacgttgcctaggctgatcttgaactcctggactcactcagtccacccaggttggcctcccaaagtgctgggattacaggcatgaaccatggcacccagccaaggagtcttttcttataatttccttttataattctctttgtctttaattctcaaataaagcaaatacataaataaatgcgtctaatgaataaagcataaggcttctcttaaatgtcatacattatgtaagcaataatctttttctttcatcaaccatggaccacttaaaaaaattgattttatacgaatgggacgaggaggcatttaatatggtagatgtagcaggaattgaatgtcatattctttgacaatgaaataataaatccagacattaatagctaaactaaaaagagaacaaataaaaaaccaaccagtgtgtcctcagacgtttgaaactggaagttttaaatgaaataactcaatccgggtacaaatgaaagcttgaattatgtactatttcagaaaatcactgcaatgtgagtgctacctatacaaagcaaagacagcaactacagtggtacaagacagaaaatttaaatcagtgaagaaattatccagttcaaatatatatgtatatacacacacgtatgcatatatatgtgtatatgcacgcgtgtgcgtatatatgtgtatacgcacacgcatgcgtatatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgtatgtgtatatgtacacgtatgcatatatatatacatgtatgtgtatatatttatatatacgtatgtgtatatgtacatgtatgtgtatatatttatatgtacaggtatgcgtatatacacatgtatgtgtttatatttatatacatgtatgtatacctgtatgtatatatgttcaactatatatttttatatacatgtatgtatatatttatatatacatgtattatatatgttcaaatatatttatatacacatgtgtatgtatatttatatacacatgtgtatgtatatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatacacatgtgtatatatacacatgtgtatgtacatatatttatatacgcatgtgtatttacatacatttatatacgcatgtgtatgtacatacatttatatatgcatgtgtatgtacatacatttatttatgcatgtgtatgtacatatatttatgcatgtgtacgtatatttatttatgcatgtgtatgtatatatatgcatgtgtatgtatatatatacatgtgtatgtgtatatatatgttcaaatgtatatgtatatacatataaaatatatatatttgaactggatttcactgatttaaatttaaaatatatatacacacatatttgaactggataatttcaaatatatatatttcatatatatatttgacttggataatttcttcactgatttaaatttaaaaaaatatatacatatatgtatatatatacatatatatacacacacacatatatatacacatatatatatatatatatatttttttttttttttttttttttttttttgagacagagtctcactctgtcgtccaagctggagtgccatggcgcgatcttggctcagtgcaacctccatctcctgggttccagtgattctcctgcctcagccttccaagtagctgggattacaggcatccaacatcacgcccggctaatttttgtatttttagtaaagacaaggtttcaccactttgcccaggctggtctcgaacgcctgacctcaagtgatctgcccgcctccgcctcccaaagtgccaaagtgctgggattacaggtgtgactcaccgtgcccagccccaaatatttttaaaataataatattaaaaaagcaaacagcagtaaaaaattcataaagataaaatgacaaaactaataattgggaacaagaaacaaattcaaggattaggttaacaaatcttcagggaggccaaggtgggaggattgcatgaggccaggagtttgacaagacaggctgggtgacatagcaagaccctatctctacaaaaaataaaaagagttagccaggtgtggtggtgcgcacctatagtcccagctagtcaggaggctgagatgggaggattgtttgagcccagaggttcgaggctgtagtgagttatgatcacaccactgcactccagactgggcaacagagtgagctcctctctctaaaaataaaaataacaaataaaaatgaatcttttattcgagaaaacataaatgtacaaaattgaaattagaaagaagtcatttggaggcagttttaaaagcaaatagtatatagaaccctttacagtagtgacactgggagtattgaagaagtgcttgatccttctagggaaatcggtgagatgttggttgttgtcatcagaagaaatagaaaccttttgtttgacaataactatgagaaaaactgaaaatgttaccaaaggcttatcttgtagaaaggccctggtttgggcaattttaagggaagttctgttaaattgctcatgatgaattaatttccctgctgcataaactgtcacagagcctagcaaaagatgaatatgttcacttattttaagaaactgttataatcttgacacccaaacttgatttacaggtttgattgtgtttacatttggattgagaaagccctcaaatacaggatgttaataaggcaactctagccctgtagtaaagaaataaatagtgcttacactaagaaagcaaagataggttattattttaaaacctattaatatcattcaacacattaatatgttagagaaagtcaatgataagatccttttaaaataaaaactaaacatataacaaaaagaattccaggccggccacggtggctcatgcctgtaatcccaacactttgggaggctgaagcaggtggatcacttgaggtcaggagttcgagaccagcctggccaacatggtgaaccctgtctctactaaaagtacaaaaaaaaaaaaaaaaaaaaattagctgggtgtggtggcaggcacctgtaatcccagctactcggtgaggctgaggcaggagaatcacttgagctcgggaggttaaggttgcaatgagccgagatggcaccactgtgctccagcctgggtgacagagcaggactctgtcaaaataaataaataaataaataaataaataaataaataaataaataaaaatccacatagattataaatatagaggtaaacatttaaaacatagagaaatcttagaagaaagtagatgaaagtttctcagcactgctgctatctgggactggagggttccatgtggtggggtgtcctgtgtactgcagggtgttgagcagcgtccctgggctccgcccaccagatgccggcaggagttggcagttgtgacaactaaaaatatctccacatgttgatgaaggtggatgttttgttcatctgaaagctggaaatgctggtgtaaattaaacaagatggaagaggacaccagaactgctgtgtgtcagagatattatgtgttaaagataaaacaaactgagggccacatttaaaatattataatggagaggttcttattgtccatcacgtacaaagaactctgaaaacactttaggggtttgcacgggctcgtctctagcacgccagaagcaaagatagacagacaaatacaaaaataggtattaaacacgagcaactggctgggtgtggtacctcacgcctgtaatcccagcactttgggagactgaggtggacggatcacttgaggtcaggagttcgagaccagcctgaccaacatggtgaaaccccgtctttactaaaaatacaaaaaacattaaccaggcgtggtggcgcctgtaattccagctactcgggaggctgaggcaggagaatcgcttgaacctgggaggcagaggttgcagtgagcccagatcgcgccacctgcactccagcctggtgacagagcgagactctgtcaaaaaagaagggaaaaaaaaaaaacctgactatattaaggtccaaaaatgcaccagtgagtggaaaggtacacatagcacatccagcaggttccgtgttttattttaaaagccggcgggggcgacggggtagaaaaatgctgttaaagagtgtaattgagttgcttgtaacacaaaggataaatgcttgaggggatggatactgcattttccatcatgtgattattacttattcctgcctgtgtcaaagtagacttaaggttcactcaagaggaactttaaaatattcagaaacaacatggcagaaatcgtgggaaggttcagtgttgcaagtcgggttgaggttttgtgggaccttttattatatgtttcgtagtcatggggagaattgagggatggcgctctgcggtggtcagggcagtggaagacgagcagtgagcaatgaccgtaaatgaccaggggtgtgggtggtgggagatcgcccctcccccaggctgtgtggtacaagcgtgttatggagtgatcttgcagggaaacctgctttaaactaattgtattcatgaaacataattctgcttccaggagtttattttagggaaatgagcagagctgaacaaaaagatgtaaggacataaatggcagtgccatttgtagtgaggtggagtgctgtttctcttgccctccccccagcccggatctttacgcaactgtggtgaagatgccataaattccataaataactgggccaaaagcagagggagatttgctgaaggaagggtactttttcagagaaatagttaccttaaatacagagcagtgaaatcttacaaataaatgtcgagtccaagagaaatgctaagagatagaaaaggtccgagagcttcaatatctgtcaaataggagagaaagaaaaagaaagaaagaaagaagtaactcctattatatttcagctctgagacaaagtttagattgaaagtgttccagatattgagcagagtggatgaagaaagctcaaatgtagacaccaagtggtaaaatttcagagcagcaaaaatgaagaaaaatcctaaatgcctttctgtatcaatctggttgtgacaattgatgtctcaaaattctggtgcaagataactttgaaatgaaagttctgtattcagctttagtaccgtaatttgaaagcaaaacaaagacttttcaaatttgcaaacgttaaaaatgttatccctcaaagatctttgaggaaaaagttagttgattgactcctgcaaaatggaatgtaatccaagaaaggcgagagtagccaagcacagtggctcatgcctgtaaccacagcattttgggaggctgaagtgggaggatcgcttgagttcaggagttcaagaccagcctggacaacatagtggggtctcatctctactaaaaaatttttaaaaattgctgagtgcagtggcacatgcctgtagtcccagttactcaggaggctgaggcgggaggatcactggagcctaggacattgaagctgcagtgagctatgattacaccactgcactccagcctgggtgacagagcaagaccctgtctcaaaataataataataatgataatgataatgataataataaatagaagagagcacacaggaagcagtgctgaataaataaatgtataaaacagagttaagtctgaatgtgttagtgcacagttacgaaaataatctggaattaacatttcacatgggaggtaattgaaagagcagagaagaaagaatgagcatatgttcatgtttttgtttcgtctgggaagaagacataggtaatgactatatttgatagaaaatataagcttaaatacgtgtgctgacagttgaaaggtggttaccaccagaaaactagaaaagatgtgtacaagtttcagagccttaatgggaaatgcgtggattgaagaaaacctgattcatgcaatcagaggtgggtgggaaagaattacactgatgtcaggcctctgagcccaagctaagccgtcatatcccctgtgacctgcatgtacacatccagatggccggttcctgccttaactgatgacattccaccacaaaagaagtgaaaatggcctgttcctgccttaactaatgacattatcttgtgaaattccttctcctggctcatcctggctcaaaagctcccctactgagcacctttcgacccccactcctgcccaccagagaacaacccccctttgactgtaattttccttgacctacccaaatcttataaaacggccccacccctatctcccttcgctgactctcttttcggactcagcccacctgcacctaggtgaaataaacagccttgttgctcacacaaagcctgtttggtggtctcttcacacggacgggagtgaaaactgaagaaatagaaaatctgatatatgtaaaaaagggaaaataatataaaatgaaactgcaggactcaatccaaatataaccgtgatcataataaacatgaatagattaaaattcctttttaaaaagataggctttctgaatgggaaaataaacataaaatccggacatacagtagtgtaggaggcagcttaattaaaaacaaacaaaatgttgaaaataaatggatgcatttgatatgattctgttccactatccaatctaagtaatggtcaattgttttatagattgttcttcagttgtttgttgttgttgttgttgttttgagacagagcctcgctctgtcgcccaggccggagtgcagtggcacgatctcagctcattgcaacctctgcctcccaggttcaagcaattctcatgcctcagcctccagagtagctgggattagtttcccgccaccgcacccggctagtttttgtatttttagtagagacggggtttcaccttgttggccaggctggtctcgaactcctgatgtcaggtgatccacctgcctaggcctcccaaggtgctggaattacaggcatgagcccctgtgcccagccttcagtttggttttgtccagtgttttctcatgattagactgaggttatgcatttttggcaaaaaaatcatcagaattgatgtaagttttcagtgtgtcatgctatggagtgcatgatgtctgtatgtcctgacctggtgatgttaaatttcatcacctggattaagtggtgtctgttggaattctccactgtgaaattattatgtttttcttttagtaatggaaaatatcttggcatagacattatacaaacagcctgtttcttctctaaaaatcagtgagtcttgtctgcaacagttgttactatagtgtttgcctaatcgtggttttctacttccctcattccttctatttcaattacttggaattatcttctaaattaaacctgccctttctttctcacatatttgtttattcaatagttatattaggtcaggcgtggtggctcatgcctgtaatcccagcactttgtgagactgaggcaggcagattgcttgagcccagaagtttgagacaagcttcataaacattgtgaaaccccatttctaccaaaaaatacaaaaaattagccgggcatggtggcatgcacttgtagtcccagttacttgggaggctgaggcaggcggaccacttgagcccaggagttcgaggctgcaatgagctatgattgcaccactgaactctagcctgggtgacagagtgagaccctgtatcaaaaagaaaacttatattagtgtaggctcatgaatatttatttcatattttgggcttgttgttttttgttattgattacattatttcagctttggcaattgggtgcttcccctagctggccccctgtattctttcaatatgcccccatccttttctagcacttgcttaatttttctgtcatcccaatatgttccagactatgatgaagtgggatttaagcaaaaataaataaataaatggaacagagcaaatttcactttgataaaatggacagtctttcaagcttcgagtctcaaacttgtatgcaactaacaatgtaagctttgaatacagaaagtaaaaattgatagagattgttatggacatctgttagtttctaccagctcagcatttacatttctctgcctctgcagcttacagagggaaactgtcttcctaagagctggcccaagtgcatgcatcttaagacagttctgttcaatttgtcacatttttcaagtatgcatgcatttctttttcataatattaatatttattactatatatgaatactagattgaaagcccaagcattcagtttacacacagaaattatgcaattatatatcgcttcacaaaggcagtgaacacattacattctacaaaatctacttcacagaaatttaaaaattctaaatatcaaaaggtacagctgaagaaacaggtataaatttggcagccagtaattttgacagggaagttgcagcttgcatgactttatttttttgtttgttttttgagacagagtcccactctgtcgcccaggctggagggcagtggtgccatctcggctcactgcaacctctgcctcctgggttcaagtgattctcctgcctcagcctcttgagtagcaggaattacaggcgcccaccagcacgcctggctaatttaaattttttgtttgtttgtttttgtttttttgcttgtttgttttgagatagagtctcgctctgttgcccaggttggagtgcagtggtgcgatctcaggtcagtgcaatctccgcctcccgggttcaagcgattctcctgcttcggcctcctgagtagctgggactacaggcgccaccacacctggctaatttttgtatttttagtagagaaggggtttcaccatgctggccaggctgatcttgaactcctgacctcaagtgatccggctgcctcggcctcccaaagtgctgggattgcaggcataagccaccgcgccaggccttgcatgactttaaatatatgaatatgaaaatattgaacttagagtaatcattgtgctttgtgttgattgaaaaatataacaatggctatcaaagaagcatgttcaaagatgcttaattcacttcaaaatgtcatacaaattgtggtggtttctatgcacctctaaagcttccgtcatttagctcaggtacattactaaagtaatatattaattctaccggtacagtggggtttcacaccattggcatttgcattcaagcatgcagaggcttttgggcacaagtggacggtgtgcacagctctaagccatccgtggaaatgtgctctgaacatggagaccgcagtgagggctgtggggattctctttgcattccacgtttgtgagcagcaaaacagcaccctcttgaaggaggaggtggttctgtgctgaatattcacccgctgtcccactatttggcacatgtctgttccagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgagtgaagactctctgcttgataggaaaccctccaagaccacatctctatccttaagcaggctgtcaacttttttttgtgtgtgtgtgacacagtcgctctgtcacccaagctggagtgcaatggcacgatctcggctcactgcaacctccgcctcctgagttcaagtgattctcccacctcagcctcccgagtggctgctattacaggcacccgccttcatgcccggttaatttttgtatttctgtacagactgggtttcgccatgctggccgggctgtcacctcttactggtagattcctgtgaggccatgtgcatttctatttctaacacagatgttcagtctattataatcaggcataacatacccccgagcactgtgctagaccctgctgaagagaacaggggattggaagacatgttcctaccccaggaatgaattataaccacagtattttacacgcacaaaatagaatcatgagggaaaaaacttgtgactgggcacagtggctcatgcctgtaatctcagcactttgggagcttgagatgggtggatcacttgaggccaggagtttgagaccagcctggccaacacggtgaaaccgtttttactaaaaatacaaaaattagccaggcatggtaacaggtgcctgtaatcccagctactcaagaggctgaggtggggggatcgcttgaacccgggaggcggaggccgcagtgagccgagactgaagcactgcactccagcctgggcgacagagcaagactctgtctcaaaaacagaagcattggtaaaagaagcattgcggcgggttctgcgtgttttgcttcaccaggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggtaagtcagggcagcccggacgcttagggtctctgttgcacacactcaactctgcagatgtaacacgaagtcagccgttgaccatacagtcacacctcgctcagcgacagggatgcggtctgagaaatgtgttgttaagtgattttgtcattgtatgaacgtcccagagtgtatctgcacacacctggatgatgtagcctactgtatacctaggctggagggtacagcctattccttctaggctacaaacccatatagcatgggagtgcactgaatgttgtaggcaactgtaacataatgggaggtatctgtgttctaaacatacctaaacatcacaaaggtccagtgaaaatacagtataaaatcttatgggaccaccgtcagatgtatggtctgtctttgaccgaagcacttttatgtgttgcatgactgtacttggcattgaacatgggctggccgtggtggctcatgcctgtaatcccagcactttgggaggccagggcggacagattgcttgaggcgaggagttcaagaccggggtgggcagatggcttgagaccaggagttcaagaccagcctaggcaacgtggcaagaccccatctctacaaaaaatacaaaaataagctggatgtgatgctggcacctgtagtccccaagccctgggaggctgagttgggagcagcagctgagctcaggagctcaagcctacagtgagctatgattgcaccactgcactccagtcaggttgacagagtgagaccctgtctcagagaaaaagaaaagagcatggctgtgttccaataaaactttatttataaaaacatgcacagtgtgtagttgcttgacccatggtagaatatagggagaattaaaaggaggcaacctgaagccgagtatttgttgaaatgggcgtcagtagagaggaaatgtgctggaatttttgtaaagtaaaagaaaatactggagcagtgaagaattgcctctaggtaaaggggaagttaatgaaactggcaaaaatgatgggaaaagcattgtcactaccagggagaattcattaggggaccagtggaatgctttggactccatatgcaattttagcattcattctggggactcctggtggagaattttggagggaatatgcacttatttttatcaatggcttgggttatcagtcttttctgagaaccaagagaatgtgtgcagctggcagacagaagaaatggaattagtaaccctgaaggcaagtgtttatgttgagagcttcaggcacatctcgcattcttggagtgaaccaagccatactttgctaacctgcttttgtgtttgctcattatgtaggggcagaccaaggcttactgaatagtttcttcaggaactggtcgaccacagacatccacaagcacctgccgttcatctataacttgagtagtaacacgatgtacacttacagccctgccttcaagcagtaagttctccaccctggcgaatcctgccagatctgccactaccgatccaccttccctcctggaagacataccagctgtcggcatatttaaaaactctatctatctatctatcatctatctatctatgtatctatctatctatctatctatctatctatctatcatctatctatcatctatctatctatcacctctatctaggtagatctaaatatctatttatctgtatagatagatacctatgtctatgtgtctgtgtatctagatctctatgtctatctatatagatatatatctgtctatatagttatctacctatataggcctagacatctgtttatctatctatctatctatctatctatctatctatctatctatctatccatatctatctatttagatctggatatctatctgtatacatagatctatatatctatatctatatatgtatctatatctagatctagatatctatatacattgatctatctaatctctatatctatgtagatatttatctatctatctagacctagatgtctatctatctagacctagatatctatctatctagacctagatatctgtctatctgtctaatctatcatctatcatatgtatctattcagatagatctggatatctatctataaacatcttatctatctatctatctagatctacatcactatatagatacctatatctatctatctagaactagatatctatgtatctagatatccatctagatttagatcttcatccatatagatatctatatctatctatctagatccagatatctatctatatacatagatctatatatctatatctgtatatctatctagatctatctagatatctatgtatatacatggatctatatatctctctatgtatctagatctagatctctctctatatagatctatgtatctagatctagatctctatataggcatctatccatctatgtagatctagacatctatctatatattaatacatagatgtatctatctatatacgtctttatatatgtatatacacacacagaaacacacacacacatctcgtttcctgcttgcttgttgctgtaaatgatagctagccaaggctctacgacaatgatccccaaagtgtggcccaaggaaccctgaccccacaactctttcaagtgtcttcaaagtcataactactttaaaaaaagaatttgaagatgtgatttttttccctttttgctgccattttctcatgcatctatgctgagagtttacagacactacatggcatgtgataaggtaataccctgaacacagatggagctaggaagaaccagctgtcgcctcttgggaaaatggatggcactcttctcacaatgattttttttaatatagaaatttttttaatgaaaaattatgaaatttatgttactgcataatggtttgattttttttaaagggattgataaatatgctttctaatttctcagttttaatatcgattattctaaatatggagagagagaatccacagggacatggccgagcacagtggctcacgcctgtcattccagccctttgggggccgaggtgggcggatcacttgagctcaggagtttgagaccagcctgcgcaacatgatgaaaccctgtctctacgaaaaaataaaacaaaacattagccgaatgtggtgtcgcacaccgctagtctcagctactcgggaggctgcggagggaggctcacttgaacctgggaagtggagtttgcagtgagccgagatcgtgccactgcactccagcctgggtaacagagcaagcctcagctcaggagaaaaaaaaaagaaagaatccacacggacaaagctctttgggttcctaaaagggtcaagggtgaggggaccagaggctgtgaaattcactgctccagaagatatggctataaatgaaaatagagaatctgagaatcaccttgggaatgaataattctagagtctgcattctctacagaggacacggtgtccctaaggaagagaaattgattcttgggagtgaaatcttgttattttttactgtataatcacagatgtaatgtacagaacatagatatgtcatgtgacttttgtgttcatatttcatgaggaggtgatccacgaaaaaaaagtttaaaaaggctcctggaggatggtgatgatgaacaacaaaaaagttggcaaggggaacatttagaatcctgtaaaagagaaaaaaagccaattgccttgccgcttgcattagccactgtaaaagctatttttttttgcccctgtcgttttaaggatatgatgatttgggctgctgtacttcacgtttttacaaaactgatttatttttcccgttttgggaaaaaatgtcaatggattacgattatgttttttgatatatagaaaataaaataactgcaaaaactgtgatttaaaaaatatatctttatgcaaaataactgcaaatgaaactactactactatgctgatagcagtggagtagtattattgatgatatattgattactatcttgatagtagtggtatgctagtattgctcagatattgattactgcattgatagtactagtatattattattgattatatattgattactatagtagtgatagtattttgttattattgatcacacattgattactgaattgatagtagtagtatgttactattggttatatattgattactatgctagtagtagtatattgttgactatatattgattactacattgatagtggtagattattattgattatatattgagtactatgttgataatagtagcatagtattgattacataacgattactacattgatagtaatatattgttattgatcatatattgattacatgcattgatagtagtagtgtattattattgattatatattgatgactatgttgatagtagtaatcttattatgggtcatatattgattactgcattggaagtagtagtgtattattattgattatatattggttactatgctgatagtagtagtatcatcagtaataataatcaataatggaaacccattgggacaagtccttcagaggctgtctttgaggagccccatggtaggtggatgctttctgggtgtcttttatcacatctgagtggaaatcagaatcccttctgtttccttctcagattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacagtaagtgggggattcccttaaaacccgtagctgaggacgaggagaacatccttgtcaccaaggtctggcgtggtttttttttgaaatgccccttttttgtctaaatactgtatttcatggaaaagaatactgagaagcaagcacctgttaaaaaaatttttaagttttagctcaaaatagagaatgcctaatgactggagatcctgttttgatgtgtaggcctggtgcagaaataggttattgaaattagccatcctcatcagagtaagagacactcatggacaagtggttcacaatgactgattacgacgtcattcgggtcaacactttccacttgaaaccatcatttgagatagcagttggaggaagtgtctgaagaggattttgtaaagttttgattgacaccaatttgattgcaaagaatataatgacagcccctcggtgtgctaaatggtggagtatctgcagtgtgctgaatgtaggctgcatctgccttgcagaagacctcttgcaattaggactcaggaaacttcttattcctaatggcttttttcactaaagtaaaaaaaaacttgagcttttttttttttttttttttaactagagcatttgtactagagtaccagagtattttttaactagagtaaagaaaactagagttttgtttgtttgtttgttttttgagacagagtctcactctgttacccaggctggagtgcagtgacatgatctcggctcactgcaacctccgccttctgggttcaagcaattctcctgcctcagcctcccaaggagctgggattacaggtgcctaccaccacgcccagctaatttttgtgcttttagtggagacggggttttgccacgttggccaggctggtcttgaagctctgacctcaagtcatccacccgcctcagcctcccaaagtgctgggattacaggcgtgagccaccaagcccggcctttttttttttttaactagagcatttgctagtacaacagagtctgctatcagcacatgcattgcctgggaaattgaaaagaatccctattttaatttttagtatggttttttatttgggtggatctaggctgctttttaaggactgctgaaaatttctctcaccgagtgacactagcaatggacgtttatttgtattcacttcacaaacattgacttgtcacatatttcctgctgggcgttttgctaagtactggattattaagtactggattactaagtactggattactaagtactggattgcataggagggaattttaaggcttagtgtcaaacggtcctgagaaagaaaacatttaggacaattatttaatgattggcagatgggagctgggagccctggctacacagggccccacccgccccccaggacagcaggtgaattgaggagacatagggaagactcactccacgtgtgtgtttttgtgcagctttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatgtaagtacctgcattcctcacaggtgtgatagtcagacgctggctcgcagtgagagagcagagagagccggcttccctggctccctggggaggggagatggaggggaagggctggtctttggcttgctgtggcattcaaggctctgcatttatttttgcattacggcacaccgaatcaagctcacctgctgaaagatgtctatgccccaatccctaggacctgtgaatgtcaccttgtgtggcaaaagggcgtttgcagttgtgattaaatgagggaccctgagctggggaggtatggtcttggattctgggagtgggctcttagtcatcacaaacctcccttcaaagaagaaggtggaagtgtgaaggtcagagaaggagtgtgaagctggaagcagaggccagagagagaggggattggaagacgctgggctgctggctttgaagatggaagaggaggccacgagcgagggaatatggtggcctccagaagctggagaaggcaggaaatggattctcccctaggtccccaagaaggaaccaaccctgccgacaacttgattttaatccactggacttctggcccccagaactatcagatggtcagtctgccttggtgtaaaccacccagtttgtggctgtttcttacatagcagcctcaaaaatctgatgccacaaggagacagatgctcagtctctcgcagtttacagattctgggggagccagagctctttcaggttcaaaaagggaggcttccgtcagtgccccctcaacccaactgcctggccgtgcatcctgagaggtttcagccgaacccctgacttgaacagtggttgaagtgaagatgaattcctgccggggttcaatgttcaaatgaatgttgacctgcacagtggtgtctgctgaggccgagtctgcagcactttgtccccatcgaagaaaaatgaaaatacaccttacttgcaaaacaaataatggaggccgtcatttctccagctccaatttctaggtgaatactttggaataatatcttgtgtttaaagatttcctggggccaggcacggtgactcaacacctgtaatcctaacactttggaaggctgaggtgggaggattgcttgagcccaggagtacgagaccagccggcaacacactgagacctcatctctacaaaaaaaagtcaagaaattagccaggcatggatgtgtgcacctgtagtcccagctacttgggaggctgaggcaggaggaatgcttgagccttggaggtcaaggctgtagtgagctataatctcaccactgcactcccgcctgggtgacagagcgagacactgtctcaaagaaaaaaaaaaagaaatcttttttttttttgaggcggagtctctctctgtcacccaggctggaatgcagtagcccaatcttggctcactgcaagctctgcctcccgggttcacgccgttctcctgcctcagcctcccgagtagctgggactgcaggtgcccgccaccgcgcccggctaattttttgtatttttagtagagacggggtttcactgtgtcagccaggatggtctcgaactcctgaccttgtgatccgcctgcttcggcctcccaaagtgctgggattacaggcgtgaaccaccacgcccggcaagatttcttgttttaaatctttaccactgatcctaacaagtttctcaacagaattattttgagatcatacttagggaaggatctggggactgggctgaaggaaagtgattcttttctgtatacttcagatagctccgggagagccgtttcttgttgcttataaacaagtgacctttagattttgcacacattgctctggaagacaccacacgcttcactgtactctggcgtaaattatgctctggcaactttatgcatgaagaatgtcggagtggtgatttcacattgacccaaacacattgaaaagatgtttaggttcagatggtgaagactgaggaggtgtaaaatgcgcttttctggtttttcattcctcatggtgtgccctgagcataccatagcctgggcctggccccaggacgtgcctcatgcgagtcaagtcaagagcctctgcttgttcctgctggaatgtgaagaattccatcagtggagcccttacatgatgtgcaaaacggctgcaattgtgctgagccatgctcgtttcaggatgtctaaggaaaaatcgcatttacattaaatgtttagtaggcaaccaagtttagactgtaaaccaaagagtatccaagaatgctgtggcattcaaggctcatgcttttatgtgcattacagcaccttaaggccaataaaggggaactcccatcccctgttgatgtgtattgaaaataattgaatgctcaaactcctagcctaaaaaagaaatattatcgaatgcttcgaaaacataaatttaggaagtgtattttgccaaggttaaggacacacccgtgacacagcctcaggaggtcctgacgacatgtgcccacggtggtcggggcacagcttgcttttatacaatttagagaggatgaggtatcaatatgcgtaagaagtacattggttcagtccggcaaggcgggacaactcaaagtggggcgggggcttccaggtcataagtagatagaggcaaatggttgcatttttttttttttttagtttctgattggtctttccaaaggaggcaatcagatatgcatttatctcagtgagcagaggggggactgaatagaatgggaggcagaggccctaagcagctccgctcccagctggacttttccctgcttactgatattggggttccaagatttactttcttcacaagactctattgagtcctcagaaaacggttttcaaaccatctttctgatttccggttgcgtaattttaatcttattccgtcactgaatcttgtacattagtggttttgcaaactatggcctgaggtctctctgaataaggatcattttaaaggattgtgtttttgcagatgatcttagaagcattcttctttttctttctttttttttttttgagatggagtctcactcgatcgcccaggctgaagtgcaatggcgcgatctcagcagctcactgcaacctccaccgcccgagtccaagcaattctcctgcctcagcctcctgagtaggtggacaggcatgagccaccacacctggctaatttttgtatttttagtaaagaccgggtttcaccatgttggccaggctgttcttgaactcctggcttcaagtgatccacctgcctcagcctcccaaagttctgggattacaagtgtgagccaccatgcctggctattaaaaacattcttaacagtttattctgaaccacagtgagcactccctcattcgtaagggcagccaccctctttcagaagcaagtgtgtattctccacccttcagcccctggagggatttccacggattgtcacagcccctgaaaacaagcttcccagggcaaacagtggttttccagagactccaaaagggaaaacagtcaggacgctccagtcccagctccagcccaagttgtagccacaccaatctctgcaaaaacagaaccatttccagagtgacagcacttagcactctggtttctctaaaacagcgcccgtcatgttcaattcatattaatctcgatggaattgttgccgtggatttttcttgacataagtcacttctacttttactttggattcataattgtcgatgaggtggcaacttaaacaatagatatgtagcttcgtgtttgtccgtccgtgagccacctttcaatcagagccagtcaagccaaacctaggagagactttcccgtggagggattggggcttctgaggaaagctcatggagagaatcgtgatgacagaattgaggatcatcctgccttgatgcccaaggaggtaagcaaggacacaaaagcacgctcatttcaccccagttaggtggtgtctattatcaaaaagacaaaaaatatccactgctggtgaagatgtggagaaaggggaactcttttccactgttgatggggattaaaaataagcacagccaggatggagaagagtatgaaggttcctcaaaaaactacaaatagaactaccacatgatccagccatcaccactgggcatttatccgaaggagaggaaattagtatattgaagggacatctgccccccgtccatgtttttgcagtttattcacaacaggcaagatacagattcaacccaagtgtttgccaaaggatgaatgggtaaagaaaatgccatgtatagatataccatggaatactattcaaccataaaaaagaaggaaatccatcatttgcagcaacatggatggaaatagaggacattatggtaggtgaaataagccagaaacagaaagttaaacaccacatgttctcactcatctgtgggagctaaagaaatttaacctcacagaagtgaaaagtaaggccaggcacagtggctcactcctgtaatccctgcactttgggaggctgaggcaggatgattgcttgagatcaggagtttgagaccagcctgagcaacatagcaaaaccctgtctctgcaaaaaaatacaaaaattagctgggtgtgcggtacttgccggtggtcccagctactcgcaaggctgaggtgggaggatcgcttgaacctgggaggtcgaggctgcggtgagccgagatcacgctgctgcactccagcctgggcagcagaacaagaccctgtctcagtagaagagagtgtactagagactaggaaaggtgggggaaggagaagatagggagagatttgttaaaggatacaaaattacagctagacaagaggaatatgttgtcatgttctatagccctgtaggatgactatagccaacagtaatctatagtttcaaatagctggacggaggatattgtatgttcccaaaagaaagaaatggtacatatttgacatgagggatatgctaattaccctgaccggatcactgaatattgtaggtattgaaccatccctgtgtaccccatgaatatgtacaattattatgtgtcaatttttaaaaagtaaattttttttttttaaaaaaaagtatgttcaacagccagcagccacgagaaggtcatcagctggtttcatccacagcaagagattgctggctccaaatccccaccccatcctcaaggggcaatattgcagaaaggaggagggtgggaaaaaaatctcaagaattggagaatcgccggtttccagggcccagaacaagacccaggaggagatgaagatcacccttgcaggtagaagctgtccctgtctgggtagtgctggggacagtaggtggcccttctgctgtctgtctgagcatgagctcaaggccaagggtaagatgaggggaaatgacccccagctgggctgagcgtactttgtttagggtatttaagcagttctcaaaagtgattgcagaacctgtatctcccatctcagggactctgcccagcctcacccctccctccaccccactgtcatgcccacgcttaggcttcaaaacatcaatggaagatgatagtgcagtgcccaactgcaggcccttacatgaataaactgtacatcacagagggggcggcaagggaggggaaaacagacagatccagctcagatggaatttgatctgaaggaaagtgataaagtgaagaagggatctgtcagccctgcaagcggccccaggcacagcgtgaaggggaggcagggagaggtcatgctggcctcagacttggacgctgaaatgtttagttacagccggaggggggacgcctgcataggtcctagggaaaggaggggacacccaggcattggagacccactgtgtagacgactgcgagacatgcttaaatatttagcagaaaggaagagaaattcgaatagagagattcaggaatgggaggaagggatggaggtgaaatcaaagctgtttaaatacagatgctcttcgatttacaattggtttacatcccaacaaacccatcgtaaactgaaatatcttaagtcaaaaatgcatttagaccaggtgcagtggctcacgtctgtaatcccaacactttgggaggccaagtgttggcagatcacttgagctcaggagttcaagaccagcctggccaacacggtgaaaccctgtctctactaaaaatacaaaagttagccaggcttggtggcgtgcgcctgtaatcccagctactcgggaggccgaagcaggaaaatggcttgaacctgggaggcggaggttgcagtgagctgagatcacaccactgcactccagcctgggtgacagagcaaaactcagtcccaaaaaaagaaaaagaaatagaaatataagcataaacttaaataactggggagcgttatgttggctgactgcaacacagatacgaaaaaccctgacagaataaaaagaattctaaccaaaaaggtattttgggccgggcacggtggctcacacctgtaatcctagcatgttggtaggctgaggcaggcagttcacttgagctcaggagtttgagaccagcctggccaacacggtgaaaccctgtctctgctagaaatacaaaaattagccggaaatcgcttgaacccgggaggtggaggttgcagtgagctgagatcgtgccagtgcattccagcctgggcaacagagtgagactccgtctcaaaaaaaaaaaaaaaaaaaaaggtattttggagttcctgtgtccacataatttcatccttcgatctcaccccctattctccccacctctccatcctaaggtcggtgaatactgcgtcggggaaattgacctaaaaaaatttgttatggtctatatattctctgatgagggtatttttctaaaagcaatgaagtcttcaggcttttaaaaggaagggattggggggcgaggggagggagagcatcaggacaaatagctaatgcatgcggggcttaaaagctaggtgacgggttgataggtgcagcgaaccaccatggcacacgtatacccgtgtaacaaacctgcacatcctgcacacgtatcccagaatttaaagtaaaagcaaaacaaaacaaaactctttttaacaaaaggtatgttgattgattggagattattatattacggtcacattttccaagataatatttgataacactgaacaaggagttgaaaatttgagctgttttgtatactagttatgtgactttggataaatcaataaatatttctgaacatcttaaaaaaaaaaaaaagagggatgctgtccatacggtatctgatatatagctcaccctccgcatctatgggttccatatctgtggattcaaccaaccttggatcgaaaatattggggaaacaaaattgcatctgcactcaacatgcacagacttttttctcttgttattattccctaaacaatacgacatagcaggtatcaacatagcatgtgcattgtaataggtatggtaattaacctagagatgatttaaagtctatgggaggatgtgcattgcttatatgcaaagacagttccatcttgtatcagagacttgagcatccgtggattttggtataaccaggaggtcctggaaccaatcctccatggatatcaggagaaattccatttcattaattcgtactcccggtggtctttgaaatgagtcgtgcaacatcactgtcacctgctgtccatttagtgagttactctgggttttttatttaggggagctgaaacacagatttttaaaaaaagtttattttcataaatcgcaataatgtcataaaagctgagtgtgcgtctggggctctttagtccagtagctactttggtatatataatgatggcaaggttgacgtgttttggttttgttgttgttgttgtttttgagacagggtctcgctctgttgcccaggctggagtgcagtggcacaatctcggctcactgcagccttgacctcctggactcaagtgatcctcccacctcctcccaggtagctgggactacaggaggtgccaccacacctggctgatattttgtattttttgtagagatgggtttcaccatgtttcccaggctactcttgaattcctgggctctagcgatctgctcatcttggcctcccaaagtgttgaaattacaggcgtgggccaccgtgcctgccccagatctgtgttttttaaagtaaagctgaatattaattttttccacatacattaatgtattaaggaaaaagttgcaattagtatcttctccagcgttttgtcttctagtatttggggtagggaaatgtagttaattaaaagattacagatgtccttcagtttttttttttttaagctatcaagtttttttactctttttgtagtgcatcttattttattcataatacacctttttgttgaagtatgtcttacttttttatttatttatttatttttttgagacagagacttgctctgtcgtccaggctagagtgcactggtgcgatctcggctcactgaagcctccgcctcctgggttcaagcgattctcctgcctcagcctcccaactagctgggactacaggcatccgccactacacctggctaattttttgtatttatagtagagccgggttttcagcatgttggccaggctggtctcgaactcctgacctcaggtgatccacctgcctgagcctcccaaagtgctggcattacaggcatgagccaccacgcccggcctctactaacattagtagaaccgttgactgtgtcccatatatctatgacacagttatctgcattttctgtcaatctttctccccatacttcagtctactgacctattttctagttaactgatctctttggctatgtctaatctgttgttaaacccacattctagcttcagttattatgtttttagttcaaattaacatcagatttttagttcaaataacatcaatgtagtttcaatactaccttgaaaatttttatctttttccccatcttatttaaagtatttctcacatttaattatagtccatgtctgataaattacatatctgggtttcaggtgggtttggttttgttgtttaattttgcttgctcttgattttcactcatttggtcttttcttgttgtatgatagttaattttttaattgacagccagacatggtaaatgaaaaagaattgcaaagacaatttgtagctctgaatcatattatcataacccaaagaggatttttttttttaattcatgtgatttgatgtgatttgtccataccctgaggtagtttgcccagaccctatctggggctgagctggagggaaattgggcttcagtgtttgtgatgaccagtctatttctggttctcctctcagtgaggtcacaaaagaaagcttgtggtgtgtaccagggtccctcattggtcctgattattaatatttatggacccctcagcctcctagcactgctggcaactctactcagtttctcagcttcccagcctcttatttgccctgagtggaagtaaggtaccaaatgtgacatttacctcttctgtttgtctctggtatcttcactcttaattttgtgctgccttagtagctctctgatgcacttaaaaaaaaaaaaaattctaggccaggtgtggtggctcacacgtgtaatgccagcactttgtgaggccaaggcaggcagatcacctgaggtcaggagtttgagaccagcctggccaacatggtgagacccccatctctactaaaaatacaaaaactagctaggcatggtggcacgtgcctgtaatcccagctactcgggaggctgagacaggagaatcacttgaacctgggagggagatgttgcagtgagccgagatggtgccactgcactccagcctgggcaacagaacgagactccgtctcaaataaataaataaataaataaataaataaataaataaataaataaaattctatatacattatttgtgcagcctttttaggtatttttggcagaagacttagtgtgaaacaacagcttcaccatttgctgaaagtggaaaaaatctcatttcagttcctgagctgatacatatatatttgtatttttagcattcaccacctccagcagtaataactttcacaaatttatagcccataatgcaaaggagtgcttccttttttgctgtaaatgttatctccttggattgtgtactggaacattctgtgtctgctgtctatctgttccctgcctcgtctgcctttacgatgtcctctctcagctttcatcttcccacacagagcattttgttttaagcatctctgcatatctcagcctctttccaatgacctgagaattcttctctggcctgcctccagtttcagagtcccttctttcaaggtgaccccatcttcagtcaggcttttaggggatacatcagtagaatagttattacctaaggataaaaagaaatgcagtttgtaaaagtcacattttatattcatgcattcacaagcttgccaaaaatgttcttaagagcggactttgagattgctgcattctcatcttaaaatttctctctgcatgatatgcaagggggaagtgtctactttttactagtaaaaataatggccatatttattcataaaagttggtttatgtttcggctgttaatattacttgttaagtaagcctctgggtcttgattagaaacattagcaagggctgactgaacttctcttcctcgtttaaattcgtaagattaacacatctgcagaaggcaagctgagaacttgcatcattatttcatcctctgtaatcaaacatataaccccgagttaaatcccttccgaggaaggattatacttcatgatcggccccgtggaacttatttatgtgtttatcgttgggagaaattagatgacagaaacagattgacattttccctaatccatttccaggaatggttttttgagcacttattctttgcctgtctggctgcttcatttatccatcacaataagtgtctgtgtgacatctcactgaaagccccatgactcagagagtcatttctgcaggtccttttccttgatgggtcagtattcaaatccaggacatccctctaccagccctggttgaagaaggaaattattcatttttatgggattcatatggtttatgataatgcagttattgcattcgtcattttttcccaagactcattttggtgttttgcaaggcgcatacccaaatcccgctctctcacttgctagttctcgtatgttgggcagtatctctgtctgcagattaaactttgcagcagtaagagggaaggctcaacctgtctgcctcatagggctgtcgcgattaaaaggaatcagggctgagaagtttatgagtgtcactcagcagccagccatgagcagccactaaaaaaggagtcctgttatcatggttgtctgatatctttgacaacttataattttgtgttacaccataattcttagaacttaattttatatttggattttacatacatagctgagatctgaaagaagaagcccatattttatttaatgttaatttttaaaaatttctctccagctgtattgaggtaccactgacaaataaaaattggtgtgtatttaaggagtacaatttgatgctttgctgtatgtatacattgtgaaacaatcattgtatcaaggtaattaacattttcatcacctcgcataaatgctgttttctcctcctcctcctcctcttcctcctctttctcctcctcctcctcctgctgctgttcttggtaatgagaacacataagatctactctcatagcaaattttaagtacacaatcctatattgttaactgtggtcaccatgctgtatgttagatccccagaacttatttatcttgtgtaactaaaacttcatattcattccttcaccaacatgtcttcattctaagcaccccgcccccagcccctggcaactactgttccactctattcttctgtgagttatttaaagtgcactttcggaggctgggcatggtgactcacctgtaattccagtactttgggaggctgaggcaggcagatcacttgaggtcaggagttcaagaccagcctggccaagatggtgaaaccccatctctacgaaaaaatacacaaaaaaaattagctgggtttggtgatgcatgcctgtaatcccagctactcaagaggctgagataggagaatcacttgaacccaggaggcagaaggttcagtgagccaagatcatgccactgcactccagcctgggtgactctgtctcaaaaataaaataaaataaataaataaataaaatcaattgcactttcgtgattatgagttagaatagtcaaattaaaaaaaaggttcatgattacagtgttctcttttacatcttaaagtttcagtaaatctcactaataatgacttttgggggtgttcagtttttatagataccttttttctatttctttctgtgctcctgttcctctgccttagggcattgcacatgctgatctgctttcacgtgcatttttcagcatgttcttcttcttacttcatttccagtcgttctacatcattggcttctactcagccttcaggcttcattttagatattacttccctaggagtgtctccccctttagaccaggtgaggtctcttgataacattttctttcctagaattgataaccattttctttcctagaattgataaccattttctttcctagaatttctcatggcttgccattttgtatttgttatttgttgattttctgtcttctttgacagtaagcttcatgaaggtgcagatcatatctgtgtaggccactgtttaatcttcactacctacctctccataaacacctgtgaaatgcatacattcatgcctcgattaggagaatgaactggacattctcctaaaagggaatgctaggatcagaaatttgggagctgagtatccgagtgactgatctccaccccagctgacatcactcaaaatctctgggatcatggcctgcgggtctgcatttgaaggattacaattctctgaagttggcctggtgcaggcaagaggggctcatgttgaggctcaaccccatccacccccaagaattccacagtgtgttttcagtgaggatgtcagtgttctcttatctctgttgctcacactcattaagctaactgctttgtgacctgacctgatgggggccccagtgtttggacacaggtttgcttcttgaccctgtatttgtcaaggtaggctagctgctataacaaacagcccccaaataagtaaaagtttatttctcatttgtatcacagccagctggggtggccaaggtatcctctaccccatgcagcctttcagggatccaggatgctcctattgttgtgcaccaccttctagggcagctcttctcaagtgagactccttgggaggattaggcgctgttgctgacggcagccactgtacgtaatgcattaagtaatctcctccccatctagcatggtgttagatatggaccatccttgggagagttgagaaaagagtcacctgatttgttctctgtttggttttattttcttatggaggcccagttcagagagggtggagggatcttgtttttcacctggctggtggtagaagagaggataggaatatcttattcctctcgttgcccagcccagaggtgactcacatcacctcctcacattcactcacatcacctcctcacattcactcaatctgcttgtgggaatcacttccatggtcctgtccaggtgcaaggaggtcacaaaatgcacttagacattagcccgagaagaagaagaaacaaacacaggtattggtgagcatatcaccttgccccagtcctatcccatatcaagttgtatttgcaccatagaggcagaaaaaaatggagtgggtattttcaattaagttgcatttatttgcacgaaggtttgacttaacttgcctttgctctttctttataacagatgatagcttgtcctgaaactgagactcctgccgtgataacgtgtgacccactgtcccagccttcccctcagcctgcagacttcacagagactgaaaccatcttggtattcctcatctatatgacctacacatggccagctctcttattgcttgttattttctcacagggtctatccccattacataccagtgggggcgccataggcttttaaaaattcctcccttttttttttttttttttttttttttttgagtggtttctcccacctggaataagttgtgttataattagtctatttctctattatccaggtggataaggaatctggctgtctgttcgaacttattgtggggttttctttttcgtcattttgttattctcttccactttgcttaaaaaaattaataagaaaaagatacagcgtctatatagcatctatgtctccattaatttttttaaacttttgataggacttgcaccatgtctaaaatcaatattccatgactatggattttattttaattctttttttctctaagtttacccttatgaatctgggcttttattgccacatatcatcagaaaactggctttatggacacccccctgtttttaaactctcaaagagactatcttagtaaaatgcttctgtaggcatttggtataaacaagtcaaatctctctctgaaaatttaacttccatgaattgcataagaacttgtagcatctcctcttgtctgagacttggtggatggctcagaaaaagtgaggggagagaagctgagctatttttagcattcccagaaaagaagatcgagtacagtccatcagtttttttaaaaaagttaattatagtgccggccgcggtggctcacgcctgtaatcccagcactttgggaggccgaggcgggcggatcatgaggtcaggagatcgagaccatcctggctaacacggtgaaacccccgtctctactaaaaatacaaaaaattagctgggcgtggtggtgggcgcctgtagtcccagctactccggaggctgaggcaggagaatggcgtgaacccgggaggtggagcttgcagtgagccgagatcacgtcactgcactccagcctgggcgacagagtgagactccgtctcaaaaaaaaagttataataaagatgaggtcttgctattttgccgaggctggtctcgaactcctgggctcaggcaatcctcctgccttggcctcctaaaatgctgggattacaggcatgagccaccgcgcctggcctcaacccaataatttgattttattttaccccaggataaagagttctccatcatttaggttagggctacagttccctgcagcccaccgcagactaatgatggaatggttatgttttagcagccagcaaataaagtcgaaagtgtctcatccgaggaaaccttcgaaccaagccaggaactccctgctgaggctctcagggaccccagtctgcaggatgcactggaggtggtatccaaattcttccccttgcccaaggctcccggtgggggccatccaccgtcactgaggtcaactgcatgcacacaacagctgttaatttttcagcctcatttaacaaaaaataagaatcggcttccctcttcccctgcctctgattcttctgtcttctctctggcatttgcctggggtgatcggccgactctcttttgccatcttcaagtctgatcatcacgctttttctctctttaaaagctgttctgcagaagggatcaggagggaagttgagggactgtggaaattaatgcgtagcaatccattttctgaaatgaagagattaaaagctgaaaattggagggagtggggcatgctaatgttcgaatccaaatggggcatgcaaataatttcttctttcaggatgaaatgagagatgcatgctttctgttccttcctcttagagatgttttcatcttcaactacgttctctccattgatgcatttaatgaaagcaattgctaacgttttctcttgctctttaagcatgatctaataatgccatttggtctttaagtaacaatcaatacagctctagagctaggtttaggtctagactgaaagttggtattgaacgcatgtttagagtgtgacctactgtgttggctaaatgccttccctggacagtcacccttggagaaaatgtgaacttgtttttctcattcttacttggttactgttcaaatgcagcattttgaacttaatttctagagctgttggttgaggtccaggtttcttataaacatgtgaatgtatcccttcagcatgttccatccttgtggtcatcatttgaggctctgtgaattgaatctgtagttattagtgagtgacagggcatcagtgtgaggttgggtaagacctacgttggacagctcagccatgtggtaggtttgggatcctggatgagttcattactttttctttttaaaaattattattattattattattatttagggacagggtcttgctgtgtagcccaggctggagtgcagtggcatgatcatagctaagcagtcttcctgcctcagccttccaaggaaatggaactacaggcatgggccactgcaaccagctaattttttatttttattttttgtggagttggggtttcactatgctgtccaggctggtctcgaacacctggcctcaagtgatcctccttttttggcctctcgaaatgctgggattacaggcatgagccaccgcgcccagcctgagttcattactttgcttcagtgttcatgaggtggagactgggttgcccacctcacagaattggaaggaggggtattaaaaaggagagtggtatagggaaagccctagttagtgcttggctcataaagatgaggaagatttcggtcattgatttgctaaaccggggcactttgacctcctgtgtgtccacactgtcctctaggggaactttatttagtatcttgtataataccctaattcataacattggagcagcttgttgttttcttggatactcatctcttgttagcagaaatgtcacaatcactgtgctgttttgtcttgaaaactagtataaggttgggtgctgtaggtcctgttaattccagaaacatttcattctcaggaactgaatggatctaaatgcaagtgctcttagaggggagaaatgctgcagtatcctgaagtggactttttaatttatttgttaactcttgctatcaccttaatcaataggatggctgtctttaaataaaatataatatatgggaatgagtgtagaaggcagaatcttatatgtaaaaaccttctaaaaacactgcggcaagtaattagagaagaaagtagtatatgcctatggtgtaaaaactcaaatttatctttctatatatctatctctatacatatcatgtatctatctatctacctcttatctattttctttttttttttttttttgatggagtctcactctgtcacccagtctggagtgcagtggcgtgatctcggctcactgcaacctccgcctcccgggttcaagtgattctcctgactcagcctcccgggtagctgggactacagtcacccacgaccaagcccggctaatttttgtatttttagtagagatggggtttcaccatgttggccgggctggtctcgaactcccgacctcaagtgatccacctgcctcggcctcccaaagtgggattacaggcataaaccaccacacccggctatctatctattttctatcatctatctcatctatatatccattcatcctcacatctagataatagatacatagatatagaagagataaaacataggtagtagatagagatgatagataaatgaatgatagagtgatagatgatagataggtagataggtagagagatattttagataaatagataaatgatagagtatagaacggatggatggatggatggataaatggatagatagattgatagaaagtagataggtaggtagagatcatagatagataaataggtagatagatgatggagtgatagatgacagatgatttattgataaatagaatggatggacagatggatggatggatggatggatgagtggatagatagaacataggtagatagatgagatagatgatagataatagatggttggtagatgagatagatgataaatagatgatagatagatagatagaaagatgtgtgtgtgtctattattgttaccatctttaaatttttaagagtctttttctagttcttggtaagaagtgtttaaagcaaatgtatttgttctttttgttgactcatctgaatgccaaacaaaatgtgtgtgtgtgtgtgtgtgtgtgtgttgttacacacttgcattttcatctgttttttcacatgacccttaagaaggcaggaactctgccattgaaaaaactatctgaattattatttaaattcctttgccaagcagtccaaattcttataggctttacttacaggaggtgagttgttttttcatttaacgtagtttggttattcactgtcatacaaaacagaagttttggtgggtgagagtattaaattagtgtgtgtgtgtgtgtgtgtgtgtgcacatgcgcatgtgtgcatgtgtgtgtttaaaatggtttagtggctagaaatgaaaacaattcttcagaaaaagagaacatatacaattacattttataaaatttcaaaacacttaagcaaaaaaaattatcttctaagcatattatactaaatctagtgtatatttagctcaaaagaaaagtgctgctgggtgtggaggctcacacctgcaatcccagctcactgggaggccaaggcaagaggattgcttgagcccgggaattcaagaccacactgggcaacataatgagaccccatctgtgcaaaaaatacaaaaatcagctgggcatggtgatgtgccctgtagtcccagctactgaggaggcagatgtgggaggatctcttgagcccaggaggtcaaggctgcagtgagctgtgactgcaccactgcactccagcctggacgacagagaccctgtctcattaaaaacaaagtgctagtgattcgcaatctctttttgagaactgagatgcatctttctgcgggaccctacactggatgggttttagcagtctttccctcgataatggacagctgcaaaaaccatctcccactgactgtcttccctaggtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatggttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgaggctcgtaggatatttcaggtgagtcagggttggatggtcatcggctttcagaaggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgttaaaaaacagccatgtggcctccttccagtgtgtgtttgcctatttcctgcgatatcaggcttatattttatattaaaccaagggtagggcctttctattttattttcggccttttctattgtattttgtttttaaaatagtaagcatcgggctgggcgtggtggctcactcctgtaatgccagcactttgggaggctgaaacaggtggatcacgtgaggccaggagttcaagaccagcctgggcaacatggtgaggccccgtctctaccaaaaacacaaaaatattagccgggcatggtggcacacgtctgcaatcccagctactggggaggctgaggcacaagagttgcttgagctggggaggcagaggttgcagagagctgagatcacaccaccatactccagccagggcgacagagtgaggatctgtctcaaaaaaataaataaataaaatataataataataataataagcattatttgagctggaattgcaaggtaaaattttaacagtaaacaataaacatactttattttatttttgatttaaaatgttttttaactgtcatgtaataattgtacatatttatggggcatgtagtaaagttgcagtacacgtcatgtctactgatcaggtcacgggaattagcatatccatcatctccaacctgtaccattttttgtgttgggaacattcagtattctccttctatatatatatttgaaactatataatatatgattttgagctgtagtcatcctatagtgctatataccagtgatccccaacctttttggcaccagggaccagtttcatggaagacaatttttccagaaaccaggctggggggatggttttgggatgattcaggtgcatgacacttattgtgcactttatttctgttatgattacattgtaacatgcaatgaaataattatacaactcagcatcatgtagaatcagtgggagccctgagcttgttttcctgcaactggacagtcccatccaggggtgacaggagacagatcatcaggcattcgattctcataaggagcacgcaacctagatcccctcacatgcacagttcacggtaaggtttgcactgctatgggaatcttacgcggccgccgatctgcaggaggcagagctcgggtggtaatgggagcgatggcgagcggctatcaatacagatgaagctttgctcactcgccgctactcacctcctgctgtgcggcccagttcctaataggccatggaccagcactggtctgcagcccaggggttggggacccctgctatagaacactagaactaccttaaaaaaaaaaaacccaaaactggatctcatagaagtaagaactagaacagaggataccagaggtcaggaagggtagggagaaggggtgatggggagagatttgttaaagggtacaaaattacagctagataggaggagtcagttccaacaataaatttaaattatcagatggatttttcagaattgctggtcacagtgaaatgcatagaactgtttacttctaactttttgcgatcttgcaggatctctttaggaaaggtacccattttctgaactttgctttgtcagtttcattcattcattcgtcatatgcttattgagtgctctctttatacccagctgtgtgacatgggacaaatcaatacaccataagtttgggaatatacacttttttccacgagaaatcctcattgtcagaagtatcttcattcaatgggcacaatatgctgtgtatctcactgggtggctgtcaggggccaccgagagtgtcgttaaaaatgggcatgttgattgacgtctcatgtctccctagaatatataaaaccaaactgtgctttggccaccttgggcacatgtcgccaggacctcccgaggccgtgtcgcaggtgtgtgtcctcaaccttggcaaaagaaactttctaaactaactgagacctgtctcagattttcagggttcacaggtacagtgctgagtacgtgggtgggggtacctcactaccatagaaaataccctagtgacaaaccggcacgtgtaccccttagacctaacataaaagttgaaattatttaaaaataaataaataaatattatgagattattatcttgtggcaagtggaaatgatgtgggaaggaaaggatttctagatctgtcgaattggcagggtggattgatgcctacagatccacaggaataagttatagtatttttgttcctcaaagccacttggtcgaatcctgccaaaacctttggctgatgcttggaagcacgaaacaggtcctagtgttaacgcgttttggggtggaactgtagtttgaagcagaaaggggtttctttctgaccaccacccttgaattaggaaaagcagagcaattctttctggtttcataggcctctgctctttagtgtacagtaccattttaaaaattatttatttatgtatctttggccgattacagtgactcacacctgtacctggtactttgggaggccaaggcgggcagatcgcctgaggtcaggagttcaagaccagcctggccaacatggtgaaaccccgtctctaccaagaatacaaaaatttgtcaggcatggttgtgcatgcctgtaatcccagctactcaggaggctgaggcaggagaatcacttgaacccaggaggtggaggttgcagtgagctgagatcacaccactgcactccagcctagacaacagagtgagactctgtctcaaaaaaaaaaaaaaaaagaaagaaaaataaaataattaaatcatctattttaattattttattattttttatttttatttttttgacacggagtctcactcttgtccaagctggagtgcagtggcccgatcaccgcttcctgcagcctccaactccagggctcaggtgatcctcccacctcagcctctcaagtaactgggattacaggcatgtgccaccacacccagctaatttttttaaactttgtagaggcagggtctcataggagtctcactatgtggcccaggctggtctccaactcctggcctcaagcattcctcctgctttggcctcccaaagtactgaggattacaggcatgaaccactgtgcctggcccccattttttttaatagatcaaatgagttgcataggtttacaaacttgatgtcttctatccctgctctatccatcatcctaagaaacaaaatgaagtttttattggcacagacaatatctgttggaagcacattcgtgcaaatccagctatacctagtatgtgacatgtactgtgcaagaatatactttacacgggattgtagcatgccttgaggatgcttgtctggattccattgcatagttgctaaatgctgatgctctgtgagtctgtcattattgcagcattcatggcccaacactcagctgcacaaaagagcttttctgtttctctttccctcc

SEQ ID NO: 122 - DNA, 108957 bp, Homo sapiens
cctgctaaaaataaaaattgaacatataactcctgaactagtggatgaaaatgaagaatgaagaataaaattaaatacaaaaaaaatgaagagtaaaattaaataccaaaattagccaagtgttgtggtgaatgcctgtagtcccagctactcaggaggctgaggtgggaggatcacttgagccccagaggtggaggttgcagtgagctgagattgcgccactgcacttccgcctgggtggcagagccaggctttgtctcaaaaataaaaaaaaataataaattaaaaacctgaatactaaatggaagttaagaaggaaggaattaaaaaagaagaaaagtaaaataaaatagtaggaatagtgaatccttagttatgttagatgttcagtgatttaataaatctgtaaaaagacggagatgagatgatgcaatttaaaatgtttcggctgggcgcagtggctcacgcctgtaatcccagcactgtaggaagccgaggcgggtggatcacgaggtcaggagatcgagaccatcctggctaacacggtgaaaccccatctctactaaaaatacaaataaaatgtttcatgctatttacgagagaagcatttgcaacaaaatgccaaagagaaggtgaaaatagctggaaaaaaaatgcgcaaagcaaataaccaatagaaagaaagccaagttgggctagcaaaatcagacaaaataaccttcgaggtgcaaacaactttgaggcccaaatagaggttcttcccactaaaagaatgattccctgaatgataatggaatcttgacccagcctgcacctcaggttaagttaaaagtggaaatttaaagatctaagtgtgagattttaaaaagcatttccccagaaataccaggatctgtagatggaaatgttattaagaataaagatgtggagctgggcgtggtggctcacgcctgtaatcccagaactttgggaggctgagactggctgatttcttgagcccaggagtttgagactagcctggacaacatagtgagaccccatctttacaaaaaaattaaaaaaaattagtggacatggtggcatgcacctctagtcccagttactcaggaggctgaggtgggaggatcacctgtgcccaggctgaggctgcagtgagccatgatcacgccactgcactccagcctgcgtgacagagcaagaccctgtctcaaaagaaaagaaaaaaaaagaagaaagaaatgaaaaccgtagctcagagacagagaaactgagcaatgcataggttcagaagggtttgaaacagactgaattgtgtcttggcatatgagagaggtcgcagctataaaacaatgagagaagaaaccaaattccacataggcaggactgagacaattggctgttcttgtggatgatacgtgatcaaatctcaacctcatgcgatacttttttttttttttttgagatggagtctcgctctgtcacccaggctgcagtgcagtggtgtgatctcacctccccgcaaacttctcctcccgggttcaagtaattctcgtgcctcagctgggactacaggcatgtgccaccacgcctggctaatttttgcatttttttagtagagacggggtttcaccaagttggccaggctggtctcgaactcctgacctcaggtgatctgtccacctcggtgtcccaaagtgctgggattacaggtgtgaaccaccacacccagcctcatgtaatacttaaaaatgaactacaggtggattacaaacctgaatataaaagaaaacttttttttttgaaaaatagagggaaatgtcttataacctcagagttaggaggtttttcttagatacaatacaaaaagcataaccacgcccatagtcccagctactcaggaggctgaggcataagaatcacttgagctcgagaggtggaggttgcagtgagccgagatcctgccattgcactccagctgaggctacagagtgagagtataaaaaaaaaaaaaaaaaagcataacctttaaaaatgggttagcctatgtctacatttaaataataataataataataatgttccaacttcaggctctgaaaaaagtcaaaagatgagctgtcaactagaagaggctccttactgctcataccaccagggaaagtttaatatgcaaaatgcagtcatccttcagaattcatgggggattagttttaagacgccttcttccccgcagacaccaaaatccacagctgctgaagtctctgatataaaacgtgcagtacttgcatataatgcaagtatatgttcctgtatatttttatttatttatttggagacagaatctcactctgttgcccaggctggagtgcagtggcgtgatcttggctcactgtaacctccacctcccgggttcaagagattctcctgactcaacctcccaagtagctgggattacaggtatgcgccaccacccccagctaatttttgtatttttggtagagacgggttttaaccatgttgtccaggctggtttcgaactcctgacctcacataatctgcccaccttggcctcccaaagtgctgggattacagggatgagccaccgtgtccagcctctggtatactttaaattatctctaggttactcataactcctgatacgctgtaaatgctatgcaaatagttgttatactatattattttttatttgtattactttttattggattgctatattttattttttgaaatattttcaatacaagactggttggatctatagatgcagaaattctggttatagagcacaaactgtgtatagatagctcctaccaaaacagacggatggtgaaaaaaagaaaagaaaagaaaagaaaaagaaaatggaggagagagactatgaggcgactaaaagaagagggatatgatcattccattcgctgacaagaaaaattcaaagaagagggaattatgcaattgaccagctgatgtgtgttagaaatgctcagggtcacacatattcattgaaagccaatttaagccactatttaaatttaaaccgatttaaacaattgggcttttttttttttttctaaaaaaaaaaaaaagtcaattaggccaggcgaggtggctcacacctgtcatcccggcactttgggaggccgaggtgggtggatcacaaggtcaggagtttgagaccagcctggccaacatggtgaaaccctgtttctactaaaaatacaaaagttagctgggcatggtggtgtgtgcctgaggctgtgagactgaggcaggagaatcacttgaacccaggaggcggaggttgcagggagcggagatcatgccactgcactccagcttgggcgacagaccaagactctgtctcaaaaaaaaaaaagaagaagtatattggttccgtctggaaaggtggagcacttgaagcaaaggcaggaagactggaagcagggagagggttttcaggtcacaaacaggtgagagacaaaacagttgccttcttttgagtttctgattagcctttccaaaggaggcgatcagatacgaatctgcctcagggagcagaggggggactttgaatagaatgggaggcaggttggccctaagcagttcccagctggacttttccctttagcttagtgacttgggggtcccgagatttatgttcccttcacagtgtatgagtgagagcacttggaaactgagagtggaagtgtcgcaggccaggtctcactaacacaggcccccacaacacctgtttcagtattgactgagtggttaaatattaaaagccagtgctgttatacaaaggctggaatgtaacaaaagcccaccgagagtttttcccaggactttcccgggccttaaagcatgacaaaataatgaatgaattcttaacaggacccatttaggattaaacaagttttactgggggtctgcagaaactccccaggcctccacaaacaagtttattggggctttgaaggaactctgcaaacctcctggatttagcaggagacaacatgagggtaatcaccccggcacctggacccattagattaagtcaatttactgaggctcctgaggaagatcctcaggactcagaccttagttatagattaaaagaagttaatcacttatgtctttagataaatgcacacacatatctccacatagcttggaaggtatataagctctggaaaactataattttgagttagtctggtgataatttccaggccttctccctgtaacaggttgcagaaataaaaactctcttcctccccagttcatcggtgtttcattattgggctgtgagaaatagcaacccagttgggtccgggaacagaaggtttggtgttatcttcatcacaggcactggactgtcggtaaatttattccatgacaattcttcctaggtttcttttttatattacttgcttccatcatggcagacagctacactggcttcttgccatgaaaacgaacttctagtaacaaaacggaaacctttttttttaagtttcaggtttcaaggttttacttctatctgcaaagtgatttttaaccagacaatggcaatctataaacacaccgtgggcagcaaatcagaacaaactgcaaggtcgatagtcacgctgatgagcttgtttctgcagcctgctcctaagggaaggacaattttcttttctaacagtgcaatgttgtttcctccacagatatctacccaaagccaaaaccaccttactacccacagcccgagaatcccgacagcggtggaagtaagaatccgcaggcctgaaactctttctcaatctggtttgatgatgtttgcctttttatttactagcaggtttagcctggttgcatttgaaatatgtgtgtaatagctcccttactgggaatgtagtttctttcctcactggggggagcaagaaagtccaacggacagaaacaatcttattttccctttgctttgacatctagaaaccactaaggtgtacttgtaaccacccaactggttcactttgttggctgcctagacagagctgatttatcaagataggggaactgcaatggagaaagagtaattcacgcagagccggctctaagggaggctagagttttattattaatcattcagtctctggaacatctggggatcagggttgttaaggataagttggcaggtaggggcttgggaagtggggagtgctgaccggtcaggttggaaagggaaccatagggggttgaagtgaggttttcttgctgttttctgttcctgggtggatggcggacctggttgagccagattaccgggctgagtggtgtcagctgatccatccagtgcagaggctgcaaaatatctcaagcaccgatcttaggttttacaatagtgatgttacccccaggagaaacttggggaggttcagactcttgcagccagaggctgcacgagccctaaagtgtaatttctaatcttgtagctaattttttggtcctgcaaaggcagactggttcccaggcaagaagggggtctttttgggaaaggggcattcttaattttgtttcagagtgaaaccacgaactgaattcgttcccaaggctagtttggctcacacccaggaaagaacaaggacagcttaaaggttagaagcaagatggagttggttaggtctgacctctttcactgtcatcatttcctcagtcataatttttgcaaaggccgtttgatactcaaaggacactttgcattatcatcacagaaagctaatcaggctgagagacaagtcctttctctcacttgttttcagtgctccaaatacctttggcttaaccattcccaaacccccacgtgtgctgtgcactttatgtgttttagagttggtttctccattttttctaacatttggcagacagtttttttccacagatttattacactcatcattgaaaaatatgcaattcaaaaaagaaagagagtgaacgagagagagaagagtggggaggggggtgggcatggagagagaaagagaaagagaaaagaaaggggaaagaagaaaggaaaagatagattctggccattaaagttatcagcagttcaacaaccttaaaaacttaaatgtttgccaggcagagcagcgtgaagctggctaaatcaagaggggttctggaagcttcctggtagtttgctctggctttaaactttcacagcttaacagcgtgtccattcattgcagacacgcacatccagatggacagaaattatctcctcttacaaggaatcattaaaaacagagaccaagacccaagggaggtgacacccacttgaaaaactacacctcaggccgggcgtgggggctcacgcctggaatcccagcactttgggaggccgaggcgggcagatcacctgaagtcaggagctcgagaccagcctggccaacatggcgaaaccctgtctctaccaaaaatacaaaaattagctgggcatggtggcatgcgcctataatcccagctacttgggaggctaagacacgagaattacttgaatccaggagaggaaggttacagtgagccaagattgtgccactgcactccagccggggaacagaatgagattctgtctcgaaaaaccaaaccaaaccaaaccaaaccaaacaaaacaaaaccccaaaacaccacctcacccttaactgcattagttaagccagctagtctttcttttttccccctctttcatgatgaaaatcccaaataccacccacctttttctcctgctatttcctcctagtcttttaaaaaccattgtcctgcggatcatggctatgttgcaaggcactcatgggaattccacagggaacgtgtttcttgctgaaacatacttgggaaacgcccagttaaacagactgccgtgggcttccctcccagagaattcatcaggacttaaaatgtgtggctgggcatggtgggtcacgtctgtaatcccagtactttggtagaccgaggctggtggatcacctgaggtcaggagttcaaggccagcctggccaacatggtgaaaccccatctctactaaaaatacaaaaattagtcgtggcctgtagtcccagcaactcgagaggctgaggcataagaatcgcttgaacctgggaggcagaggttgtagcaagctgagatggcgccactgcactccaggctgggcaacagagcgagactccgtctcaaaaaaaaaaaaaaaaagaataagaaaaaaaaaacttaaaatgcgagatcctttaagatgggccatcttcagagtgtgaacactcagcccctcccacagcaaagtgattcatgaaccccaataggaggaggagtgggggaagagaggctcaggctggggaggtgaccccccatgactcaagcctcaatctcctgatgcttgtcccaacaaagaggaggcttcctttccgactttggtttttcatgttgtgcttaaatccagccacactgatgcctttaacatggcagtcctgaattattaatcaatactgtgtgaatccaaaatatctgagacaggtctcaatcagtttacaaagtttattttgccaaggttaaggacgtgcccgtgacacagcctcaggaggtcctgatgacaagtgctcaaagttgtcaggacacagcttggttttacacattttagggagacaggagatatcaatcaatatgtataagaagtacattggtttgatctggaaatgcgggacaactggaagcaggggcttccaggtcacaggaagatacgagacaactagttgcattcttctaagtccttgatcggccttttactgaaaactcaatttacatgtgagacagggcaaaggaatagtacttatgcctcagtctggcccagtgaatctgcatttttcatcaacaatagggcagaggaagcaatcagacatgcatttgtctcaggggagcagaggggatgactttctgtcccacacctgtgaagatgagctgttggtgtacattgccagggtgaaattccacagaactgttttagggtaaacaaaacagtttactttcctcagattgtgaggacagtatgtagcttttaaaaaacttaaaaaaatttttttgtagctatcttatttagaaagaaaatgggaggcagatctgactaactttttttttccagcttgacttttcccttggcttaatgattttggggtcccaagatttattttcctttcacaattgaacatcagaacatggagtatttaacacaggaaatgagcaaatttaacgtacacacccaaggaaaaggaaaaatgaagctggttggaagttaattatggatagtgtggtatatgagcagaaattccccttaaccagtgttcttgcccaggctagcccaaatgagcccaggctagcctagattcccaagtgtgtatcttgagaacgaggaagagccctagaaaacaatgtgtaacgtccctccaagatggggtgttctggaacaatccctcagacaacgaaggcaattgttgatgggcaacattgggaagaccccagagatggaatgtcctaggcctttccatgttctctttctcattctccctccattgacttgataggtggctgggggatttataagtatttaccacacaccagccagctttctccggatggctccaggcatgcttggagcccagtggtctctttcccttagaatttgatctggaggaacccaaaattctctctgtgtcctttgaaattcagcacatttttcttggcttccatgagctcctgtggcatttctcaggccaactgttgactctgcttcctatgtctgtgcttgtccctttgagagatgtcagcgttgctcaccgattcttttctctgaccccagcagctcctatccatgttgtctttttttttttttttttcagacagagtctcactgtattgctcaggctggagtgcaatggcacgatggcatgatcttggctcactgcaacctccgcctcctgggttcaagcaattctcctgccttagcctcccgagtaactgggattacaggcgtgcaacaccacacctggctaatttttgtacttttagcagagacagggtttcaccatgttggccaggctggtctcaaactcctgacctcaggtgatctgcccaccttggcctcccaaaatgctgggattacaggtgtgagccactgtgcctgtcctcatgttgtcttgaaagtaacaagacaggcacggattctttttgatgcaagctgttatgggatgaattatgtctccccgcaaattcataggatgaagtcctaacccccagtttcctcagaatgtgactgtctttggagatggggcctttaagaaggagattaatgtaaaatgaggtcactagggtgggtccggatccaataggactagtatcctaataagaagagatgaggacttagacacacacagaggaaagattatatgaagacacagggagaagacggcatctacaagcccaggagagaggccttaggaggaaccagcccagaccatatcttgatctcacactcccagcctccaggactgtgggagaatcaatgtctgttgtttataagccacccagtctatggtgttctgtgacagcaacctgaaatggactaagacacctcataagaaggggagatgaggacgcagacacacacagagggacaatcctgtgaggacacagggagaagatggcatctgcaagcccaggagagaggcctcaggaggaatcagcccagcccacacctggatctcagacttccagcctccaggactgtgggagaatcaatgtctgttgtttataagccacccagtctttggtattctgtgatagcagcctgaaatggactaagacatctcataagaagaggagatgaggacacagacacacacagagggacgaccctgtgaggacacagggagaagatggtgtctacaagccaaggagagaggcctcaggagtaagcccaggaatcaatgcagttggaggttctgtgtgtgaatggaggagggaagctcacagatgaaggcgttttgagggaggactgaccttacagtgaggtacccagagacttcctgaaccaagccacgaatatgcagctcgtgctccgggcagtgccttctggcctggaaaccaaagctcccttgtgtccagtccccactcctctgtttggcccccaagtttccataatcccccacagttgtatcattttagagacctcaaaagagagtctaggctgggcgtggtggctcatgcctgtaatcccagccctttcagaggccgacgtgggtggatcacctgaagtcaggatttcaagaccagcctggccaacatggtgaaaccctgtctctactaaaaatacaaaaattagctgggcatggtggtgtatacctgtaatcccagctacttgggaggctggggccagagaatcgcttgaacccaggaggcggaggttgcagggagccgagattgtgccactgcactccagcctgggcaacaacagcaaaactccttctcaaaaaaaaaaaaaaaaaaagagagtctaggcagggcatggtggtccatgcctgtagtcctagctatactcaggaggctgaggtaggaggatcacttgagcccaggaggtggaggctgcagtgagctatgattcaccactgcactccagcctgggcaacagagcaacaccctgtctcaagagagagagaaagggaaagagagagagactattttgagaagtgaaaaaccagtcattctcagcccagatttccagtgttctgagacgtctgtcctgaggaaggactttgagaacagcatccttgccttttttgtgaattaaagtaatttcactcttgagccaatgtggataagcacttgacaggtactggcagtgccaggtaccaggaatatagaatgggtacagaaaataaagtttctagtccagcgacaaaaaggtgctgaagatacagactcatgtcgtgcaaagagcttgcactgattatttcatttcggcttcttgaatagggtcaaaggacatttaagctgagacaggagggacgagctaattaatgcttttccagatgacaaatggattcttcaaatatttagggagagtgtaaagtgatggacagggaacaggaggggtcatgacagaaggaatgccacctgcaaaagtcctggggcagggctgggcacggtggctcatgcgtgtaatcccaacactttgggaggccaaggtgggcagatcacctgaggtcagaagttcgagaccagcctgggcaacatagtgaaatcccatctctactaaaaatacaaaaattggccaggcgtggtggcacacacctgtaatctcagctactcgggaggctgaggcaggagaattgtttgaacccaggaggcagaggttgccgtgagctgagatcacaccactgcactccagcctgggcgacaaaagcgaaactccgtcttaaaaaaaaaagtcctagggcagaaagctcatggtaaacttgaggaacatgcaaaagtcattgcaaaaagttttaagaaattcaaatgaagccaggctcagtgtggctaatgcctatgatgattccagctctttgggaaggcaagacaggacgattgcttaagaacaggaatttgagaccaacctgggcaacatagcaagaccttgtctctacacaaattttaaaaattagccaactatggtggtatgcacctgtagactgagctacatgggtggctgaggtgggaggattgtttgagcctaggaactcgaggctgcggggagctatgattgcaccactgcactgcagcctgggcaacagagcaagactctgtctcaaaacaacaacaacacaaattcaaatgaaacggtgtaactcaagcaagatggaaatacaacacactatcaaaaggtcagatgtttcatcctaacatttatagaagtgactgacttctgtaaatggtgctggcatctgtagtagccctaaacagggaaaggtcaacaacgcactttctgccctgttaatttcagagagccctggacttcttgcgaaagcaccagtggtgtaagtttttgttttttcattgtaagctctgaggtggtattatgaatattgtctacatgattaataagctccgtaaaagcaatgggcagtaacatcttttctgtactttggcattcttatttatagatggtatctacctgaaagatgtcattatttttctgaaatcatactgttgttttccaacagatatctacccaaggccaaagccacgccctcaaccccagcctggcaattccggcaacagtggaggtaatgagtatttatttatttatttttattttattttattttattttattttactattttatttgattctatgttattttactttattttaccattttatttgattctatgttattttactttattttatttgattctatgttattttactattttattttattatttattttggagacagggtctcgctctgttgccctggccagagtgaagtgatgtaattgcagccttgaactcctgggctcaagcaatcttcctccctcagcctttcaagtagttaggactacagatgtgtaccacctacattgcaccacctatatttcaccacctatattggctatatttcaaattttttgcagagacaggatcttgctgtgttgttcaggctattcttgaactcccggcctcaagcaatcctctgcctcagcctcccaaaatgctgggattacaggcaccagctattgtggcccagcctgataatcagtattaaagtccattttagaagtgtttggggccaggcacagtggctcatgcctgtaatcccagcactttgggaagccgaggtgggcggatcacttgaggtcaggagtttgacaccagcctgagcaatatgatgaaaccctgtctctactaaaaatacaaaaattcgccgggcgtggtggtacatgcctgtaatccagctactcaggaggatgaagcaggagaatcgcttgaacccgcaaagcggaggctgctgtgagttgagatcacgccacagcactccagcctgggagacagagcgagcccctgtctcaaaaggaaaaaaaaaaaaaaaaagaagtgcttcacgcctgtaatcccagcactttgggaggccgaggtctcctcaggcagatcacctgaggtcaggagtttgaaaccagcggccaacatggtgaacccctgtttctactaaaaatacaaaattagctgggcagagtgacgcgtgcctgtaatcccagctactggggaggctgaggcaggagaatcgcttgaacccaggaggcggaggttgccttgagccaagattgtgccaatgcacaatctatctaggtgatagagtgagactctgtctcaaaaaaaggcgggggggtggttggatacaagtattatttaatgacttaaaaattctcatctccatggtgaaagaccaattgcttttgaaatgcacagacattgttttgcgaggagttcagttctactatccaccagcacctggggattacatttagttgatagtaaataaatttaaatgtttttgatgacattgactgaaaaataccatgcacactaagacatttcaagttatgatggaggaaggcaattttttcttgtttttttttttgttggtctgtgttctactcacttattcttccctctgcaagagttatctgcggccactttgcctgtgttcctacagcacttcccatctccgccttggcaattgtgtctcacgaacgtgagacactcaggaaagagatgctggtctgtaaagttggaagagtctcagcgattccattggtggggcaaatgtgtgcagattgaggaagctaagatacactgggtgtcttcctctctccacctgctttaaccattgggagttcccctgattgtgattgtttcaggacgttgcttggatgttgtcatattcctagggttcaaggcactccgtgaaatccaaggaaacaagctttgggtatgtcccagtgccttttcccttgggtcttgcaactgaagaattgtgtttcttccctagaaaaacgaacacacttttgcccactcacccacctcctgcaagtctccaaaaccacagcgttgtatcctagactatgttcccccaggaggtggttcctccctctgcattcccgtactccatactgcttgatatgttcttacatgcaacaccgtgcaattgtgtttagttgattcctgtgaattagaatgagaactctacatgggcatggatttttgcctttcattcactgctgcattccctagtctggaaagctgtgcctggcacacaatgagtcctaggtgaaggtcagtgaagtcattaatgcttgagtcccaacaggcaaacagctggattcatgaatgaaagacttaccgctacatcccttcatcagggtgtatagcttcaactccatttcctggaaagctctacaatagttcttcctcctcaaaaggctctggtcttgtgattcatagcattcgtccaccaagacatgaacaagggatctttatgtcagaggttccctgttcaaagctgttttagaggccaggcgtggtggctcattcaggtaatcccagcactttgggaggccgaagtgggaagaccacttgaggtcaggagttcgagaccagcctggccaacatggtgaaaccccatctccattaaaatacaaaaattagccaggcatggtggcatgtacctgtaatcacaactacttgagaggctgaggcaggagaatcacttgaacctgggaggcggagttcagttggagttgcagtgagccgagatcatgccattgcactccagcctgggtgacagaacgagactccatctcaaaaacagtaaaaataaaaaagctgttttaggaaacatcccttttttattattttttctttgagtcagggacttgcttggttgcctaggctgaaatgcagtggcgggatcacagctcactgcagcctccacctcctgggctcaagcaatcctccgactttagcctcctgaatagctgggactacagacacacagcactccacctggctaattttttcttttttctttttctttttctttctttttctttttctttgtgtgtgtgtgtgtgtgtgtgtgtatgtgtgtgtgttgggacagggtttccctctgttgcccaggctggtcacaaactcctggccttaagtgaccctcctgccttgacctctcaaagtgctgggattacagatgtgagccactgagcccagccctaggaaacagcctcttaagccaagtgcaatgactcttgaactccccagagcctctgtgcatgctacctcgacttcagcttcacagatgtatgcaactgcgggatcaggttaggggcactcacttaccggcagtcccaaagctctggagagtctgtgctgagggaatggtccatgttaaagcaaagcagaacaaccactctgccttttgtattttatacttgttttttttttgaaacagggtctctctgtgtcactcaggctggaatgcagtggtgtgatcatagctaactgcagcctccagttcctgggctcaagtgatcctcctggcagatgggactacaggcgcacaccaccaagcccagataattttttgtatttttttgtagagacagggggtctcactatgttgcccagactggtctccaactcctggcctcaagcaatcctcccgcctccacctcccaaagtgctgggttgcacccggcttgcatttcacacgtttaataaactcaatcagcatgtttcctaccccctagagtgacaatggtgcacattagcatggatttcttatagatcgagaccaaagacctaattacttatctatagaccaatcttggagaggaaaggcagactccaagggttaattcggggtccaggaaccacagaaggaaggtctccttggatctcgtttgagcctgaagtagctcagtctatgacagacaccatcagagggcagaggcacaggtgaacgcagcagtcggaactttgtcagagcagcaaaggacatcttaggaaatgaggcttgcaaagcagccttgggttattgagaaagctctctcagcgtggattctcagggctctgggatcttctctgccttgcaggtgcctctttgttttttgggaggaagcaggtgggtctcatgtgtcagggcagtaaggagcaggaatgaatggatgaaacaaatctgttggggtgggtagcggctgtgctctggggagccaagagagagacagggggatggtgctggtttcagacaagatagttgagcaggaacttgaaagagaaaaggagagtggatcgtggggacctgagaagctggaattctccctggggaatcggccactgccaacgtgagggctggggttaggagcatgcctatggtgatggagaagcctgggggaggtgcctggttgatggggcaagaggagccatctggagagaaggaaaagcctggagtctccttccgggcttgcttaaggactagggaggggcaggacatgagatgatgttggaggattctgagcaggggatgggcctaggtgggaggtggggcagaaggagagctggacgaggacatggtgagaggtgatgttggctcatccaggaaggacggccaggaggaagcagagggaaaggggcatgcaaaggtccagaggcaggagcaacggggaacatccagggaaggagggaagggcaggggatttggagatggggcaccctgagagagggatccaggcagcaggcagacacgacagcctgagcttcaccccagctcacggttggccctgggagggctttgagcagaagaggggcaaacatcagcaatatgaggccacactgcagacgttctgggccctgcacacgcctccttgcaggcaaggcggccagcccacaaggtaatttaattcctggtgcctgtgggcgtcctgcaaagagccagttggcgtcggaacgctcttctccaaaacctgtgccagtgcccccagcgcagacctggtgtgaaggggacctttggagaggtctcatgagcaatgccgcgtgctctgccccacaggttacttcaatgatgtggaccgtgatgacggacgctacccgcccaggcccaggccacggccgcctgcaggtaggtgccgagcctccccagatgcgacacattgaatttgcacagagagggtgggatgagaggcctgaagttggggatgagagagctgaggttggggcagagttggtgacgagcagacgataagctggtgcaggggatgacagagaaggccccatggccgcatcagtggggtttgcggtctgggcatctgtccgcctctccaggctgggggactggatggaaacaaaatgaacaggcagaactggagggtccactgaaacacttgcggtcatttctgtttagacttgtatatgtgtaagtgtgggtgtacatgtccagacacacctttatatatctgcatgcttatcaatcttcatttgtgtgtatatagatgtttatgtatctttatatttgtgtgtatatatgcttttaaatatatataaatgcatctacatatgtaggtatatggtttttttcatgtgtgtatatacatgcttttgtatatatacagtacgtggatacctttctctgtttttatatatgtatatcctgactttatatatatccttatatatatctttacataggtacatgttttatatgtgtatatatatctttatatttatatgcagatatatgctttttatatatatttatgtatatgtatatcgtttaatatatctttttaaaaatatatcttcatgtatatctttaaatacatatacattttatatacattttaatattttatgtgtatgttatataaatatatatctttacatatataattaaatatatgcctttatttatatacatctttatatatgtacatatatacctttacatgtatgtgcctttatttatatatgtatatatttatatatacacttttatatatacatatgtgtatatctttatatgtgtgtataaatgcctttatatacgtacacatatacctttatgtgtatatacttttatatgtgttatgtatgtacacacaactttatatatacatgtgtatatatctttatataggtatataaatgtctttaaatatgtatatacatatcttttgtatttatttatttttttttgagacggagtctcgctctgtcgcccaggctggagagcagtggcacaattttggctcactgcaacctctgcctcccgggttcaagtgatgttctgcctcagcctcctgagtagctgggattacaggcgcctgccagcacgcctggctaacttttgtatttttagtagagacggggtttcaccattttggccaggctggtcctgaactcctgacctcgtgatccacctgcctcagcctctcaaagcgttgggattacaggcgtgagccactgtacctggtctatatgtatatcttctaatgtatctttatatatatctttaatatatctttatatacatgtacattttatatacatttttatattttatgtatgttatataaatatatacatttatacatatataattatatacctttatttatatatctttatatgtacatatatacctatatatgcttttatatatgtatgtgtacatttatatatacacttttatatatgcatatgtatatgtctttatgtgtataaatatcttcataaatatatttatatatctatacataacctttatatatgtataaatatcttatataaatatatattttatgtgtatatatgcattatttgtataaacacatatttgtaaatgtctttccatatatatgcatatatagcttacatatgtttctatactgttatatataggtgtatacctttacatatgtatgcatactgttttatatatgtgtatataggtcccttcatgtatatatgtatatacatttaggtatatgtgtgtgtgtgtgtgtgtgtatatatatatacacctttatatatgtacatttatctttatacacacagacatatataaacacttctaatataaagttttctctgtaattggaggtgaatgtctatcaataatctttcatatagaaatacaagtacagactataggagacagagatgcatacaacattgggctgaagagtgtgatgtttgaggctttattttcaagcatgtgaggtttctggcctgtttagttctgcaattttattttagaagacataaaggacttgtcccagatattttgcaaagctggacctgcatctttcggacaaccagattgcatccagtcatcttttctgccgtgtttacttgcaataaataaagagcgctgtcttaggatttattacaataacaatcaggaataaactaaaaattactagttatttttgaaaggagaagctgagaacatttacgattgagaccatctgctggaaggtcctcctaatccggcgtcggcgtggctgatctcatatcagtttctcggcaggaagcgggtgcgcctgcgtgaatttggagtccccagggtaaatgttagtcccgtgacggcaaagtgtttttgatagctagagctcagtgttggcatgagttttcccacggggaagaggaagctttggtggggccacccttgactctcccctgctggtcactctttggagctctcttggcagtgacacgttcacacgacttgttgccattcccaatgagctggacagaccaacacctgcaggaaaccccacgctcagacacctgaacatccctcaactctaccttctctgtctaacaggaggtggcggcggtggctactccagttatggcaactccgacaacacgcacggtacccctacatctgggcatgcgatggtgggtggagggtgggaggggtcatctttctagggctcccgcttgcactctgccctgggccttctacctggagtctttggtgagtagggtgctgtgtgctggtgcctggtcttctgagaacctgtctgtgctgggctgttctgcttctgttccccaggagggtgggtgcagccacacatacacacacgcatacacacatgcacacacacacacacacacacacccctttaggtaaaagtaaacagagcaaagaactatacaactaattagagaaagagagcatccaacaaactggagagcatccaacaaattctttaggggcgcagctcgcttacttcaagcagaatagaaaacactttcaatggctgggcgcggtggctcatgcctgtaatcccagcactttgggaggctgaggtgggaggattgcttgagcccaggagtttgagaccagcctggacaacatggaaaaaccctgtctctacaaaaaatacatatatgcaaaaattagccaggcgtggtggcatgtgcctgtagttccagctactcaggaggcagaggtaggaggatcacttgagcccaggaggtcgaggcttcagtgagcagacagagataagatcgtgccactgcactccagcttgggtgacagactgagatcctgtctcaaagaaaaagaaaagaaaagaaaagaaaaaaagcaagagaactcttttggtcggtgcttatgcccagagtgaaagccgtgttctacagaagccataaacaggctcttggcttggttgagtttttctcatggagaccaggggaccttgaaaccctcagatcctctccggtttggaaaacgactgaagcaaaatgtcatcactgagaaagaaaacaataacaaaacactctgtaggttgattttaaaccatcatctccgttttaacattttccctttgttaagagttttgtacaccttcaatgaattgagtaaccatcttttcttttttttttttttttttttgagacagagtttcacttgttgcccaggctggagtgcagtggtgtgatctctgctcactgcaaccttggcctcccgggttcaagtgattctcctgcctcagcctcccaagtagctgggattacaagcatgtgccactacacagggctaatttttgtttttttagtagagacagggtttcaccatgttggtcagattggtcttgaactcttgacctcaggtgatccatctgcctcagcctcccaaagtgctgggattacaggcatgagccactacacctggctaatttttgtatttttagtacagatggggtttcaccttgttggtcaggctggtcttgaactcctgacctcaggtgatccgccctcttcagcctcccatagtgctgggattacagacgtgagccaccatgcccggccttgagtaaccatctttttggttaaaactaatatgtgccaagagctctggtaatgtgggaagtacttttttttctttttctttctttttttttttttaagatatggtctcattaggctttgtgagagccaaggctgttggccccctaagttttctctgaatcactgacatgaggcagcttaattaacaggagaaaaagcgtataaatttattgagtggatatacacgcaaaccttcagaaccaagactcaaccaccaatgggatgcaaaagcttatagaccatcttttttaactttgatgttaggttcaggggtccttgtgtagggttgttacataggtaaattgtttgtcaccggggtttggtgtacacattatgtcatcacccaggcaataagcatagtacctgataggtagtttttccatcctcactctactcccaccctctgccctcaagtaggccctggtgtctggtgttcccttctttgtgtccatgttgtcaatcgagaaaaatgacgagacgagcgtaaaagatttatttgccaaagttaaggttaagggcgcgccccaggagacaggtctgtggccttctccgaagatgattttgaaggctgcaaatttaaaggggaaagggtgggggtagggaaaaagagttattcatgcttttgtctggctcagtgaatctgtgtttttttacataagatggcatagacaaatggggcagagggaaaatgcagggaatctgcatgttgcataagataatctggacaaaatggggcaggggagcaatcacatatgatttgtgtctgctgggcgggggtgactgcaaagctgtcgatttgcatattgtcatggtgaaatcttcacagctcactaggattttccttgtgggcaaaatatgggggagacgtgtagcttttcatcttgtagccattttatttaggaaccaaaagggggaggcaggtttgtgtgacccagttcccagcttgacttttccctttgactaaatgagttcaggatcacaaaatttaatttcctttcacaatgcgtactccgtgtttagctcccacttgtaaatgagaacacatggtatttggttttctgttcctgcattagtttgctcaggagaatggccaccagctcgatccatgttgctgcaaaggacatgatcttgttcttttttatggctgtgtatatgggccacattgtatatgggccacatttcccttatccagtctaccattgatgggaacctaggctgattccatgtctttactatttgagtttgctatttgttgttctttgcaggaagaatgtgggctcagagcatggccccaaataggtgacgttggtaaagcaggtttaacgggtggcaagccaggtgatgagagggagacaggaagaggcctgcttagcaagggggtccttgttatgcagatgaaggttcccaggtagcagcgctcagagacgaccatggtaaatgtttcttttcagacctgtaaaggtgtcagagtctccgtttctctctcctacatccaggaaaagcttagaaagggaaggcctggctgcaacagcaaagatcctctacagatgccaatttccccacctcagtctgctggccctggagcggcaatttcaaaataaggcaaagcaatatattttggagtaaaatattttgatgtccgtcatcttcgttacctcggaagcgagtgttgtcatcagatccatttaacaaaatgaaagcaatgcatgacgctcgactgtccacttcaaaggagcaatagctgtggccctataggtagcccatcctcagaactcactccctatgacacagacaagcttcaggatgggagggggctcatgacaaagtgctcattacctggggtcaagaactgtctacttttggccgggcatggtggcccacgcctgtaatcccagcactttaggaggccaaggtgggtggatcccttgagttcaggagttcaagaccagcctgggcaaaatagtgaaaccctgtctctacaagaaaatacaaaaattagctgggcatggaagtgtgcgcctgtggtcccagctactcgggaggtgtaagtgaccctggaagtttgaggctgcagtgaaccgtgatagcaccactaccttccagcctgggccatggagtgagaccctgtctcaaaaaaaaaaaaaaaaaaaaaaaggacactaaaaaagaattgaccaccttcaactcaacgtactatgagatgagttccttccaccatctttctggaactagctaaggggttccccttacctactacctaggtagacctgatttattaagacgggaatcgcaatagagaaagagtttaattcacacagagctgactgaacgggagcatgtgaagcagctatgctgtctggggtacatacctggggttcattgttgcacgctgagaaagaattcaggacacagacacatgtggttgggttaaggagttgaaagtttaatagaagaaaggagagaggagagcagctccttgcaagagagagagggagagagagaaagagagagagagaaagagaagcatctgaaaaagttgggaggttgtggaccgcagcagcttttgtaggcaggctggaggaggtggtgtctgatttacatagggcttacagactggttcgatcaggtatgacttctacatagtgcgtggggaaggctggtggccccaccctaattttgttatgtaaatgggctttccagttggtcagtgccatcttgtctgctacttactgtacatggggctgacaaagaggagggaagatgaagctgccatcttgaacgtgtctaggccctagttcctgccggcattcacccatgtaagctcctagctggcttgtctatgtctgcagctcaactttattttttattttttatttttttttgagacggagtctcgctctgtcgcccaggctggagtgcagtggcgtcatctcggctcactgcaagctccgcctcccgggttcacgccattctcctgcctcagcctcccgagtagctgggactacaggcgcccgccaccacgcctggcaattttttctatttttagtagagacggggtttcaccgtgttagccaggatgatctcgatctcctgacctcgtgatccgcccgcctcggcctcccaaagtgctgggattacaggcgtgagccaccgcgcccggccacagctcaactttacaggctgctctttgttagaaaatgatttggggctgcttttcattaaaaagaaaagccttaccaaggactcccatacccttgctatgtgcctaagtaattaactaattccttcttaactcctatatcaactggaggttttgcttttttttctttaaacagggtttcattttgttacccaggctggactgcagtggtgaaatcatagctcactgcagcctcaacctcttgggctcaagcgatcctcccgcctcagcctcctgtgtagctaggaccacaggtgtatgccaccacacctgcctaatttttaaaaaatttttgtagagatggggtctcactatattgctcaggctggtcttcaactcctggcctcaagtgtttctccgacctcagcctcccaaagagctgggattacgggcatgagccactgcacctagccaagactggagttttatgactcaaatcagcttcccccaaaatttggacactgggctttttaacgtgtaatttggctggtaggagacccgggcgtggggagtgctgagtggttggttggaggtggaatgacagaggacggacatgggttctttttgttgtcttctgttcttgtgtgggacggcagagctcgctgagccgcattaccagtctgggtggcgccggctggtgcatctcaatgaagggtttaaaaaatgtctcaacttcaaccttaggttttacaatagtgatgccatccctaggagcaactgaagaggtttggaatcttgtggcctccggctgcatggctcctaacctattaatataatttctaatcttgtgactaatttgttagtctttcaaaggcagtctgatccccggggaagaagggagtttgtttcagaaaagggctgttatctttgtttgaatgttaagctggaacttcctcctatggttatctgagtctgtgttcaggaatgaactagggctgttcgagggctacaggcacgatgcagtcggttaggtcagatctctttcactgtcgtaattttctcactgttataatttttgcaaaggcggtttcaatttaactgaaaatgtcaggcaaagaccaaatttaatatttttacagaaagccactgggagtagttttttattgttttattatttatttatttagagacagagtctcactctgttgcccaggctggagtgcagtggtgcaatcatagctcactgcagcctcaaactcctgggctcaagcgatcctcccacctcagcctcccgaggagctggggctacaggcacacaccatcatacccagctaaatttttaagaaattttttgtagagatggggtctcaccgttgtaactgcccaatgggtttaccttgccccctgcctaaacagggccgatttatcaagacagaggaattgtaatggagaaagagtaattcatgcagagccagctgtgcccgagaccagagttttattattactcaaatcagtctccccaggcattcagggtccagagtttttaaagataatttggcgggtaggggcttgggaagtggggagggctgattggtcaggttgcagagggaaccataggggggtgaagtgaggttttcttgctgttttctgttcctgggtggatggcggaactggttgagccagattaccgggctggctggtgtcagctgatccatccagtgcagaggctgcaaaatgtctcaaacaccgcgcttacgttttacaatagtgatgttacccccaggagcaatttgcagaggttcagactcttgagccagaggctgcacgacccctaaaccataatttttcttttcttttcttctttttttgtttttttcgagacagagtatcactctgttgcccaggcttgagtgcagtggtgtgatctcggctcactgcatcctctgcctccctggttcaagcaattctcctgcctcagcctccccagtaactgggactacgggcacatgtcaccatgcccggctaattttcatatttttaccagagacggggtttcaccatattgttccggccggtctcgaactcctgacctgaggcgatccaccctcatcggcctcccaaagtgctgggattataggcttgagccactgcgcccagccctaaactataatttttaatcttgtagctaatttgttagtcctacaaagtccaactggtccccaggcaagaaggaggtgttttcaggaaaaggctgtgatcagttttgtttcagagtgaaaccatgaactgaattccttcccaaagttagttgggcctatgcccaggaatgaacaaggacagcttaagggttagaagcaagatagagtcggttaggtctggcctctttcactgtcatcatttcctcagttacaatttttgcaaaggtggtttcgccacgttgcccaggctggtcttgaactgggctcaagcgatcctcctaccttggcctccataagtgctgggattacaggcctgcaccaccacatccggcccaccttggagcgtgttatataaagcgagccgtccccacacccctacagcctacgaatgagccttttcaccccatgcacgattctctgaaactgctctctgtaaggagctattcgggacacgttcttttgttctctggcatactcatcaggtagaaagaagtgattcagcaagcggctcccctgagagccctgatcgtttcctgttttcctgtgaagttagtctcgggaggtctgcgctgtgccatttttgggggaccattatctggctcccgaatggatcaaagcttactggtcagggggctgctgtatccctggggcaaaactgccagaaaatagcaggtagccctgtggtccttggcagggccagggcccggtggaagcagcagctgggccaagaacatcaggcgtgcatgaggcacagcccagttttgggagcatgacgcttgttttcgaggatgcctgtgctccccttcctgcctggacccctgctctccagccccggcagagcgaggctgtgagtcagcgctcggattagcatcagcatggaggtgccggctgggatgcaagccgccgccatgggatgagtcacgcggcttctccccgaatccccaaaggaggcagagcgtgttaggcttgttctggcttcatgcagagcactgaggggtgagggctgaccgtggctggccgcggagggaagcccaaagtctggcctccctgcggagactggggagaaaatgttgcgctcgtcgtttttaaatactgggggacaagtttcccttgtctgctaaggctgccattgtaaattacaagagtcaggagggctgaagcaaaagggatttcttctcccacagtcctggaggctggaagtctgagatcaaggtgtgagcagggctggttcctcctgaagcctctctccttggctcgtcgacatcatcatctccctgtgtcctcacagggtcgtccctctgtgtgtgtctgtgttccaatctcctctccttatgaggtgtcttagtccatttcaggctgctatcacagaatactatagactgggtggcttagaaacagcagacattgattctctcaccgtcctagaggctggaggtccaagatcaaggtgtgagcagggctggttcctcctgaggcctccctccttggcttgtagacaccatcttctccctgtgtcctcacagggtcgtccctctgtgtgtgtctgtgtcctcatctcctcttcttataaggtctgtagtcctattggattagggcccaccctagtgatctcgttttattttaatcacctctctaaggacgttgtgttcaaatacagtcacagtctgatgccctgggggttaggactgcgacctgtgaatttggagggggatatagttcagcccatagaacccactatccacataagtcattccacttcaaaatcagcacaaagcattagttttaaaaatctcaaatctgtatttttaaaaattgctcttaacacattagaaaaatatagaaaaactttttttgctgtttttctgagacaaaatctcactctgtagcccagcctggagtgcagggacgtgatcatagatcattgcagcctccacctcctgggctcaagcaatcttttgcctcagtcgtctcccaagtagtagctgagactacaggtgcacatcaccacacccagctattttttttttttaagtagaaacggggtctcactatgtttctcaggctgggctccaaatgagctcaagtggtcttaccgccttagcctcccaaagtggtaggattacaggtgggagccaccacacccaacctggaggaactctttttttttaaaattttaaataaattactatttgtggcctgcgttttcatcctattctctttttttttaaccaacatttgctggcatttttttttatgccgaagaaaacacctttgcccatctatgtcaggcctccagaccctcagggatgtacatctaatgcaccttcagccaccggtgtaaacagtaaacaggggccagatggcgcctgtgcaccttccctggccttgggagagcattggaatctctgcagcttttaagagcatcttgcttcaggtttgctgacctgcttgcttctgtaagatcatgcagacttcctgagcaatatctagcatttcatggtctcttttctatcctgcaggaagagggggctatagactcaactctcgttatggaaatacttatggtaaaggaattatgtcttacagaatatgtgaggcaaaactgtccatttgcaaataactaacacactgtctgcactgatgggaagctgatgctttcatccagtgcacaaccaactggccgttcgagtctctcatttgcattttccttggtcatccatgctggggggagatgttgtgcatgccctgaggacttcatttcttcaaaggaactatggcccacttacaggtgttactgggtgcatgtgtgtgcacgtgtgtgtgtatacatatgtgttcacacacaggtatgcttgtgtgtattgtgtgtgcatgcatgtgtacatgtgcatgtggattttgtaatcatgtgcataagtgcatgtggatttcatgtgcatgtgtgcaagtgtctgtgcacacatgtggattgagcacatgcatgtttgtgtatgtgcacagatgtgttggcatgtacttgtggattttgcatgtgtgcatgcttgtgcttgggttgcatgtgcattgcatgtttcccatgtgtgtccattcacatgcatacatttaggggtgtgcaagcacatgtgtgcatgtggatagatgcaggagtgtgcatctgggtgtgctcgtgtggtatgtgcatactgcacgaatatatcatgtgcatctgtgcatgtggattgtgtgtatacatgcgtgtgtacaggcatgcacacacacacatgaatgtgtttgtgtgtgcatatttgtgtgtacatgcatgtgtttatgcatacaggtgtaaacatgtgcacacatcggtgtgtgcatgtgcacacatgtgtacatgtgtatgtttaggcgaattgtgctttatatgtgcttttgttgcctgtgtgtgtggtatgtgcatgtgtgtgtatgtggggatgtgtgggatgtgcatgtgtgtggatgtgcacattgcattgtgcttctgtgttgcatttgtatttacatgttgcacatgtgtgtaaatgcatgtgtgtgtgcacgtgtgtatgcgtgcttgtctgcctgtgtgttgcacgtttgttgcatgctgcatgtgtgtatgcatgtgcacacacatttgtgcatgtcagtgtgtgttgcatgtgcttgtgtatgaatggcgtgcgtgtgtgcatgtgtgtccatggggttgtcagcctgtgtgtgttttgcatgcgcatgtatgtagactctccaatcctgaaattaaagctgcatctccctctccctggtattatccccattctgctaatgaccattagacatggcatacacattcacattcctcctccttatgctgcttggctgtccccctccccccacaagaatgtaaattccctgaaaacagggatctgtgtgctgtgttcacagtcgcatcctcaacagtgcccggcaatataaggccctccataagctctgctgaataaacacgaacatccttttccgcttacaggtggagatcaccattcaacgtatggcaatccagaaggtaactgattgactcacccggtcccaacctttaataagagcacactctcctagatcagtgctgggaggagctgtgtgggcttctgtttcccaacctcatgactttcacggagcactcatactttgtatgtatataaagtagctcctgaataaaaatatctgaccttcagcacaggaccaatcagagttcagagaaaggagaggcaagcattggttttcactgcagaagatgccccttagctctcaaagcaaggctgtgaatgagtgctgagactattacatttctcccagtaccaccattactcccctttctttgaccagcactaacttgaaacccaagaaggacaggagaaaggaaggtatgaacactctgcccaaagaagccatcagagtgcactgtcaatcccgtctcaggtcaaaggagggagaacttgaagcccagaaggctgactttgtgtcctgtattgttgggagaacaggttccccattccctaagggtcatattcttagagatttgggctgacacctgcttgagtttaagttgagagtaaacgcactcaaccccaaggctcttgtgagttttcaattatgggggaggagaaagtgattgaaggtgacctctacctttcaatgatcatgcagagtactagtatcaatatttttggggtatgttggcatccttagaaaaatttatggtttcacctttttccctctgtggtgtaaagtgaggtccagagatggaaagggcaaggcaaataaacaagtaattgcagtcaaatctgatgaataatttcctggaacatatgggatcctgtagcaaggcagaagggatactcctagactaggttaggtgagggaggtagggtttcctggagagaacaatatccaagccaatcccccaaaatatgggtgggaggtgcccaggagaagagtgaggtgtcagggaagatggtgcactaggtagagctggatacacacgtggggacaccggaaattgtgtagccaggatgtggaatgcaacgggaaccagggaaggatgcaatggtgaccaggaaagacctccaggttagcagaggtggagtctgcacttcatagaaccttcatgggaaggagcctgcccctgttgatatgtaggtgaagaatggacctgagggggctcactaagacccagggagacaccctttcagaccagttcagtactccctggaaatgatgacaggctgaattaaagcctgggcaaaggaggcaaagagaagcagtcagcttggatgaccacttggtaatgacaattgattgtacttgattgatttgtaagagatgagagagaggaaaaggtatgtatcagtcagctatgctgtgtcacaaaaaaccccaaaacttagtagctggaaataacaaccatttattatgttcgtgattatgtgagtcagcaatttgggctgacaccattctagtggtcctcctggtctcttctgaactccctctcttgtgtgcagtcaactgtaggtgtggccagcgctttgaccatgtttcctgggtcttcttatgtatctgggactttaggtggaatggctcatctcagcttcatgtgggctctcacatccctccaggaagccaggccaggcttcatcacatggtgaccagacagggtaccaagagcatgaagagaagcgtgcctgggcttagagccaccatgccttcacttgtgtgacattctgttggctaaagcctggattttcagaatgaagatgcagctccacctctggatggggaacactgtgaaatcatactgtggagcgtgttcatgtagggaggggaagaatagagggctgtctctcccaggaggcagggtgtggcgggcggcagcatcagccgtagagcaggttcttgcgttcagtgacaacactcttccccccagcatggcagcctcattcgtggagcagtcttgtgtccctcacctatgccatgccatgtattggcccaggtgttcaaccctgtctgaagaaagccatgcatggaaagggtggctatttcaaatggaaacggtgatttcttccttttttccctttggaagtgttgatttttgtcacatcaagctccttcttgttctttgtgcaggagtgccaaagctctggagcaatttgccatcgaggcattgaggatgcttgtgtctagtgtgtgcttgggtctagagttccagcatgcctttgaaagcaagcctatctggcagtttttagtggaacaatatttttgcatgagtgggcattctacatctaaaaaggcacaaaatagttttgacatgtgcctgtcatcccaactactcaggaggcggaggcaggaggatcacttgagcccaggagttcaggacgagcttaggcggcatagtgagaccccatctctaaaaaaataaatcaggccaggcgcggtggctcccctctgtaatcccaacactttgggaggctgaggcgagtggatcacctgaggtcaagagttcgagaccagcctggccaacatggtgaaaccccatctctactaaaaatgcaaaaattagttgggcatggtggcatacacctgtagtcccagctattcgggaggctgaggcaggagaatcgcttgaacccgggagaaggaggttgcagtgaactgagatcacgccactgtattccagactgggcgacagagcaacattccgtctcaaaaaataataagaaataaataaataaataaataaataaaattaattaaaaggcatacatgaattgacttcaacaaacaaacaaaaatgccaagtgcctcgtctgtgcaaatcctggccttggatgtcttcagtggtaaaatgtggttgacaagcttggctctttgtgaaaacagaattacttcctaaggtttttttttctttttttttaaattaagtttctcttttttttctgtgaatacaagggtgggaagggacgtgatggagaagttactagatagatgcaaaagttattgcagtttttgtcattactttcaatggcaaaaaccgcaataacttttggaccaacctaatatttaagcagttttcctgcagccatgtttttttctcggatgagcttgctttttctccactcctgcaggcaatatggtagcaaaaatcgtgtctcccatcgtatccgtggtggtggtgacactgctgggagcagcagccagttatttcaaactaaacaataggagaaattgtttcaggacccatggtaagtttggctctaaacattgttttgcttgttactaagcctgatttaaaaaaaaaaattactttcagatgtctgtcactagcaaggttatttctggttaagttcaatatacataacttgcctaataatgtgattttttaaaatttatttttattctttttgagacagagttacactgtgttgcccaggctggactgcagtggcaggacctcggctcactgcaacctctacctcctgggttcaagagattctcttgcctcagcctcccgaacagctgggactacaggcatgcaccaccacgcctggctaatttttgtatttttagtagagatggggtttcaccatgttggccaggctggtcttgaactcctgacctcaagtgagctgcccgccttggcctcccaaagttctgagattacaggcgtgagccaccgtgcctggccaacaattgggttttcatggtcaggtgtgagctgtaccttcctctaaaccttgttacaatgaggctggcacattatctgtctaatgtaaaagaggaggagaaaaaaaggaaagaaaaagaaacaaacaaacaaaaattaccaacctacattgcaagactataagcatgacggttggtttaactacctgttctgttttgtattcagtgaaattttcgtcacaggcgagtcaggaaaaatacctgggttgaatgtgaatgttttgcccagaaccccacccgcaaagaaaactaccgaaacactgaattataagcctctctgaaattccgaaggtgcgctcagaccataggggagaggaaagatctgctgtggcttcctggttcaatgccggctccacactcctgggtttgaagaatcacttgggatttgagagcagaggatgccctaaagaaatctctgaaacaacagtcagggattgttttatagcctaaagagtgactcagatctttaactgggtgtctctggaggcttggtttaaacctcaggccacccacgtcagaatctgtctggagtttgcccagggccctctaactcataccttctttgtgtccccgaaggaaaccagaaaggggtgcccattcctacggtgtttgctttaggatttgcatttggcctcaaaaatcctaaaaccttcccatgcgctccctctgctggtgaatgggcagtatcaaccgttagctaatgaacctccgtttggggtgagcctccgtctacattacgccccgtcctgaaattttaggaggaaactgagtttctgaaaaactgccttattttcctggcaacctgagagcagattcttgggttcagtgacaacactctttcacccaacatggcagccatcattaacgaacaccacgtgttaacttcagtagcttttgtggcagtgatttgtaagcctttgttaaccaagggctgaaactgagtaagcagagagaggcacccatctccacaagcacaaaatgtaagggcggggtacaggggtcccccacaaactcaataatcaaggcaaatatattttagtgcaatattttagaaggaaaatcattggaatgggggccagttgagtttctgaaataggtgtagttttaaaaacgtggatgatgcctgccccatttatctgaggtggaaggaagcacgtttttgctaaagaggtataatgtcttgaagctctttcatgccttttggctgcctggtaagtatttttgtctactttctccattgtacttcgatgataccctcaccaggtattcccaagcaccaagtttatcttcccctcccttaaagttcctgagatcagaaaggaggatgtagacagagtgagctgatgttagggagatctcttcaagggtgagcagtgacatttatgtggatcctgggcctatatcacctcgctggctgtaaagcctttatactatctaggaaatatgtgcatgacagcaaatacgtatgggtttggtatcaaatggggctcagagctctgcgaacttgactctaaagttccaggctgctgctaatggtacccagctgtccacctctccttagttaggtcattaattttctctgtctcctaaaggatgacgtacatggtatactaaccatatccatggtgatgtggtgcagtgcacaacctgtggaactgtgtacctgctgaggccatacactgaagcttgcacactttgtagagaaagagttgtagtaacagagctacacagatagaagcagatgtctgtcacttgatgtggacttttaagaatcatactttgcttttattttataaagtggagcaaatgacaacatcacttcagaagttataaagaccaacaaggccatattcgaaaaaagaagttcctacaaatattagttttaaccaaaaaggaagttactcaattcatttaagatcatcaaaatccttaacaaatggcaaaatgtcaaaaacaatgttttcaaaacgaatatttgtttccagatatgattttaacagtttttaaatattttctatttttaatttttcctgctttattgaggtatagttgacaaataaacattgtatatatttaagatgtacaacttcatttctgcatcatttatttgttctaatctatctccttctgccgaatgtaaagcaggtgtcatgtagacagcacatagtctgatcttggttttcttttttttaaaatagatttttcattcttctagctttattaaagtatgatagacaaacattgtatatatttaagatgtgcaacttcatttctgcttcatttttttctgttctaatcttccttctcctaaatctagagcaagagtctcttgtaacagcatagaattggatcttggttttctttttctctgtttaataagacttttttttttgcccccacaatgacatttgtttctaatcttcctttcagaaccagaaaatgtctgaagatgttaagatcccctgattactttgagaaaaacaactaaaacaagaaccgtgtttatcactgttgtggagatttccttttattcttgacacaatttgatgacctaaagtgtgttttcttctgtgtaaagtacatgagctgcctcactaagcattcccaactcattgaatgtgatgtggttataaagataagttaggcagctagaccctgcgttctaaaaaaggattgcttgcaatgttggtttggctattcatttgcacaaagagactgtggctctctgttgtgagatcttcagctacctcatggtgcaataacacacacacgcttaaccatgttgatggcacaaagcggtgagcagtagggaggtagaatatcttggtggggaggggatgttatcagcttctgggagatgaagaatattgttgaggttccaaagatgctggacctgtgctaaattcttcagtgatatgaaaaaatcattgagcattcattattgcgaatgaagtggggatgcattatttctgacacccacaagcagggtttgatcatcctttcagctttgagatatctgcacataaaattattattacctgaagaaaataaggctgcattttgaaatgttaagtgcaaaatgactgatgttaaaaccatctgggggaaatcttgggatgctttttcctaggaaatcatatggttgtgatatgttttggcgcataggagacagaaatagtgattatcaggcgttgagcctttttgtagtatttttagtctttgatactctgtaagtgctagttcctaaggcaccaacattgcattccttggtttatactttttctattcatcagggtaggaagtcttaaatccttaggcatccaagaagtatactagctttttgcttctcttttagaaatacttgtggggagagaaaaaaggatggtttgggcatattggtatagtttgagtaaactaaggttaatgttcatataacatttagactttgccataaatatcagaaccaaagatcaagacattcatgtacagtctggaatgtatatatggggcccataaaaattcccagtatgcatgttttatgctcaccattatgaattggggtcttcaaagagagaaggttgaaagtggaaagcacttgaaagggctccccggtttgtaaaatatctttaatcattcacattaggtacctcggagttgcgggtctcaaatgtggattcatgcatcatttgtgcagtttgaagatagtccatatttcctatttcagtattaggtcctgcaacacttttcaattcttgtagaaggtttttttcaggagtggtgatgtctgatgctcaattactattttccctataagagtttcagcatgagcttaattaaattcttgtgaaaaaacctgtgtttttagttacacacacacacacacacacacctacttaaatggaatctaaacatttttagcctttaatccattccattttctaaaactgtcataaactatttttaatcattttaaataaatgtaaaagaaaaataactggatttgattattgaatagtttttttctatatttcacaaataaattgtatgaaatgactgtagaagtggccccaaaattatgaaccttcgtagctgtgaatatgatgccataaatctcttttaaagctcaagatagactatgaacatatgaaatacatagttacctaatcatgagactaaattcacctgggtgacaaggctaacgttcaagctacttaagatgaaaatatttgaatcatgattgcttgggggaacctctctttgaggggtcatgaggaccacctgctgggcattctgttttcatgctgagaaggtgagaattgaacagatgagaaaagccttgataaaacgtcatctccatgtaatttagagaaggataaccttgactgtacagctgacccttgaacaacacagggctgaactgcacatgtccacctgtatgtgagtttgcttctggctctgccattactgagacagcaggaccaaccctccatctactcaatgggaagatgataaggatgaagacctttatggtgatccgcttccacttaataaatagtaaattcattaattttatcttccttatgattttcttcataacattttctttcctctagcttactttattgtaataatatggtatgtaatacatatacaaaatacgtgttcaactgttaccagtaaggctttcagtcaaccagtatgctatgagtagttaagtttttggagagtcaattcatacagcccttgatttttttttttttttcaattaagttcatttagatggtcagaaatgtcagttaagcgtcatttgaaggtaataactaaccttgaaaaactagtggcttgggtatagttttccaaaaagttaggctgggcgtagtggctcacacctgtaatcccagcactttgggaggcctaggtgaggggattgcttgagcctaggagttcaagaccaggctgggcaacatagtgagacccccatctctagtaacgatttaaaaattagctgggcgtcgtagtgcacacctgtagtcccagctacgtgggaggatcacttgaacacagaaattcaagaccatagtgagctgcgatagcaccactgcactccagcttgggcaacagagtgagactctcaaagaaagaaggaaggaaggaagggagggagggagagagggaggaaggaaggaagaaaggaaggaaggaaggagagacagagaaggagggagggaggaagggaaggaaggaaggaaggaaggaaggaaggaaggaaataaatttgattcttttcgcccataaatttgtgatgaagcaccagttttggaaagcttccctgctttggtagaaatagcagatggcaagattctgatatcttctactatgaagttcaaagcagtcagaagtgggcagcttggtttttctgaaatttatcattctgacatcggactgagacctagaggagattttttaatgccatctgacagatctaaaatacatcttctaagagtactatgcaaaagtggcagctgtcctgtttgcttggcttcattgatccaaaccacagggttgacaattttccttcacatggatacagtgagggattctgcagttatatgaggcatttgagtcaaggtgatacttgcttcttgattccacagatgccactttttgcctttgaggacttgctaaagagttcagacttttcctactgtatgttttctgtgcagaagtcatgttgtgtggtgaggaccatggattttatttcatttcttaacctttctatgcaaatgagaccttgaggctgcagagaacaaaattattgggatgcacaaatccaaatggaaataggctcagtttagctaaggaggacacttgtgttatcttgtgattctaatgacgttcaagctttaatcacaacattttcgtgcaaaaggaaaaatacatatattatatacgtgtgtgtgtatctcctgtaaaataaaaacaatatattgtattaaggaggccttgcagctgttgtccttatagcttcagaaattttatttttttcaatatattattcttaggtctgtagtatgaaagttcttttaaaataaactgtacaacaatttcacaaaatattcaaaataaaaaagagggagtgtttggatattaattgtcactaaatttaataattaaaatactaaaaattttacaaaggggtgaccacactaaaattcatatatccccaaagatctcttaaaaattagatttttcaggctgggtgcagtggctcatgtctgtaatcccagcactttgggaggccaagatggggggatcacttgaggccagaggttggagaccagcctgggcaacagagcaagaccccatctgtacaaaaattttgtaaaaattagctggatgcagtggtgtgtgcctgtagttatagctacttaggaggttgaggcaggaagatcacttgagcccaggagttcaaggctgtagtgagttatgattgtgccactgcattccagcctgaggaacagagtgagagcttgtctctaaaaaagaaaaaaaatagatattttgaacattgcaaaagcctacaatctttttaatattgattactttagttaaattcttctccatttaatgtgattttagaagtaatccttttacatctggaaaatggagaataatttattatttcacccagagaatgataaatcaatcaatcaaaatatagcaatctagaaagctaataaataatgttctaattagggagacctactgccagtaggagtaatagataataacaatactatttgctgaatcattttattttagtagaaaaataagctttcaaagtaatttatttacttatttatttatttttgagatggaggctcactctgtcgcccaggctggagtgcagtggcacgacctcggctcactgcaacctccgcctcccgggttcaggcgattctccctgcctcagcctcctgagcagctgggattacaggcacccaccatcatgcccagctaatttttgtatttttagtagagacggggttttgccatgttggccaggctggtcttgaactcctgacctcaggtgatctgcccgcctcagcctcccaaagtgctgggattacaggcgtgagccactgcgcccagccttttaaaataatttacatactttacacatgtacacataaaaatggatgttggttggatgtggtggctcatacctgtaatcccagcactttgggaggtcgaggtgggtggatcacttgagcacttgagccttggagtttgagaccaagcttggcgacatatcgagactctgtctctacaaaaaaattaaaaaattagctgggcgtggtagtacatgcctatggtcctagctacttcggaggctgagacaggagaattgcttgagcctgggaggttgaagcagcagtgagctctgattgcacaattgcactgaagcccaggtgacagagcaagaccctgtcaaaaaaaaaggatgtcagtgataatgagttgtttataaagatagaattagagttccagggatgactggagaggtatagtgtattataacccctaccatgtgcccgtcagggactggtacttaaaagtcaaaacagtaactgcagaatttgagaggtgtacaaagatagtctctcaaatagtgctcagttattagttcagcgatggtcagtttgtgcatagctatgaaactagcttatcacggtaaaaagtgtgtacgcttcactatcttgtagcatttagtttcccagcagggccatgcgacacccagtggacatttctaaattgtacattcaaaaaaatgttaccactggctgcaacatttttttcattaaacataaaagttggtcttgggggtgtcattcaatgccttttctgcttccttcagaattctaaaggcttccaccacaactttgatctgagcccagttatgaacttcatacaaagctgcagggaggagcctgtgtctgttgaagaaaggctcacaagatcccatggtaaggggagaggagaaggggtaatgaggaagaaaggcagctttccaggggccgagtccggaagaccagacttgtcagagaatggaactagcttgtccagtctcagcccatgagagagtttcacgccacgtgctattctggttctgaacattgagcacttgggtgacttggaatggcctccatctaagctgcatcttcccccatagttccaaatataaatgcaatgcattccctgggttcctgccagccattgtcacgtttttgcttcacagctgtctcctccctgctccccgtcctattcatctgccccttgctagacaggtattcatgaaacatgactgcttgtttatgaatagctgggatgtagacatgacatacggaaagagaagctgccaatttttccccaaccaaaagtgaaaacagtgcttggacctaacaagcatagaatgtttgatcccatagcagagctggtgggaaggctgggggcaaaatctgacactgtccaccattggctgtagaccaaagggaggctgcagaccaaagggaggccgcagggaggtgagatcatttcaatcgcaggtccccacccactacgagcacttcctcacccacatcctctgttctaatcttttctgtctatctcttatcaacttccaacatatgataacgtatcaccttttattgtttctctcccggctccatccccactagaatgcaactgctacaaaggcatggatttgtccccagtttccagaaacatgactggcatgtagtagatgctcattaaagacttatttatttatttattgagacaatgtcttgctctgccgcccaggctggagcgctgcagtgtgatcctggttcactgcagcctcaaactcctgggctccaacgatcttgtcacctcagcttcctgtgtagctggcacaacaggcatgtcctaccatgcctggctaatttatttattgtttttgtagagacggggtctcactgtgcttcccaggctggtctcgaactcctgggctctagtgattttcccaccttggcctcccaaattgctgggattacagacttgagccaccacgcctggccctaaagacttattaaacacacgggaaaatgaatgaatgaagccctcgttcaggccacaactttaataatattaaagaggagatattttcttttggtattctagctaaagacttttgggatgagatggatagggatattaacaaatgtgtgtgtttttaaaaaatatacatattatgaaataaaacatctggaagacctccataactcaatgaaccaatattctacaaatgacccatgtgtgaagtggcagaatcatgaatggataaaaggtttgtctgaagcttaagataaacctgtgggttttaaatgtgtagactttaaaaattcagtgataggatttcagattccacactaccttatctttgagaagctattgatgatcaagttttgtcatcaaaggagaacattcacagttatttgaaaagattactaaaatactttttctaactatgtatctttgtgaggctagattttcttcatctactttaacctgaacaacataaggaatgctgatctgagaaactggttgtctcctcataagtcagatattaacaagatttgtaaacatgtaaaacagtacactcttcccctatgaaaatttttctgtttgaaaaaatatatcccatttttcataaaattatgttatttatgtaaaatgtagtggatttatctttaaaattattaaatagtcaaaaacttcattttaattttagaaaatatagaaatattaattttaatttattacagcgttaaatttaatgcaatataatttaattacagaacatgtagacatttacaatgcacaaaaacaaaagttcctctaggcccttaatcattgttaagagggcaaaagaggcagggcgcgacggctcatgcctgtaatcccagcactttgtgaggccgaggcgggcggatcacctgaagtcaggagttcgagaccagcctggccaacatggtgaaaacccgtctctactaaaaatacaaaaattagccgtgtgtggtggcacgtgcctgtagtcccagctactcgggaggctgagataggaaaattgcttgaacccgggaggtggaggctgcagtgagctgagatcacgccactacactccagcctgggcaagacagagagagactctgtctcaaaacaaaacaaaaaaagaaggcaaaggaatcctgtgaccaacatgtttcacaatttctgcttgatgttataaatgatggcactttcccccggaaatctctgcagttttatcagtctccctccctgtctgaccacctcaatccttttctatctctgctgactcaaaatggttgaagcaataaagacagcatctgtaacaagatgtacttagattcaggacctctgggctgggtcagtttgagggcttaacaatgtcctccagtagccaggttctctgtgtcttgcagtcctgtgtttcataagtcatcggcccatttcactcatggcagaagatggctgctgtacctccagccatcacagcctcatctactaatatctggaggcccaattaggatcatttcctcccagattttctcttttaagagcaaagacattctttcagggatcaagcccaattcctcatccctgatttacacacagcccctaactaaaagtaatcaggtgtaggccaggcatggcagctcacacttgtaattccaacactttgagaggctgagtcaggaggatcacctaaggtcaggagttcaagaccaacctggccaacatggtgaaacctcgtctctactaaaaatacaaaattagccaggcatggtggtgggcgcctgtaatcccagctacttgggaggctgaggcaggagaatcgcttgaacctgggaggtggaggttgcagtgagccaagatcgtgccatttcactccagcctgggcaacagagtgagactccctctcaaaaaaaaaaaaaaaaaaaaaaagcctgagaaagcatgaaggaaccctgggaaaaaatacaggctccaccaacaataaggaaaaatgatggttgactgggtagccagtagcatgtgctgcaaatcatttgcttattttgtgtcaagttgtttgccaatgtagctctttatatattatatattattatgttactctttaccaaaatataaaatattgagatgtaattgtagttgtgacccacacacatacatgtaaatgcatgtattgcaaatgtgttctctcattctgtatttgtcttcaattcttagaacctttgtcacaatcatgtcgtgcaatcaagtagcttggcacaaacatctgttctgtgccttctgagtttgattttttgttgttgttgtttgagacagagtcttgctctgtcacccaggctggagtgccgatcatggctcactgcagccttgaactcgcaggctcaagcaatcctcccaccttagcctcctgagtagctgggactacaggcgtgtgccaacactctcagctaatttttttatttttattttttgtaaagatgaggggaatctcactatattggccaggccggtcttgaattcctgagctgaggcgatcctcccactttagcctcctgagtagctgggacaacaggcgtgtgccaacactctcggctaattttttaaaaattttttgtaaagtcagagggatctcactatattggccaggctgttcttgaactcctgagctcacgtgatcctcctgcctttacctcccaaagtgctgggatggcaggcatgagccaccatgcccagctgcctgccgggtttcaatccttcctttcccagcacacatgtaattttaaaaaggtcttgtaactaactctccaataaagttgtcccaggcatataaatgtcttgacgttttcttcaaatgcctccctaggaaaattggcacacacctattcccggcaacagggaggagagaaaggtttactctgaatgcacccatgacaaagcttacctgctgccaagctctccatggcttcctggagaccaacacacacaggaacagaagcccggcaacccccgggggaagatgcctcctccgggtttaaaaacagagctacccttttgcccggggatcatgagggttgccttgtgacttagtgccttatactctgctttcggagcaccaattctcagtggaacgggagaaacaggcgggtgaggaggggtggggtgatttatggggcagagaatggtgcaacacctacccttgtttgtgttgggagaccgaggcctcctccatgccctaaacatgctgtttaaacatccctgcaatttcgccaacgtctctttctctctggctgcctcaacccttttctatctctgccaaatccatgctccactgtctccggccctcctggctccagctacccctccccaacaccctcaaatctcagaaatgcaagcagtgcctctcaagcctgcgcattaggaactcctggaggcctggttcacatagcggggttggaggaagccccgagacgcagggttctgatttcagagttcggatgcctaagaatgtgcatgacacagtttcccaggtgacgctgatgctgccggactaggactgagcctgcacatctcaccctgaattcaaaatcaaaagatggggtgagggttctcggcaaaacgcagcctgagattctattttggagacccctgttccagagagaagagcagtgctcctgacacttggtgggtggggcccagggacgctgctcaacaccctgcagtgcacaggacgccccccacagtcattcaacttaaatgttattagtgataaagttgagaaagactctatctattgtctatctatgtatccatctatccacccattcatctatcatcatttatctattacctatgtatcatttatctattatgtctatacatctagccatccatcatccatcatcattatttattatctatcatttatctaatatctgtcttcctgtctatcttcatcatcatcatcatcatcatcatcaatctcttatctatttatcatctatctccatatatgtatgtatctatgtatctctatatctatgtatcatctatttatcacctatctatctctctatcctatctatcatctatctgtccattcatcctatctcatctatcatctacctatgtatcatctatcatgcatctactgatctatttatctatccattatctatctatttatttatcatctatctaaacagtggcttacagcctaagaatgattctgcccctgctcctaccaggggacactgtgcaatgtttgaggtcagttttaattgtcactactggaaagtgtgccaatggcacccggcagatggagcccagggatactgctcaacaccctacagtgcacaggatgggcccacctcagagaatccagccctgaatgccacaaacgccttggtgaaaaactccagtagtaacttccatctaaccttgggaaagggatcaggttgacagtcacatcattctgaacagtccaggaggcaggagctgtctgagtcttttgtaaatgcccctcttgttagaacactcataagaccctttcccgtaggaggatcctcccttacccagagcaagagcacagcactccacggtttccctgctggagcaatgagaagccaacacaggccccatggaacgagttggcagcacaaggctgtgcagacatctggcgactattggagccaacaaggagaaagcatagaagctgggagagtctccccttccttgcacaagaactgagacttccttggaggggccagcttcatcctggcatttctcttctttggggctggcatccagaggatagaaaactgaggtcgtactggcaaagggggctccgccggggcacttcttggctcctaaggatttccccaatgcctcaggggctggacggatttgaaagtggaccccctatggaaaatgatacagagatttctcaaagaactaaaattttatctaccagttgatctaacaattccactacaaggtattcacccaaaggaaaacaagtcattatatcaaaaacacacctgcactcatatgtttattacagcaccattcacaatagcaaagatacggagtcaacccaggtgctcatcgacaggtgattggatacagaaaatgtgatttatgtgtacaatggaatcatattcagccatgcaaaagaatgaaattctatcttttgcagcaacatggatgaaactggaggccattatcttaagtcaaataactgagaaaaagaacgtcaattaccacgtgttctcactcataagtgggagctaaataatatgtccacatggacatagagagtggattaatagacactggagatacaaaagggtgagagagtgggaggatggtggagaatgagaaattacttaataggtaccatgtacactattcaggtgatgcttaccctggaaacccagacttcaccacaactcagtatatctatgtaacaaaattgcactttaccccataaatttacacaaataaaataaaataaatcagtaaaattggatatgtcaacctgtttaaaacaaacgaatgcagaaaaaaaacatgttgtaataacatataaaaataaataaagatggcttcttgatgtttaatatgccctgcagatatcttacaaagccccagtagtcacgagttaaattcttgcctgtagcctgctggaggtcagagatagcctccactgtttatgtacagctctggccccatctatgaagtagagctaaaaacaccaccgatacctgtccccaaggctgagctgatgcaggaacagccctcagcacagtgcctggtatccacagaccatcgatcatcctaggtattcatctagatcaggaaggcctgactgtagcttgcgttgattgccattgacagtttcggcaagaatctgggttcctttgctgtctctttcggatggacacgtgaaggctcttctccaagtaagttcactcattcgactcatgcactcatacatgcatgcactcacaccatcatcactcattcaactcatacatgcatgccctcacacagtcatcactcattcaactcatacatgcatgccctcacacagtcatcactcattcaactcatacatgcatgccctcacacagtcatcactcattcaactcatacatgcatgcactcacacagtcatcactcattcaactcatacatgcatgcactcacagtcatcactcattcaactcatgaactcatacatgcttgcattcacacattcattgattcattcacttaattcactcatgcatgcatgcatgcattcacactttcacttattcattcatgcatccattaacttgtccatgcattcaattcattcattcactcatacataatacattaattcctgaagtgtatgcagtcttcactcattcactcgtgtgtgtgcattaacacacatgctagtttgttcagctcattcctgtactcatacatatttattcactcagtcattcggccacgtattcacttgtcatgtattctcttcattcactcacacacacatccattcctgtataaatgcatgccttcacgtgctcaatcaatcctgcatgcatgaattcactcactcatgcaggcatgaactcacttgttcactcactcattcatgcactcactcatgcttgtacgaattcgcttatttactcattcatacactcatgcaggcatgaactcacttgttcactcattcgtgcactcatgcatgcatgaattcacttgtttactcactcatacatgcacttatacatgcatgaattcacttcttaagtcattcatgcactcaatcacgtatgaattcgcttgttcactcattcatgcactcactcatgcaggcatgaattcgcttgtttattcactcatgcagtcactcatgcatgcataagttcacttgttcacttattcatgcactcactcatgtatgcatgaattcacctttcacccattcatgcactatgcatgcatgaattcacttgttcactcaatcattcatgcattcaactcattcattcactcattcatagattcatgccttcacgcatgcatgcatgcattcacctatattttccacacagtcacacctccattcacgcatctatctctaaattcattcatacatgcattggctcgttcatgccttcaactcatgcattcatgtgtgaatgcattcattccctccttggcgcaaacattgattcaatggttcattcatttcctggcctgctcattcatgagtagttgtttgttcattcacgcctcacatgcattcacgcatacatgcactcacgcatacatgcactcaccgcgtgcgtacagccactcgctcgctatgcattcaacagctgaagcctgaaaccctcatttattctttctttcgtgcactcattcattcattcagtttatgcgtgtaagtacgcgcacgtgcatttttcatgcattcgacaagatcgcgtataagccctgccttctccctctgggaggcttccagagcggcctccactcttgctgcgcgctggccttgggcccagggccttaagtcatcgcaaacgtttactttggggctggctgattaaaggttaaatgtccaaacctagaaaccgccgactgccgaaggggccgcggcgggcgaggggcggggcgcgggcgtggatcgcagcccccggcggttcccgggtctctcttcccggcagccggggctgggcaccaggcggcgcgcgggcttgcgggcaggggctgcagggaggaggagaggacccgcgcccgcgggggctggcggaggcggggccgggcttccggacagaggccaatcgctgccctcggggcctccagcgccggctctgggccgaggcagccagagcgcggaagaggtgcggggggctgtagggggctgcaggggaccgtgggcagtggaggaggcctgggcgcggcggggggccggggggcgcagaggctgcccgaacgcctaggaggtctcgagggtgggtggcgtacagcggggcgggggcgcaacccagaggccgaggctgggggctgggggaggggcgccggactggagtgcaaaggaggggcgaggggcgcagggggctggaggtcagaggttgcccaagcgcgaaggaggggaggggtgcggggcgcgggagtaggccaggagcgcttaggggtgagtgcgccgagccagggcaccgagtgctggggaatacaggccgtccaggcgcggcggggcgcggggagacggaggctgccggagtacggaggacagacggggcgcgggcgtagggctgggaggcttggggaggggggcgcgggcccaaggcagaggctgcgggagcgcggggcaagggagaggtgcagagcgtggagggggctcgggggcgcttggggaggatgggcggcaggccgggtcggggaggaggggcggcgagaggcgcaggggtaggccggggggctgcactggagtgacgagggagggggcacctggccggggggcgcgggcagaggcagcccaagctcggaggaggtgcagatactggcgtccgggagcgcaggggtggtccagggagtggagaggggtgaccggggggcgccagctggggtggaggaagaggatgcccagaactccaagcaggtgcgcggggcggcggggcagctgctgacaccgctgaggtcgggtggtgtcccgggggcgttgtcgttgctgggcgcatgggtgttaagacgcagcggggtcgcaggtgactgtggggaggacagggggtcaaggggcccctggccagagggcacgaggctgacctggagcgccaaggaggaagtgcggggcgtggaggtcgcaggggcatcgggggaggcaggggccccgtggggcgcaggtgacatggagtgggtaggaggccgggggtgacactggcggggcctgcagccgagggtgtcgagactgccacgctgtcgcccccaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcgggtgagtagctcaagctgcttcagttcagcctgcctgttcctactggcttgggtgacagattggtctgcactggggagaaccccactttgaccgcaggattgccccaaaccccgagtctcccccttactgcctcgcccaggtctctctggggctggagggaatggagataccagcctcagctgctgggagggggtgatttacagcaagtgaagggggccttgggatttcaccagtttccttttgtaaaatatagtcctgaaactttcaatgggcttgtttcttgggaatagcattgaactgcctgagactgtcactgcctggaaggccgatgggaagaagtctgttctcctgaaatggccctaaagctctgggaagaggctgccttgagttcttagaactcagaccacggttttaatttctgtttccagtacagatacagggatggcccggcttggtggctcaggcctgtaatcccagcactttgggaagctgaggcgggaggattgcttgaggccaggagtttgagaccatcctgggcaacatagggagaccacatctctaggaaaaaaatttaaaaatcagctgggcattgcggcacctgcctgtagtcccagctactagggaagctgaggtgggagggtcctgagcccaggagttccaggctgcagtgagctatgagtgcaccactgcactccagcttgggtgacagagtgagaccctgtctctaaaaaacaacaacaaaataagaatccaggttaatcctcctgcaggcagagggctggctggcaagaatggcaggaaaggcctgcccccgccaaggaccggtgagccccatctccctgcccttgggttttgtggacatcagatagactggttgacttaagaggcctagatatgtgaacagagtgtaacctcttcccataagaaagatgctggttctattttctatcattaaatcattaagacacctccttcttgtaccagaccacactggatcattctatgagtgcattttatgtatttatttttaaatgtatattttttaaattttgtagagacagggtcttgctatgttgcccaggctggtcttgaacttctaggctcaagcagtcctcctcctttggcctctcaaagtgctgggattacaggcacgagccaccacgcctggccatgagtgcaatttaaaacacacaaacagaacagatgacttttttattcagaggagagatttggtaaatcacagagctgcttctctcctgtttgttcccactctggacttagagatgaaaattgtcggggcagggatcttaagggctgttttcatgaggtgtactggaagagtctgttccaaggaatggcagaaaagattctctgttctagggacgcgtttggagctctctaaagtgaaagccacacatttccccaagcctgctagggtctgtataatagcagcattcaagacggacattcgcatacatcttggtcagcctcgtgccagaagagaagactcaactctttgcagaaaacaaaaaccacctttgagtagaaaagggctgagaaggaagctgctaaggttattttggggggtgatcagaagattccttgagtgcaggggggcaggcaaggggtagaaagaaactgttgtcacagattcataaaattctcagccactgtaatctccagactggacttgattttgtgacaatgtctcctttttgtgggctgtggtgcagtgacaggttttcttgctgtttttccactccatgccgttgctgaaagtgtccgccgcagtggcacttggagtggaaactccctctttgaatgcagtagcattggataattgtggatgttctctggcgtctggcgccgcaccaggacttgatcaccagttgtttcttcaaggcaaggcgatgtggaagctaagccctgtcaatcaatgtttcatcttctgttctatttcaatctgctggtctgtctttgcactttagatgggttttacagtgtcctggatgggaagcggctaaccttcaggaggtgcacatttttgttccaaagcaaaagtctgagtctcggatcccttgttgctggagagagctcgtgtgccaactggtgttgtcttgtcattgtgtgactgtggtcaatattccctccactctaaaccaaagagagaaacagggtatccagtagttccataaaactctcactctaaatgcagccctgtctgcattctcttttgtgtttgagatcaaggtgggtgtgggcagggctggttcctcctgaggcctctctcctgggcttggtcctcacagggtcttccctttgtgtgtgtctgtgtcctaatcgcctctttttttttgagatggaattttgctcttgtcgcccaggctggagtgcgatggtgcaatatcggctcactgcagcttccgcctcttgggttcaagcgattctcctgcctcagcctcctgagtagctgggattacaggtgcccgcccccatgcccggctcacttttgtatttttagtacagatggggtttctccatgttggtcaggctggttttgaactcctgacctcaggtgatccacctgccttggcctcccaaagtgttgggattacaggcgtgagccaccacgcttggcctaatctcctttcttataaggacaccaatcctattggatcagagcccaccctagtgacttaattttatcttaatctcttctttaaagaccccatctccaaatacagtcacattctgaggtcctgcaggttatgatattcatatatgaattttggaggtgcacaagtcagcccataataggataactcatttatttgaatactactgtgtttttctgctggggctgccataacaaagtcccacagactgggcggcttaaacaacacacatttactctcccacagtcttggaggctggaaatctgagatcagggtgtgggcagggctgtttcctcctgacgcctctctccttggcttgtagatgttgtctttctctgtatctccacaaggtcatccttctgtgtgtgtgtgtgtctgtgtcctcatctcctcttgtagtgaggccagcagtgctactgtattagggcccaccctagtgacctcattttaccataatcacctctttaaagaccccatcttcaaatgcagacacattcagaggttctgtggggtagggtttcatcctaggcgtttcaggatgggttatcatccgtctataacacccattaatcctcatgttttccctgaggtccccatgaagagctataaagccagcgcatgtggttatcaatcaatgatcactctgccatttctcttagttgtcactgagatcctcatgaagagattaaaaaaaccagcgcacatcgttatcaatcattgatcactttgccagttcgcatagttgtcactcacgtcctgatgaagagataaaaagcccatgcgcatggttatcaatcattgatcactctgtcatttctttcagttgtcactgagatcctcatgaaggggtaaaaaaccagagcctgtggttatcagtcactgattgctttgccatttctcttagttgtcactgatgccctcatgaagaactataaaaccagcacaggtggcgatcaatcactgatcactttgccattcctgtgtgttgtcctctgcaccttgctttgggccaattcacttgcatcatccttttctctagacagccagagggccctccctggcaatggagatgagaccttcttacaggttttggaaccctcaaatagctcctcataagcctcaggataatagaaaaggctgcatatcacctttgtaatccgggccctctgaccccatctcttcctgtgggtccttgttctccagctgctgttgctacgctgtgaggaatgcaggatgcagcatgcaacctatcatctccacctctggccttggctggtggattttttctgcctcttccttctttgccttattatttttggttcagtttcttattggaggcaggagacagtagctattttgagggcttttgttggtgttggagtcagaggtgacctcggacatttaattactcgttgaagccccggtttacttgtttttgaagcacatgtctgtgttggaaagggaattaatgagagcgcagaggtatgccctatctacacactcctggagggatgggagccatattcattcttgtttgttgctccactgatttcttgatggataagttcttcctggccatttatccctgagcttggatggtgccctttcaaaaactgctgccagccataggacttgccttgcagtatcgaaacacccatttcttagggctaatgtttctcatggagctgtgggtgtctgaggacagagcttgtaccttgtcagctgctgggcccagcacctagcagattctcgtgcctgggaattgcctgggacgtgaacccacagtgaacgtgtaatgcactgagagcacgtcattaggcccacacagacatcttctgccccttcaccttctttgtcttctgcctccagcttcaatccttcactctttctctaagcagatgcccttatgtgtgcagcttatggcatagcactgtggactgggataagcagtgtcccccataaaactcatgtccccccagaagctgtgaatgggacctgtgaacccaaaagtatctgagacaggtctcaatccatttagaaagtttattttgccaaggttaaggacatgcccgtgacacagcttcaggaggtcccgacaacatgggccaaaggtggtcggggtacagcttgcttttacacatttcagagacatgagacatcagtcaatacatgtaagatacacattgctttgatctgaaagggtgggactacttgaagcaagggggttgcggggggtggtgccaggtcataggtagatttttaaatgttctgattagtcgaaagagttattatcaatagaagagaatgtctgggttatgataagaggttgtagagaccaaggttttatcacgcagatgaaacttccaggtagcaggcttcagagagaatagattgtaaaggtttctcatcagacttgaggtctgtgtggatgtttatggtggtcagcttttcctgaattccaaaatggaggaggttatgatgaggcatgtctgaccctctcctcattatggcctgaactcgtttttcaggttaactttggaatgcccttggccaattaggtagttgcgaggcctagaattttagtttaggtttacagaccttattgggaaatagggtctttgcagatgtaattagttaagcatctcaagataagattatcctggaatatttgggtgggccctaaatccaatggcaggtgtccttctaagagatagaagaagagacacagacacagaggaggccatgtggagttggaggcagagattggagtaatgtggccacaagcccagggacatctggagccaccaggagctggaagaggcaggaaggacccttctctagagtttggttttggaatcctggccttcagaactgcaagagagtaaatgtgtgttgtttaagtctcccagcgtgtggtactttctcacagcagccccaggaagctcattcatgggtttgctagggaaaggagtcagcgatgagcccaccagtaagcaaaatgagcacagcaggtaagatggcacaagagatgaagggtcctgtgtcataggaggtgagggactgtgatgagaagggtcgtcttggggagcagggtttgcaggaagatctctgagggatgggtggttttttccatggccaccatgtgctgggaggagagcaagttccaggtgagttaagggagtggtagtagccccatggtagtagcacacatcataggatgtgcttgaagacccagaggggttgagctggacgtggggactgagtgtgggggatgagatgaccagcagtctggacccagcttacatttgcagacaatgagaaaaccattggcgttgggttggctttcagggcagctgatggctttcactgtgtgttgggggagaaaatgtggtttttaaggaccgaggagacagataacagggaccagaatctacagggtggagcagagaatgcaaaggagggaagctgtggctcagggtggttgatgcagagacccattttaaatgttttctagtctggtgcggtggctggctcacacctgtaatcctagcactttgggaggccaggacgggaggattgcttgaggccaggagtttgagaccagcctgggtgacagagcaagagaccccatctctacagaaaagttaaaaataaattagccaggtgtggtgagcatctgtagtcccagctactcaggaggccaaggcaggaggatagcttgagcccaggagttccgggcttcagtgagctgtgatgctgctgctgcactccagccctggtggcagacagagcaagaccctgtcaaaaaaaaaaaaaaaaaaaagccaggcacagaaggacacctgtagtcccagcactttgggaggctgaggcgggtagattgcctgagcccaggagttcgagaccagcttgggcaacataacctgtctctaccaaaaatataaaaaatagctggatgtagtggtgtgcacttgcggtccctgctactcaggaggctgaggtgggaggattgcttgctctcaggaagtcgaggctgcagtgagctgaaatcatatcactgcgctccagcctgagcaacagacggagaccttctctcaaaaaccaccaccaccacaacgtaatgaacaaccccaacattttctgttgtgcctctcggttaagatctcaggttagttatgcaagagtagaatgtgggattggaggcaagtggacttctccttaccccagaattcatgtcataaatgctctgcacagacgaggcttctgggactcttggggagacctaggaggtgggtaatagggatctgaatctacacggtggagctcatgacccaggtcagatgatgccaagtttcattttatacattctctgttcttcttctctgctccttaagagcgcaggtcagtaagtggggttggaaacagtggactcttccttactggggtataggagttggcacgctaaatattctgcaaagcttgctcttgcaggaccaagcatctaaatagtaaggtctaacctcagtcatctgtttctggaggaaaatcccaaagcatggcctttggagtgtgatttagccctcattctcagattcagtggtgaagttcagaggggagccaatccctctgagcatctcgaaggtggacagaacagtcagctcaggaggaaatctcaaaacaacgcccctcctcgggagttctcttacctttgtcattgtagttcctaaaggatgcactccttttcctttctattctttaattcacagggtccttaaacatggttcctcagatttcaataatctatacattggagatcacaaagaaatcttaatactgccaatgaaaggctaaaaattgtaaatggcactttattttcagtttgacattactttgctgatgattcttttcataatatatatgatttgatttaccttattttttactttgccatctgctttgcaattaaatacacacacacacacacacacacacacacacatacacacacacacacgttttctttttaaagacagggctctgctctgtaacccaagctggagtgcagtggcacaattatatctcactgcagcctccaacttctgggtcaaacaatcctgccgtctcagcttcccaagtagctgggactacaggcatgtgccaaaaaaaaaaaaattaaattaaatgaatgcaagtccattctcagtatgaaacacatactgaaataactgcctgagaaatggtacgtggtagataaatgtgcagcagatgtgctaattggcctgggtatagaaatttagctatttggtctgggtatacaattttaggttgaggaccattgcactcagagtttagatatggtggtttgttttagtgtccactattcatgataagaagtctcagtctcatccttaataggattgacctgtatttttattttactttcattttcttggcattttcacaatgttctccttagccttggtgtttttaaattccaggaatatattgtcaggaaaaggactgctgattttctttctttctttctctctctcccctcctctcctctcccctcccctcccctcccctcccttcctctctctctttctttcttttttctttttctttctcttttgttgcatactctctgggctttttaaatctaaagactgactttctgctgttgagaacatttcctgtttaatttctttgaaaacttttcttctctctattttttttttctattctcttattctgaaactcatgttggtgaaccttctgaatcactcctgtaggcttctagctttctgaaattttccatttgtccctttattctactttctgagagatttcctcaatgatgttttccaaaccttctgttatttcgttttcatttcagcaaatcatatttttaacttctaataactatttcttatccttggagtgatcttttctatagcatttgattcttggtttatagatgtatccctctccccctgatcttttgaaagaatactaattggtgcagtcagaatttttatgtctgcctgtctgttccttgaacttctattccatgaaatgtctggtatttctggggttcttcccattccaccccataacttttcagttttctcttttgtggtgaaggtgtttttcaaatatctggtaatggtttatatctatatgtataaaaatgaggaatgtcggttgagctgtacccacttgccgactcgtctgaatttgtcaagcttatgctataggttgggaattccacttctgtgtgatggtaattatttttttcttgggctttttgtttcctttagaatagatcctatcatctgattttgcccctggtgatgggtatatttggcctctgagaattctgcagaatttcagtgacttctccagtttctcttattggctgatggttttctcctgcctctttgttggcttggggttcacacttgccttccttagcacactttttagtctgttctccttttatctcagaaagaaggaaagagaaactaggagctccacatccaccatctttgcttggaagattcctggtttacacttttaattacgtgattgaattgatgaaaatggatggaccttgaaaacatcatgctgatggaaagaagtcagacacaaaaggccatatgatgcttaattccatttacatgaaatatgcagaacaggcaaatccacagagataaaaagtgattggtggttgtcacaagctagggaagggagaaaggggagatactccttaatgagtgcagggtctctttttggggtgatgaaatgtcccaggattagatagaggtggtggatgtgcaacattgtgatgaattgtgttctttacaatggcgaattttatgtcatgtgaaatttactgtgataaataaaaaggaaatatgaaattattccattttcaaaaggctacatagtgtttgattccatttataggaaatatccaaaataggaatgtagagacagaaagcggactcatggttgccagaatggggagtgactgcgtaatgggtacagggcctccttttggagtggtgagaatgtcctcggattgcctggagttagtggttgcacaacattgcgcatggactaaatgcgagtcacttgtgcactttaaaatggtttgttttatgttatgttaatttcccgttaattttttgagagtttgcatggaaaggtgaagctctaagcaggtcgtatgtttaggtgtggggatacccattatgctgcttagaaatatgttcacacttagggctcagcactgggggttctacttggtaattctttctgcttccacactctttcaagatatgggtcagagaaaccctggtgaggacggggtaggggattggatctctggctctgttttgggcattgtgtgattttcgaggtctgtgggtgaagctcacacagtacctttaccttggccagctctgggctttgcagatgccagtcccgaatgcctgcttcctctcccaactctgtcctctgcttagagacaaaagaagccttacagacagctgaatgggtccatgacagctacgcctgttcttgggaagtaattttgatcagagctcaggcctttggaaatgtctaaagaagtagtaatcaccattattatcattttaaagctagtaactaagaaaactatagatagattatagataatggtagagataatttataatctatagactgtaggtagataggtagatgattgaaagattgatagatataaataagtagatacatagaggacatatatatgataggtagatggtaggtatagatagatggatggctaatagaaagatgataggtagagagatgatggagatagatggatgatagatgatagatatatagatgatagataaatagatatagatgatatatgataaatagatgatagagatacatggattagatagctagatagataatagagatacatgatagtaagatagataataaataatagatgtgaagaggattggtagatgataggtggatagatggatggatagatgataggtagatggatagatagatgatggatggatggatagatagatatatgatagatagatgaatagatgatatagatagatagatagaaggatggatagatagatgataaagatagatcgattatagtaagatagataatagatgtacagagaattggtagatgatggatggatggatgaatagatggatagatagatgatagatggatggatgtatagatgatagatagggatagatagacaatggatggatggatatatgacagatagatggatagatggatggatggatagatagagatagatgatagtaagatagataataaataatagatgtgcagagaattggtagatcataggtagatggatggatgaatggatggatagatagatgatagataggtagatggataatatagatattatccaatgatagatagatgatggatggatggatagatagatgatagataaatagatgaatggatggatggacggatggatggatggatggatgatgggtagatggatagatatggactgatgaaaggtatcttttgttctacagaattaagttgtaaagtttgctgtctgtaattctcactcccaatggagatgtcaggaattctcgttctttcttcgttcaagggtggggaggaggagtctacaggagcagctgtaacaggcacattttggaatttaccccattggaatgtaaaggtcaaggaggcagccctgtaccacacgtctgggacgcttgtgtttgttatatttagtgcgaattgtgggttggctttgcttggagtgctgcttccgggaaaggcgctgtggtcgcctacatgctgagcattttaatttccatagacagtacactgggctgcacactgcatgggacttctcggcattgctggctgccctcctgactgttgtctttctcctggcaacaggggcttgggtgcccaagaatcaagtggtttaaaagtcattaccaaagttcacatcagtcttgtgcacagagaattaaaactgctgtaaattatatctgctgtgagagctccttcctctcatactgaggcattaggaaattgaatccattctacctaatgaaacaatgtacttttccttatgttgtctctaccgcctcatacatccctgagttgaacttgaagtctttgtaagaaatggtctgtccagaatttaaataacatgtttggctgcttctttatggagcacgattcttttctttcctttctttcttttttcttttttctttttttcagagacagggactcactctgttgcccaggctggagttcagtagtgtgatcatggctctttgcagccttgacctcctgtgctcaagcgatccgcctgcctcagcctctcaagtagctaggactacgggcatgcaccacctcgcctggctaatttttttttttttccagtacagatgaggtcttgctgtgtttcccaggctggtttcaaactcctgggctcaaatgatcccccttcttcgaccctagcactgggattacaggcatgagccactgcacctagcccaaagcacagttcttttgagtgagttgggttacatctttgctgtaactcaggtcatcaagccatcacttccactttttgccttttgttttcacctaagatctaaacactttgggtgagttttcaagagtcaaacacaacataaaataagggatagtagctatgagtttccatggcattgcagcatcaggaaatgggcatagcagttgggttgactttgtcccttgtttaaggttccttcatactcctcctgtgttttgttttgtttagaatgaaaggaagcatgtatgcgaattagaatactgaatattcactgcaagtcgtgattttttttttttttttgagacagggtctcactctgtcatccaggctggagtacagtggtgcaatcacggctcactgcagcctcaaactcccaggctcaagtatcctcccacctcagcctctccgagtagctgtaactgcaggcctgccaccacgcccagctaatttttgtatttttcgtagagacagagtttcaccatggtgcccaggctggtctcgaactcctgaggtcaagcaattcacccacctcagcctcccaaagtgctggaatgacaggtgtgaaccatcacgtctggcccaagccatgaatcttgggagaggagaggaggtgactatggccccgtcacccctgctgtccctcaggagtgtaactctggtgtttctgttgattttcacagtgactgatcaggcttttgtcacactagccaccaatgacatctactgccagggcgccctggtcctggggcagtcactgaggagacacaggctgacgaggaagctggtggtgttgatcactcctcaggtgtccagcctgctcaggtaaggctcagagatgcggcttgtgcccagctgggtcctatagaaggagggtcacctctcccctaagaggtcctaggagttattctgacgactgactgcccttcttcataggcctggatggccggcagtcatgatgggcatctgacgtttgtaaggaaccttcgaatcatgtgaaaatataggcgtgtgatcggcttcacaatactttaaaaaacaatactgggtttggttacagttcattctcccaaccatggaaactgaaaattcaattcttttttgtttgtttgttttttgagacagggtctcgctctgtcgcccaggctggagtacagtggtaccatcttggctcaccgcaacctctccctcccaggctcaagcgatcttccctcctcagccttctaagtagctgggaccacaagtatgtgcccccatgctcggctatttttatttttatgttttgtatttttggtagagacagggtttcgccacgttgcctaggctgatcttgaactcctggactcactcagtccacccaggttggcctcccaaagtgctgggattacaggcatgaaccatggcacccagccaaggagtcttttcttataatttccttttataattctctttgtctttaattctcaaataaagcaaatacataaataaatgcgtctaatgaataaagcataaggcttctcttaaatgtcatacattatgtaagcaataatctttttctttcatcaaccatggaccacttaaaaaaattgattttatacgaatgggacgaggaggcatttaatatggtagatgtagcaggaattgaatgtcatattctttgacaatgaaataataaatccagacattaatagctaaactaaaaagagaacaaataaaaaaccaaccagtgtgtcctcagacgtttgaaactggaagttttaaatgaaataactcaatccgggtacaaatgaaagcttgaattatgtactatttcagaaaatcactgcaatgtgagtgctacctatacaaagcaaagacagcaactacagtggtacaagacagaaaatttaaatcagtgaagaaattatccagttcaaatatatatgtatatacacacacgtatgcatatatatgtgtatatgcacgcgtgtgcgtatatatgtgtatacgcacacgcatgcgtatatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgcatgcgtatatgtgtatacgcacacgtatgtgtatatgtacacgtatgcatatatatatacatgtatgtgtatatatttatatatacgtatgtgtatatgtacatgtatgtgtatatatttatatgtacaggtatgcgtatatacacatgtatgtgtttatatttatatacatgtatgtatacctgtatgtatatatgttcaactatatatttttatatacatgtatgtatatatttatatatacatgtattatatatgttcaaatatatttatatacacatgtgtatgtatatttatatacacatgtgtatgtatatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatgtatatttatatacacgtgtgtatacacatgtgtatatatacacatgtgtatgtacatatatttatatacgcatgtgtatttacatacatttatatacgcatgtgtatgtacatacatttatatatgcatgtgtatgtacatacatttatttatgcatgtgtatgtacatatatttatgcatgtgtacgtatatttatttatgcatgtgtatgtatatatatgcatgtgtatgtatatatatacatgtgtatgtgtatatatatgttcaaatgtatatgtatatacatataaaatatatatatttgaactggatttcactgatttaaatttaaaatatatatacacacatatttgaactggataatttcaaatatatatatttcatatatatatttgacttggataatttcttcactgatttaaatttaaaaaaatatatacatatatgtatatatatacatatatatacacacacacatatatatacacatatatatatatatatatatttttttttttttttttttttttttttttgagacagagtctcactctgtcgtccaagctggagtgccatggcgcgatcttggctcagtgcaacctccatctcctgggttccagtgattctcctgcctcagccttccaagtagctgggattacaggcatccaacatcacgcccggctaatttttgtatttttagtaaagacaaggtttcaccactttgcccaggctggtctcgaacgcctgacctcaagtgatctgcccgcctccgcctcccaaagtgccaaagtgctgggattacaggtgtgactcaccgtgcccagccccaaatatttttaaaataataatattaaaaaagcaaacagcagtaaaaaattcataaagataaaatgacaaaactaataattgggaacaagaaacaaattcaaggattaggttaacaaatcttcagggaggccaaggtgggaggattgcatgaggccaggagtttgacaagacaggctgggtgacatagcaagaccctatctctacaaaaaataaaaagagttagccaggtgtggtggtgcgcacctatagtcccagctagtcaggaggctgagatgggaggattgtttgagcccagaggttcgaggctgtagtgagttatgatcacaccactgcactccagactgggcaacagagtgagctcctctctctaaaaataaaaataacaaataaaaatgaatcttttattcgagaaaacataaatgtacaaaattgaaattagaaagaagtcatttggaggcagttttaaaagcaaatagtatatagaaccctttacagtagtgacactgggagtattgaagaagtgcttgatccttctagggaaatcggtgagatgttggttgttgtcatcagaagaaatagaaaccttttgtttgacaataactatgagaaaaactgaaaatgttaccaaaggcttatcttgtagaaaggccctggtttgggcaattttaagggaagttctgttaaattgctcatgatgaattaatttccctgctgcataaactgtcacagagcctagcaaaagatgaatatgttcacttattttaagaaactgttataatcttgacacccaaacttgatttacaggtttgattgtgtttacatttggattgagaaagccctcaaatacaggatgttaataaggcaactctagccctgtagtaaagaaataaatagtgcttacactaagaaagcaaagataggttattattttaaaacctattaatatcattcaacacattaatatgttagagaaagtcaatgataagatccttttaaaataaaaactaaacatataacaaaaagaattccaggccggccacggtggctcatgcctgtaatcccaacactttgggaggctgaagcaggtggatcacttgaggtcaggagttcgagaccagcctggccaacatggtgaaccctgtctctactaaaagtacaaaaaaaaaaaaaaaaaaaaattagctgggtgtggtggcaggcacctgtaatcccagctactcggtgaggctgaggcaggagaatcacttgagctcgggaggttaaggttgcaatgagccgagatggcaccactgtgctccagcctgggtgacagagcaggactctgtcaaaataaataaataaataaataaataaataaataaataaataaataaaaatccacatagattataaatatagaggtaaacatttaaaacatagagaaatcttagaagaaagtagatgaaagtttctcagcactgctgctatctgggactggagggttccatgtggtggggtgtcctgtgtactgcagggtgttgagcagcgtccctgggctccgcccaccagatgccggcaggagttggcagttgtgacaactaaaaatatctccacatgttgatgaaggtggatgttttgttcatctgaaagctggaaatgctggtgtaaattaaacaagatggaagaggacaccagaactgctgtgtgtcagagatattatgtgttaaagataaaacaaactgagggccacatttaaaatattataatggagaggttcttattgtccatcacgtacaaagaactctgaaaacactttaggggtttgcacgggctcgtctctagcacgccagaagcaaagatagacagacaaatacaaaaataggtattaaacacgagcaactggctgggtgtggtacctcacgcctgtaatcccagcactttgggagactgaggtggacggatcacttgaggtcaggagttcgagaccagcctgaccaacatggtgaaaccccgtctttactaaaaatacaaaaaacattaaccaggcgtggtggcgcctgtaattccagctactcgggaggctgaggcaggagaatcgcttgaacctgggaggcagaggttgcagtgagcccagatcgcgccacctgcactccagcctggtgacagagcgagactctgtcaaaaaagaagggaaaaaaaaaaaacctgactatattaaggtccaaaaatgcaccagtgagtggaaaggtacacatagcacatccagcaggttccgtgttttattttaaaagccggcgggggcgacggggtagaaaaatgctgttaaagagtgtaattgagttgcttgtaacacaaaggataaatgcttgaggggatggatactgcattttccatcatgtgattattacttattcctgcctgtgtcaaagtagacttaaggttcactcaagaggaactttaaaatattcagaaacaacatggcagaaatcgtgggaaggttcagtgttgcaagtcgggttgaggttttgtgggaccttttattatatgtttcgtagtcatggggagaattgagggatggcgctctgcggtggtcagggcagtggaagacgagcagtgagcaatgaccgtaaatgaccaggggtgtgggtggtgggagatcgcccctcccccaggctgtgtggtacaagcgtgttatggagtgatcttgcagggaaacctgctttaaactaattgtattcatgaaacataattctgcttccaggagtttattttagggaaatgagcagagctgaacaaaaagatgtaaggacataaatggcagtgccatttgtagtgaggtggagtgctgtttctcttgccctccccccagcccggatctttacgcaactgtggtgaagatgccataaattccataaataactgggccaaaagcagagggagatttgctgaaggaagggtactttttcagagaaatagttaccttaaatacagagcagtgaaatcttacaaataaatgtcgagtccaagagaaatgctaagagatagaaaaggtccgagagcttcaatatctgtcaaataggagagaaagaaaaagaaagaaagaaagaagtaactcctattatatttcagctctgagacaaagtttagattgaaagtgttccagatattgagcagagtggatgaagaaagctcaaatgtagacaccaagtggtaaaatttcagagcagcaaaaatgaagaaaaatcctaaatgcctttctgtatcaatctggttgtgacaattgatgtctcaaaattctggtgcaagataactttgaaatgaaagttctgtattcagctttagtaccgtaatttgaaagcaaaacaaagacttttcaaatttgcaaacgttaaaaatgttatccctcaaagatctttgaggaaaaagttagttgattgactcctgcaaaatggaatgtaatccaagaaaggcgagagtagccaagcacagtggctcatgcctgtaaccacagcattttgggaggctgaagtgggaggatcgcttgagttcaggagttcaagaccagcctggacaacatagtggggtctcatctctactaaaaaatttttaaaaattgctgagtgcagtggcacatgcctgtagtcccagttactcaggaggctgaggcgggaggatcactggagcctaggacattgaagctgcagtgagctatgattacaccactgcactccagcctgggtgacagagcaagaccctgtctcaaaataataataataatgataatgataatgataataataaatagaagagagcacacaggaagcagtgctgaataaataaatgtataaaacagagttaagtctgaatgtgttagtgcacagttacgaaaataatctggaattaacatttcacatgggaggtaattgaaagagcagagaagaaagaatgagcatatgttcatgtttttgtttcgtctgggaagaagacataggtaatgactatatttgatagaaaatataagcttaaatacgtgtgctgacagttgaaaggtggttaccaccagaaaactagaaaagatgtgtacaagtttcagagccttaatgggaaatgcgtggattgaagaaaacctgattcatgcaatcagaggtgggtgggaaagaattacactgatgtcaggcctctgagcccaagctaagccgtcatatcccctgtgacctgcatgtacacatccagatggccggttcctgccttaactgatgacattccaccacaaaagaagtgaaaatggcctgttcctgccttaactaatgacattatcttgtgaaattccttctcctggctcatcctggctcaaaagctcccctactgagcacctttcgacccccactcctgcccaccagagaacaacccccctttgactgtaattttccttgacctacccaaatcttataaaacggccccacccctatctcccttcgctgactctcttttcggactcagcccacctgcacctaggtgaaataaacagccttgttgctcacacaaagcctgtttggtggtctcttcacacggacgggagtgaaaactgaagaaatagaaaatctgatatatgtaaaaaagggaaaataatataaaatgaaactgcaggactcaatccaaatataaccgtgatcataataaacatgaatagattaaaattcctttttaaaaagataggctttctgaatgggaaaataaacataaaatccggacatacagtagtgtaggaggcagcttaattaaaaacaaacaaaatgttgaaaataaatggatgcatttgatatgattctgttccactatccaatctaagtaatggtcaattgttttatagattgttcttcagttgtttgttgttgttgttgttgttttgagacagagcctcgctctgtcgcccaggccggagtgcagtggcacgatctcagctcattgcaacctctgcctcccaggttcaagcaattctcatgcctcagcctccagagtagctgggattagtttcccgccaccgcacccggctagtttttgtatttttagtagagacggggtttcaccttgttggccaggctggtctcgaactcctgatgtcaggtgatccacctgcctaggcctcccaaggtgctggaattacaggcatgagcccctgtgcccagccttcagtttggttttgtccagtgttttctcatgattagactgaggttatgcatttttggcaaaaaaatcatcagaattgatgtaagttttcagtgtgtcatgctatggagtgcatgatgtctgtatgtcctgacctggtgatgttaaatttcatcacctggattaagtggtgtctgttggaattctccactgtgaaattattatgtttttcttttagtaatggaaaatatcttggcatagacattatacaaacagcctgtttcttctctaaaaatcagtgagtcttgtctgcaacagttgttactatagtgtttgcctaatcgtggttttctacttccctcattccttctatttcaattacttggaattatcttctaaattaaacctgccctttctttctcacatatttgtttattcaatagttatattaggtcaggcgtggtggctcatgcctgtaatcccagcactttgtgagactgaggcaggcagattgcttgagcccagaagtttgagacaagcttcataaacattgtgaaaccccatttctaccaaaaaatacaaaaaattagccgggcatggtggcatgcacttgtagtcccagttacttgggaggctgaggcaggcggaccacttgagcccaggagttcgaggctgcaatgagctatgattgcaccactgaactctagcctgggtgacagagtgagaccctgtatcaaaaagaaaacttatattagtgtaggctcatgaatatttatttcatattttgggcttgttgttttttgttattgattacattatttcagctttggcaattgggtgcttcccctagctggccccctgtattctttcaatatgcccccatccttttctagcacttgcttaatttttctgtcatcccaatatgttccagactatgatgaagtgggatttaagcaaaaataaataaataaatggaacagagcaaatttcactttgataaaatggacagtctttcaagcttcgagtctcaaacttgtatgcaactaacaatgtaagctttgaatacagaaagtaaaaattgatagagattgttatggacatctgttagtttctaccagctcagcatttacatttctctgcctctgcagcttacagagggaaactgtcttcctaagagctggcccaagtgcatgcatcttaagacagttctgttcaatttgtcacatttttcaagtatgcatgcatttctttttcataatattaatatttattactatatatgaatactagattgaaagcccaagcattcagtttacacacagaaattatgcaattatatatcgcttcacaaaggcagtgaacacattacattctacaaaatctacttcacagaaatttaaaaattctaaatatcaaaaggtacagctgaagaaacaggtataaatttggcagccagtaattttgacagggaagttgcagcttgcatgactttatttttttgtttgttttttgagacagagtcccactctgtcgcccaggctggagggcagtggtgccatctcggctcactgcaacctctgcctcctgggttcaagtgattctcctgcctcagcctcttgagtagcaggaattacaggcgcccaccagcacgcctggctaatttaaattttttgtttgtttgtttttgtttttttgcttgtttgttttgagatagagtctcgctctgttgcccaggttggagtgcagtggtgcgatctcaggtcagtgcaatctccgcctcccgggttcaagcgattctcctgcttcggcctcctgagtagctgggactacaggcgccaccacacctggctaatttttgtatttttagtagagaaggggtttcaccatgctggccaggctgatcttgaactcctgacctcaagtgatccggctgcctcggcctcccaaagtgctgggattgcaggcataagccaccgcgccaggccttgcatgactttaaatatatgaatatgaaaatattgaacttagagtaatcattgtgctttgtgttgattgaaaaatataacaatggctatcaaagaagcatgttcaaagatgcttaattcacttcaaaatgtcatacaaattgtggtggtttctatgcacctctaaagcttccgtcatttagctcaggtacattactaaagtaatatattaattctaccggtacagtggggtttcacaccattggcatttgcattcaagcatgcagaggcttttgggcacaagtggacggtgtgcacagctctaagccatccgtggaaatgtgctctgaacatggagaccgcagtgagggctgtggggattctctttgcattccacgtttgtgagcagcaaaacagcaccctcttgaaggaggaggtggttctgtgctgaatattcacccgctgtcccactatttggcacatgtctgttccagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgagtgaagactctctgcttgataggaaaccctccaagaccacatctctatccttaagcaggctgtcaacttttttttgtgtgtgtgtgacacagtcgctctgtcacccaagctggagtgcaatggcacgatctcggctcactgcaacctccgcctcctgagttcaagtgattctcccacctcagcctcccgagtggctgctattacaggcacccgccttcatgcccggttaatttttgtatttctgtacagactgggtttcgccatgctggccgggctgtcacctcttactggtagattcctgtgaggccatgtgcatttctatttctaacacagatgttcagtctattataatcaggcataacatacccccgagcactgtgctagaccctgctgaagagaacaggggattggaagacatgttcctaccccaggaatgaattataaccacagtattttacacgcacaaaatagaatcatgagggaaaaaacttgtgactgggcacagtggctcatgcctgtaatctcagcactttgggagcttgagatgggtggatcacttgaggccaggagtttgagaccagcctggccaacacggtgaaaccgtttttactaaaaatacaaaaattagccaggcatggtaacaggtgcctgtaatcccagctactcaagaggctgaggtggggggatcgcttgaacccgggaggcggaggccgcagtgagccgagactgaagcactgcactccagcctgggcgacagagcaagactctgtctcaaaaacagaagcattggtaaaagaagcattgcggcgggttctgcgtgttttgcttcaccaggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggtaagtcagggcagcccggacgcttagggtctctgttgcacacactcaactctgcagatgtaacacgaagtcagccgttgaccatacagtcacacctcgctcagcgacagggatgcggtctgagaaatgtgttgttaagtgattttgtcattgtatgaacgtcccagagtgtatctgcacacacctggatgatgtagcctactgtatacctaggctggagggtacagcctattccttctaggctacaaacccatatagcatgggagtgcactgaatgttgtaggcaactgtaacataatgggaggtatctgtgttctaaacatacctaaacatcacaaaggtccagtgaaaatacagtataaaatcttatgggaccaccgtcagatgtatggtctgtctttgaccgaagcacttttatgtgttgcatgactgtacttggcattgaacatgggctggccgtggtggctcatgcctgtaatcccagcactttgggaggccagggcggacagattgcttgaggcgaggagttcaagaccggggtgggcagatggcttgagaccaggagttcaagaccagcctaggcaacgtggcaagaccccatctctacaaaaaatacaaaaataagctggatgtgatgctggcacctgtagtccccaagccctgggaggctgagttgggagcagcagctgagctcaggagctcaagcctacagtgagctatgattgcaccactgcactccagtcaggttgacagagtgagaccctgtctcagagaaaaagaaaagagcatggctgtgttccaataaaactttatttataaaaacatgcacagtgtgtagttgcttgacccatggtagaatatagggagaattaaaaggaggcaacctgaagccgagtatttgttgaaatgggcgtcagtagagaggaaatgtgctggaatttttgtaaagtaaaagaaaatactggagcagtgaagaattgcctctaggtaaaggggaagttaatgaaactggcaaaaatgatgggaaaagcattgtcactaccagggagaattcattaggggaccagtggaatgctttggactccatatgcaattttagcattcattctggggactcctggtggagaattttggagggaatatgcacttatttttatcaatggcttgggttatcagtcttttctgagaaccaagagaatgtgtgcagctggcagacagaagaaatggaattagtaaccctgaaggcaagtgtttatgttgagagcttcaggcacatctcgcattcttggagtgaaccaagccatactttgctaacctgcttttgtgtttgctcattatgtaggggcagaccaaggcttactgaatagtttcttcaggaactggtcgaccacagacatccacaagcacctgccgttcatctataacttgagtagtaacacgatgtacacttacagccctgccttcaagcagtaagttctccaccctggcgaatcctgccagatctgccactaccgatccaccttccctcctggaagacataccagctgtcggcatatttaaaaactctatctatctatctatcatctatctatctatgtatctatctatctatctatctatctatctatctatcatctatctatcatctatctatctatcacctctatctaggtagatctaaatatctatttatctgtatagatagatacctatgtctatgtgtctgtgtatctagatctctatgtctatctatatagatatatatctgtctatatagttatctacctatataggcctagacatctgtttatctatctatctatctatctatctatctatctatctatctatctatccatatctatctatttagatctggatatctatctgtatacatagatctatatatctatatctatatatgtatctatatctagatctagatatctatatacattgatctatctaatctctatatctatgtagatatttatctatctatctagacctagatgtctatctatctagacctagatatctatctatctagacctagatatctgtctatctgtctaatctatcatctatcatatgtatctattcagatagatctggatatctatctataaacatcttatctatctatctatctagatctacatcactatatagatacctatatctatctatctagaactagatatctatgtatctagatatccatctagatttagatcttcatccatatagatatctatatctatctatctagatccagatatctatctatatacatagatctatatatctatatctgtatatctatctagatctatctagatatctatgtatatacatggatctatatatctctctatgtatctagatctagatctctctctatatagatctatgtatctagatctagatctctatataggcatctatccatctatgtagatctagacatctatctatatattaatacatagatgtatctatctatatacgtctttatatatgtatatacacacacagaaacacacacacacatctcgtttcctgcttgcttgttgctgtaaatgatagctagccaaggctctacgacaatgatccccaaagtgtggcccaaggaaccctgaccccacaactctttcaagtgtcttcaaagtcataactactttaaaaaaagaatttgaagatgtgatttttttccctttttgctgccattttctcatgcatctatgctgagagtttacagacactacatggcatgtgataaggtaataccctgaacacagatggagctaggaagaaccagctgtcgcctcttgggaaaatggatggcactcttctcacaatgattttttttaatatagaaatttttttaatgaaaaattatgaaatttatgttactgcataatggtttgattttttttaaagggattgataaatatgctttctaatttctcagttttaatatcgattattctaaatatggagagagagaatccacagggacatggccgagcacagtggctcacgcctgtcattccagccctttgggggccgaggtgggcggatcacttgagctcaggagtttgagaccagcctgcgcaacatgatgaaaccctgtctctacgaaaaaataaaacaaaacattagccgaatgtggtgtcgcacaccgctagtctcagctactcgggaggctgcggagggaggctcacttgaacctgggaagtggagtttgcagtgagccgagatcgtgccactgcactccagcctgggtaacagagcaagcctcagctcaggagaaaaaaaaaagaaagaatccacacggacaaagctctttgggttcctaaaagggtcaagggtgaggggaccagaggctgtgaaattcactgctccagaagatatggctataaatgaaaatagagaatctgagaatcaccttgggaatgaataattctagagtctgcattctctacagaggacacggtgtccctaaggaagagaaattgattcttgggagtgaaatcttgttattttttactgtataatcacagatgtaatgtacagaacatagatatgtcatgtgacttttgtgttcatatttcatgaggaggtgatccacgaaaaaaaagtttaaaaaggctcctggaggatggtgatgatgaacaacaaaaaagttggcaaggggaacatttagaatcctgtaaaagagaaaaaaagccaattgccttgccgcttgcattagccactgtaaaagctatttttttttgcccctgtcgttttaaggatatgatgatttgggctgctgtacttcacgtttttacaaaactgatttatttttcccgttttgggaaaaaatgtcaatggattacgattatgttttttgatatatagaaaataaaataactgcaaaaactgtgatttaaaaaatatatctttatgcaaaataactgcaaatgaaactactactactatgctgatagcagtggagtagtattattgatgatatattgattactatcttgatagtagtggtatgctagtattgctcagatattgattactgcattgatagtactagtatattattattgattatatattgattactatagtagtgatagtattttgttattattgatcacacattgattactgaattgatagtagtagtatgttactattggttatatattgattactatgctagtagtagtatattgttgactatatattgattactacattgatagtggtagattattattgattatatattgagtactatgttgataatagtagcatagtattgattacataacgattactacattgatagtaatatattgttattgatcatatattgattacatgcattgatagtagtagtgtattattattgattatatattgatgactatgttgatagtagtaatcttattatgggtcatatattgattactgcattggaagtagtagtgtattattattgattatatattggttactatgctgatagtagtagtatcatcagtaataataatcaataatggaaacccattgggacaagtccttcagaggctgtctttgaggagccccatggtaggtggatgctttctgggtgtcttttatcacatctgagtggaaatcagaatcccttctgtttccttctcagattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacagtaagtgggggattcccttaaaacccgtagctgaggacgaggagaacatccttgtcaccaaggtctggcgtggtttttttttgaaatgccccttttttgtctaaatactgtatttcatggaaaagaatactgagaagcaagcacctgttaaaaaaatttttaagttttagctcaaaatagagaatgcctaatgactggagatcctgttttgatgtgtaggcctggtgcagaaataggttattgaaattagccatcctcatcagagtaagagacactcatggacaagtggttcacaatgactgattacgacgtcattcgggtcaacactttccacttgaaaccatcatttgagatagcagttggaggaagtgtctgaagaggattttgtaaagttttgattgacaccaatttgattgcaaagaatataatgacagcccctcggtgtgctaaatggtggagtatctgcagtgtgctgaatgtaggctgcatctgccttgcagaagacctcttgcaattaggactcaggaaacttcttattcctaatggcttttttcactaaagtaaaaaaaaacttgagcttttttttttttttttttttaactagagcatttgtactagagtaccagagtattttttaactagagtaaagaaaactagagttttgtttgtttgtttgttttttgagacagagtctcactctgttacccaggctggagtgcagtgacatgatctcggctcactgcaacctccgccttctgggttcaagcaattctcctgcctcagcctcccaaggagctgggattacaggtgcctaccaccacgcccagctaatttttgtgcttttagtggagacggggttttgccacgttggccaggctggtcttgaagctctgacctcaagtcatccacccgcctcagcctcccaaagtgctgggattacaggcgtgagccaccaagcccggcctttttttttttttaactagagcatttgctagtacaacagagtctgctatcagcacatgcattgcctgggaaattgaaaagaatccctattttaatttttagtatggttttttatttgggtggatctaggctgctttttaaggactgctgaaaatttctctcaccgagtgacactagcaatggacgtttatttgtattcacttcacaaacattgacttgtcacatatttcctgctgggcgttttgctaagtactggattattaagtactggattactaagtactggattactaagtactggattgcataggagggaattttaaggcttagtgtcaaacggtcctgagaaagaaaacatttaggacaattatttaatgattggcagatgggagctgggagccctggctacacagggccccacccgccccccaggacagcaggtgaattgaggagacatagggaagactcactccacgtgtgtgtttttgtgcagctttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatgtaagtacctgcattcctcacaggtgtgatagtcagacgctggctcgcagtgagagagcagagagagccggcttccctggctccctggggaggggagatggaggggaagggctggtctttggcttgctgtggcattcaaggctctgcatttatttttgcattacggcacaccgaatcaagctcacctgctgaaagatgtctatgccccaatccctaggacctgtgaatgtcaccttgtgtggcaaaagggcgtttgcagttgtgattaaatgagggaccctgagctggggaggtatggtcttggattctgggagtgggctcttagtcatcacaaacctcccttcaaagaagaaggtggaagtgtgaaggtcagagaaggagtgtgaagctggaagcagaggccagagagagaggggattggaagacgctgggctgctggctttgaagatggaagaggaggccacgagcgagggaatatggtggcctccagaagctggagaaggcaggaaatggattctcccctaggtccccaagaaggaaccaaccctgccgacaacttgattttaatccactggacttctggcccccagaactatcagatggtcagtctgccttggtgtaaaccacccagtttgtggctgtttcttacatagcagcctcaaaaatctgatgccacaaggagacagatgctcagtctctcgcagtttacagattctgggggagccagagctctttcaggttcaaaaagggaggcttccgtcagtgccccctcaacccaactgcctggccgtgcatcctgagaggtttcagccgaacccctgacttgaacagtggttgaagtgaagatgaattcctgccggggttcaatgttcaaatgaatgttgacctgcacagtggtgtctgctgaggccgagtctgcagcactttgtccccatcgaagaaaaatgaaaatacaccttacttgcaaaacaaataatggaggccgtcatttctccagctccaatttctaggtgaatactttggaataatatcttgtgtttaaagatttcctggggccaggcacggtgactcaacacctgtaatcctaacactttggaaggctgaggtgggaggattgcttgagcccaggagtacgagaccagccggcaacacactgagacctcatctctacaaaaaaaagtcaagaaattagccaggcatggatgtgtgcacctgtagtcccagctacttgggaggctgaggcaggaggaatgcttgagccttggaggtcaaggctgtagtgagctataatctcaccactgcactcccgcctgggtgacagagcgagacactgtctcaaagaaaaaaaaaaagaaatcttttttttttttgaggcggagtctctctctgtcacccaggctggaatgcagtagcccaatcttggctcactgcaagctctgcctcccgggttcacgccgttctcctgcctcagcctcccgagtagctgggactgcaggtgcccgccaccgcgcccggctaattttttgtatttttagtagagacggggtttcactgtgtcagccaggatggtctcgaactcctgaccttgtgatccgcctgcttcggcctcccaaagtgctgggattacaggcgtgaaccaccacgcccggcaagatttcttgttttaaatctttaccactgatcctaacaagtttctcaacagaattattttgagatcatacttagggaaggatctggggactgggctgaaggaaagtgattcttttctgtatacttcagatagctccgggagagccgtttcttgttgcttataaacaagtgacctttagattttgcacacattgctctggaagacaccacacgcttcactgtactctggcgtaaattatgctctggcaactttatgcatgaagaatgtcggagtggtgatttcacattgacccaaacacattgaaaagatgtttaggttcagatggtgaagactgaggaggtgtaaaatgcgcttttctggtttttcattcctcatggtgtgccctgagcataccatagcctgggcctggccccaggacgtgcctcatgcgagtcaagtcaagagcctctgcttgttcctgctggaatgtgaagaattccatcagtggagcccttacatgatgtgcaaaacggctgcaattgtgctgagccatgctcgtttcaggatgtctaaggaaaaatcgcatttacattaaatgtttagtaggcaaccaagtttagactgtaaaccaaagagtatccaagaatgctgtggcattcaaggctcatgcttttatgtgcattacagcaccttaaggccaataaaggggaactcccatcccctgttgatgtgtattgaaaataattgaatgctcaaactcctagcctaaaaaagaaatattatcgaatgcttcgaaaacataaatttaggaagtgtattttgccaaggttaaggacacacccgtgacacagcctcaggaggtcctgacgacatgtgcccacggtggtcggggcacagcttgcttttatacaatttagagaggatgaggtatcaatatgcgtaagaagtacattggttcagtccggcaaggcgggacaactcaaagtggggcgggggcttccaggtcataagtagatagaggcaaatggttgcatttttttttttttttagtttctgattggtctttccaaaggaggcaatcagatatgcatttatctcagtgagcagaggggggactgaatagaatgggaggcagaggccctaagcagctccgctcccagctggacttttccctgcttactgatattggggttccaagatttactttcttcacaagactctattgagtcctcagaaaacggttttcaaaccatctttctgatttccggttgcgtaattttaatcttattccgtcactgaatcttgtacattagtggttttgcaaactatggcctgaggtctctctgaataaggatcattttaaaggattgtgtttttgcagatgatcttagaagcattcttctttttctttctttttttttttttgagatggagtctcactcgatcgcccaggctgaagtgcaatggcgcgatctcagcagctcactgcaacctccaccgcccgagtccaagcaattctcctgcctcagcctcctgagtaggtggacaggcatgagccaccacacctggctaatttttgtatttttagtaaagaccgggtttcaccatgttggccaggctgttcttgaactcctggcttcaagtgatccacctgcctcagcctcccaaagttctgggattacaagtgtgagccaccatgcctggctattaaaaacattcttaacagtttattctgaaccacagtgagcactccctcattcgtaagggcagccaccctctttcagaagcaagtgtgtattctccacccttcagcccctggagggatttccacggattgtcacagcccctgaaaacaagcttcccagggcaaacagtggttttccagagactccaaaagggaaaacagtcaggacgctccagtcccagctccagcccaagttgtagccacaccaatctctgcaaaaacagaaccatttccagagtgacagcacttagcactctggtttctctaaaacagcgcccgtcatgttcaattcatattaatctcgatggaattgttgccgtggatttttcttgacataagtcacttctacttttactttggattcataattgtcgatgaggtggcaacttaaacaatagatatgtagcttcgtgtttgtccgtccgtgagccacctttcaatcagagccagtcaagccaaacctaggagagactttcccgtggagggattggggcttctgaggaaagctcatggagagaatcgtgatgacagaattgaggatcatcctgccttgatgcccaaggaggtaagcaaggacacaaaagcacgctcatttcaccccagttaggtggtgtctattatcaaaaagacaaaaaatatccactgctggtgaagatgtggagaaaggggaactcttttccactgttgatggggattaaaaataagcacagccaggatggagaagagtatgaaggttcctcaaaaaactacaaatagaactaccacatgatccagccatcaccactgggcatttatccgaaggagaggaaattagtatattgaagggacatctgccccccgtccatgtttttgcagtttattcacaacaggcaagatacagattcaacccaagtgtttgccaaaggatgaatgggtaaagaaaatgccatgtatagatataccatggaatactattcaaccataaaaaagaaggaaatccatcatttgcagcaacatggatggaaatagaggacattatggtaggtgaaataagccagaaacagaaagttaaacaccacatgttctcactcatctgtgggagctaaagaaatttaacctcacagaagtgaaaagtaaggccaggcacagtggctcactcctgtaatccctgcactttgggaggctgaggcaggatgattgcttgagatcaggagtttgagaccagcctgagcaacatagcaaaaccctgtctctgcaaaaaaatacaaaaattagctgggtgtgcggtacttgccggtggtcccagctactcgcaaggctgaggtgggaggatcgcttgaacctgggaggtcgaggctgcggtgagccgagatcacgctgctgcactccagcctgggcagcagaacaagaccctgtctcagtagaagagagtgtactagagactaggaaaggtgggggaaggagaagatagggagagatttgttaaaggatacaaaattacagctagacaagaggaatatgttgtcatgttctatagccctgtaggatgactatagccaacagtaatctatagtttcaaatagctggacggaggatattgtatgttcccaaaagaaagaaatggtacatatttgacatgagggatatgctaattaccctgaccggatcactgaatattgtaggtattgaaccatccctgtgtaccccatgaatatgtacaattattatgtgtcaatttttaaaaagtaaattttttttttttaaaaaaaagtatgttcaacagccagcagccacgagaaggtcatcagctggtttcatccacagcaagagattgctggctccaaatccccaccccatcctcaaggggcaatattgcagaaaggaggagggtgggaaaaaaatctcaagaattggagaatcgccggtttccagggcccagaacaagacccaggaggagatgaagatcacccttgcaggtagaagctgtccctgtctgggtagtgctggggacagtaggtggcccttctgctgtctgtctgagcatgagctcaaggccaagggtaagatgaggggaaatgacccccagctgggctgagcgtactttgtttagggtatttaagcagttctcaaaagtgattgcagaacctgtatctcccatctcagggactctgcccagcctcacccctccctccaccccactgtcatgcccacgcttaggcttcaaaacatcaatggaagatgatagtgcagtgcccaactgcaggcccttacatgaataaactgtacatcacagagggggcggcaagggaggggaaaacagacagatccagctcagatggaatttgatctgaaggaaagtgataaagtgaagaagggatctgtcagccctgcaagcggccccaggcacagcgtgaaggggaggcagggagaggtcatgctggcctcagacttggacgctgaaatgtttagttacagccggaggggggacgcctgcataggtcctagggaaaggaggggacacccaggcattggagacccactgtgtagacgactgcgagacatgcttaaatatttagcagaaaggaagagaaattcgaatagagagattcaggaatgggaggaagggatggaggtgaaatcaaagctgtttaaatacagatgctcttcgatttacaattggtttacatcccaacaaacccatcgtaaactgaaatatcttaagtcaaaaatgcatttagaccaggtgcagtggctcacgtctgtaatcccaacactttgggaggccaagtgttggcagatcacttgagctcaggagttcaagaccagcctggccaacacggtgaaaccctgtctctactaaaaatacaaaagttagccaggcttggtggcgtgcgcctgtaatcccagctactcgggaggccgaagcaggaaaatggcttgaacctgggaggcggaggttgcagtgagctgagatcacaccactgcactccagcctgggtgacagagcaaaactcagtcccaaaaaaagaaaaagaaatagaaatataagcataaacttaaataactggggagcgttatgttggctgactgcaacacagatacgaaaaaccctgacagaataaaaagaattctaaccaaaaaggtattttgggccgggcacggtggctcacacctgtaatcctagcatgttggtaggctgaggcaggcagttcacttgagctcaggagtttgagaccagcctggccaacacggtgaaaccctgtctctgctagaaatacaaaaattagccggaaatcgcttgaacccgggaggtggaggttgcagtgagctgagatcgtgccagtgcattccagcctgggcaacagagtgagactccgtctcaaaaaaaaaaaaaaaaaaaaaggtattttggagttcctgtgtccacataatttcatccttcgatctcaccccctattctccccacctctccatcctaaggtcggtgaatactgcgtcggggaaattgacctaaaaaaatttgttatggtctatatattctctgatgagggtatttttctaaaagcaatgaagtcttcaggcttttaaaaggaagggattggggggcgaggggagggagagcatcaggacaaatagctaatgcatgcggggcttaaaagctaggtgacgggttgataggtgcagcgaaccaccatggcacacgtatacccgtgtaacaaacctgcacatcctgcacacgtatcccagaatttaaagtaaaagcaaaacaaaacaaaactctttttaacaaaaggtatgttgattgattggagattattatattacggtcacattttccaagataatatttgataacactgaacaaggagttgaaaatttgagctgttttgtatactagttatgtgactttggataaatcaataaatatttctgaacatcttaaaaaaaaaaaaaagagggatgctgtccatacggtatctgatatatagctcaccctccgcatctatgggttccatatctgtggattcaaccaaccttggatcgaaaatattggggaaacaaaattgcatctgcactcaacatgcacagacttttttctcttgttattattccctaaacaatacgacatagcaggtatcaacatagcatgtgcattgtaataggtatggtaattaacctagagatgatttaaagtctatgggaggatgtgcattgcttatatgcaaagacagttccatcttgtatcagagacttgagcatccgtggattttggtataaccaggaggtcctggaaccaatcctccatggatatcaggagaaattccatttcattaattcgtactcccggtggtctttgaaatgagtcgtgcaacatcactgtcacctgctgtccatttagtgagttactctgggttttttatttaggggagctgaaacacagatttttaaaaaaagtttattttcataaatcgcaataatgtcataaaagctgagtgtgcgtctggggctctttagtccagtagctactttggtatatataatgatggcaaggttgacgtgttttggttttgttgttgttgttgtttttgagacagggtctcgctctgttgcccaggctggagtgcagtggcacaatctcggctcactgcagccttgacctcctggactcaagtgatcctcccacctcctcccaggtagctgggactacaggaggtgccaccacacctggctgatattttgtattttttgtagagatgggtttcaccatgtttcccaggctactcttgaattcctgggctctagcgatctgctcatcttggcctcccaaagtgttgaaattacaggcgtgggccaccgtgcctgccccagatctgtgttttttaaagtaaagctgaatattaattttttccacatacattaatgtattaaggaaaaagttgcaattagtatcttctccagcgttttgtcttctagtatttggggtagggaaatgtagttaattaaaagattacagatgtccttcagtttttttttttttaagctatcaagtttttttactctttttgtagtgcatcttattttattcataatacacctttttgttgaagtatgtcttacttttttatttatttatttatttttttgagacagagacttgctctgtcgtccaggctagagtgcactggtgcgatctcggctcactgaagcctccgcctcctgggttcaagcgattctcctgcctcagcctcccaactagctgggactacaggcatccgccactacacctggctaattttttgtatttatagtagagccgggttttcagcatgttggccaggctggtctcgaactcctgacctcaggtgatccacctgcctgagcctcccaaagtgctggcattacaggcatgagccaccacgcccggcctctactaacattagtagaaccgttgactgtgtcccatatatctatgacacagttatctgcattttctgtcaatctttctccccatacttcagtctactgacctattttctagttaactgatctctttggctatgtctaatctgttgttaaacccacattctagcttcagttattatgtttttagttcaaattaacatcagatttttagttcaaataacatcaatgtagtttcaatactaccttgaaaatttttatctttttccccatcttatttaaagtatttctcacatttaattatagtccatgtctgataaattacatatctgggtttcaggtgggtttggttttgttgtttaattttgcttgctcttgattttcactcatttggtcttttcttgttgtatgatagttaattttttaattgacagccagacatggtaaatgaaaaagaattgcaaagacaatttgtagctctgaatcatattatcataacccaaagaggatttttttttttaattcatgtgatttgatgtgatttgtccataccctgaggtagtttgcccagaccctatctggggctgagctggagggaaattgggcttcagtgtttgtgatgaccagtctatttctggttctcctctcagtgaggtcacaaaagaaagcttgtggtgtgtaccagggtccctcattggtcctgattattaatatttatggacccctcagcctcctagcactgctggcaactctactcagtttctcagcttcccagcctcttatttgccctgagtggaagtaaggtaccaaatgtgacatttacctcttctgtttgtctctggtatcttcactcttaattttgtgctgccttagtagctctctgatgcacttaaaaaaaaaaaaaattctaggccaggtgtggtggctcacacgtgtaatgccagcactttgtgaggccaaggcaggcagatcacctgaggtcaggagtttgagaccagcctggccaacatggtgagacccccatctctactaaaaatacaaaaactagctaggcatggtggcacgtgcctgtaatcccagctactcgggaggctgagacaggagaatcacttgaacctgggagggagatgttgcagtgagccgagatggtgccactgcactccagcctgggcaacagaacgagactccgtctcaaataaataaataaataaataaataaataaataaataaataaataaaattctatatacattatttgtgcagcctttttaggtatttttggcagaagacttagtgtgaaacaacagcttcaccatttgctgaaagtggaaaaaatctcatttcagttcctgagctgatacatatatatttgtatttttagcattcaccacctccagcagtaataactttcacaaatttatagcccataatgcaaaggagtgcttccttttttgctgtaaatgttatctccttggattgtgtactggaacattctgtgtctgctgtctatctgttccctgcctcgtctgcctttacgatgtcctctctcagctttcatcttcccacacagagcattttgttttaagcatctctgcatatctcagcctctttccaatgacctgagaattcttctctggcctgcctccagtttcagagtcccttctttcaaggtgaccccatcttcagtcaggcttttaggggatacatcagtagaatagttattacctaaggataaaaagaaatgcagtttgtaaaagtcacattttatattcatgcattcacaagcttgccaaaaatgttcttaagagcggactttgagattgctgcattctcatcttaaaatttctctctgcatgatatgcaagggggaagtgtctactttttactagtaaaaataatggccatatttattcataaaagttggtttatgtttcggctgttaatattacttgttaagtaagcctctgggtcttgattagaaacattagcaagggctgactgaacttctcttcctcgtttaaattcgtaagattaacacatctgcagaaggcaagctgagaacttgcatcattatttcatcctctgtaatcaaacatataaccccgagttaaatcccttccgaggaaggattatacttcatgatcggccccgtggaacttatttatgtgtttatcgttgggagaaattagatgacagaaacagattgacattttccctaatccatttccaggaatggttttttgagcacttattctttgcctgtctggctgcttcatttatccatcacaataagtgtctgtgtgacatctcactgaaagccccatgactcagagagtcatttctgcaggtccttttccttgatgggtcagtattcaaatccaggacatccctctaccagccctggttgaagaaggaaattattcatttttatgggattcatatggtttatgataatgcagttattgcattcgtcattttttcccaagactcattttggtgttttgcaaggcgcatacccaaatcccgctctctcacttgctagttctcgtatgttgggcagtatctctgtctgcagattaaactttgcagcagtaagagggaaggctcaacctgtctgcctcatagggctgtcgcgattaaaaggaatcagggctgagaagtttatgagtgtcactcagcagccagccatgagcagccactaaaaaaggagtcctgttatcatggttgtctgatatctttgacaacttataattttgtgttacaccataattcttagaacttaattttatatttggattttacatacatagctgagatctgaaagaagaagcccatattttatttaatgttaatttttaaaaatttctctccagctgtattgaggtaccactgacaaataaaaattggtgtgtatttaaggagtacaatttgatgctttgctgtatgtatacattgtgaaacaatcattgtatcaaggtaattaacattttcatcacctcgcataaatgctgttttctcctcctcctcctcctcttcctcctctttctcctcctcctcctcctgctgctgttcttggtaatgagaacacataagatctactctcatagcaaattttaagtacacaatcctatattgttaactgtggtcaccatgctgtatgttagatccccagaacttatttatcttgtgtaactaaaacttcatattcattccttcaccaacatgtcttcattctaagcaccccgcccccagcccctggcaactactgttccactctattcttctgtgagttatttaaagtgcactttcggaggctgggcatggtgactcacctgtaattccagtactttgggaggctgaggcaggcagatcacttgaggtcaggagttcaagaccagcctggccaagatggtgaaaccccatctctacgaaaaaatacacaaaaaaaattagctgggtttggtgatgcatgcctgtaatcccagctactcaagaggctgagataggagaatcacttgaacccaggaggcagaaggttcagtgagccaagatcatgccactgcactccagcctgggtgactctgtctcaaaaataaaataaaataaataaataaataaaatcaattgcactttcgtgattatgagttagaatagtcaaattaaaaaaaaggttcatgattacagtgttctcttttacatcttaaagtttcagtaaatctcactaataatgacttttgggggtgttcagtttttatagataccttttttctatttctttctgtgctcctgttcctctgccttagggcattgcacatgctgatctgctttcacgtgcatttttcagcatgttcttcttcttacttcatttccagtcgttctacatcattggcttctactcagccttcaggcttcattttagatattacttccctaggagtgtctccccctttagaccaggtgaggtctcttgataacattttctttcctagaattgataaccattttctttcctagaattgataaccattttctttcctagaatttctcatggcttgccattttgtatttgttatttgttgattttctgtcttctttgacagtaagcttcatgaaggtgcagatcatatctgtgtaggccactgtttaatcttcactacctacctctccataaacacctgtgaaatgcatacattcatgcctcgattaggagaatgaactggacattctcctaaaagggaatgctaggatcagaaatttgggagctgagtatccgagtgactgatctccaccccagctgacatcactcaaaatctctgggatcatggcctgcgggtctgcatttgaaggattacaattctctgaagttggcctggtgcaggcaagaggggctcatgttgaggctcaaccccatccacccccaagaattccacagtgtgttttcagtgaggatgtcagtgttctcttatctctgttgctcacactcattaagctaactgctttgtgacctgacctgatgggggccccagtgtttggacacaggtttgcttcttgaccctgtatttgtcaaggtaggctagctgctataacaaacagcccccaaataagtaaaagtttatttctcatttgtatcacagccagctggggtggccaaggtatcctctaccccatgcagcctttcagggatccaggatgctcctattgttgtgcaccaccttctagggcagctcttctcaagtgagactccttgggaggattaggcgctgttgctgacggcagccactgtacgtaatgcattaagtaatctcctccccatctagcatggtgttagatatggaccatccttgggagagttgagaaaagagtcacctgatttgttctctgtttggttttattttcttatggaggcccagttcagagagggtggagggatcttgtttttcacctggctggtggtagaagagaggataggaatatcttattcctctcgttgcccagcccagaggtgactcacatcacctcctcacattcactcacatcacctcctcacattcactcaatctgcttgtgggaatcacttccatggtcctgtccaggtgcaaggaggtcacaaaatgcacttagacattagcccgagaagaagaagaaacaaacacaggtattggtgagcatatcaccttgccccagtcctatcccatatcaagttgtatttgcaccatagaggcagaaaaaaatggagtgggtattttcaattaagttgcatttatttgcacgaaggtttgacttaacttgcctttgctctttctttataacagatgatagcttgtcctgaaactgagactcctgccgtgataacgtgtgacccactgtcccagccttcccctcagcctgcagacttcacagagactgaaaccatcttggtattcctcatctatatgacctacacatggccagctctcttattgcttgttattttctcacagggtctatccccattacataccagtgggggcgccataggcttttaaaaattcctcccttttttttttttttttttttttttttttgagtggtttctcccacctggaataagttgtgttataattagtctatttctctattatccaggtggataaggaatctggctgtctgttcgaacttattgtggggttttctttttcgtcattttgttattctcttccactttgcttaaaaaaattaataagaaaaagatacagcgtctatatagcatctatgtctccattaatttttttaaacttttgataggacttgcaccatgtctaaaatcaatattccatgactatggattttattttaattctttttttctctaagtttacccttatgaatctgggcttttattgccacatatcatcagaaaactggctttatggacacccccctgtttttaaactctcaaagagactatcttagtaaaatgcttctgtaggcatttggtataaacaagtcaaatctctctctgaaaatttaacttccatgaattgcataagaacttgtagcatctcctcttgtctgagacttggtggatggctcagaaaaagtgaggggagagaagctgagctatttttagcattcccagaaaagaagatcgagtacagtccatcagtttttttaaaaaagttaattatagtgccggccgcggtggctcacgcctgtaatcccagcactttgggaggccgaggcgggcggatcatgaggtcaggagatcgagaccatcctggctaacacggtgaaacccccgtctctactaaaaatacaaaaaattagctgggcgtggtggtgggcgcctgtagtcccagctactccggaggctgaggcaggagaatggcgtgaacccgggaggtggagcttgcagtgagccgagatcacgtcactgcactccagcctgggcgacagagtgagactccgtctcaaaaaaaaagttataataaagatgaggtcttgctattttgccgaggctggtctcgaactcctgggctcaggcaatcctcctgccttggcctcctaaaatgctgggattacaggcatgagccaccgcgcctggcctcaacccaataatttgattttattttaccccaggataaagagttctccatcatttaggttagggctacagttccctgcagcccaccgcagactaatgatggaatggttatgttttagcagccagcaaataaagtcgaaagtgtctcatccgaggaaaccttcgaaccaagccaggaactccctgctgaggctctcagggaccccagtctgcaggatgcactggaggtggtatccaaattcttccccttgcccaaggctcccggtgggggccatccaccgtcactgaggtcaactgcatgcacacaacagctgttaatttttcagcctcatttaacaaaaaataagaatcggcttccctcttcccctgcctctgattcttctgtcttctctctggcatttgcctggggtgatcggccgactctcttttgccatcttcaagtctgatcatcacgctttttctctctttaaaagctgttctgcagaagggatcaggagggaagttgagggactgtggaaattaatgcgtagcaatccattttctgaaatgaagagattaaaagctgaaaattggagggagtggggcatgctaatgttcgaatccaaatggggcatgcaaataatttcttctttcaggatgaaatgagagatgcatgctttctgttccttcctcttagagatgttttcatcttcaactacgttctctccattgatgcatttaatgaaagcaattgctaacgttttctcttgctctttaagcatgatctaataatgccatttggtctttaagtaacaatcaatacagctctagagctaggtttaggtctagactgaaagttggtattgaacgcatgtttagagtgtgacctactgtgttggctaaatgccttccctggacagtcacccttggagaaaatgtgaacttgtttttctcattcttacttggttactgttcaaatgcagcattttgaacttaatttctagagctgttggttgaggtccaggtttcttataaacatgtgaatgtatcccttcagcatgttccatccttgtggtcatcatttgaggctctgtgaattgaatctgtagttattagtgagtgacagggcatcagtgtgaggttgggtaagacctacgttggacagctcagccatgtggtaggtttgggatcctggatgagttcattactttttctttttaaaaattattattattattattattatttagggacagggtcttgctgtgtagcccaggctggagtgcagtggcatgatcatagctaagcagtcttcctgcctcagccttccaaggaaatggaactacaggcatgggccactgcaaccagctaattttttatttttattttttgtggagttggggtttcactatgctgtccaggctggtctcgaacacctggcctcaagtgatcctccttttttggcctctcgaaatgctgggattacaggcatgagccaccgcgcccagcctgagttcattactttgcttcagtgttcatgaggtggagactgggttgcccacctcacagaattggaaggaggggtattaaaaaggagagtggtatagggaaagccctagttagtgcttggctcataaagatgaggaagatttcggtcattgatttgctaaaccggggcactttgacctcctgtgtgtccacactgtcctctaggggaactttatttagtatcttgtataataccctaattcataacattggagcagcttgttgttttcttggatactcatctcttgttagcagaaatgtcacaatcactgtgctgttttgtcttgaaaactagtataaggttgggtgctgtaggtcctgttaattccagaaacatttcattctcaggaactgaatggatctaaatgcaagtgctcttagaggggagaaatgctgcagtatcctgaagtggactttttaatttatttgttaactcttgctatcaccttaatcaataggatggctgtctttaaataaaatataatatatgggaatgagtgtagaaggcagaatcttatatgtaaaaaccttctaaaaacactgcggcaagtaattagagaagaaagtagtatatgcctatggtgtaaaaactcaaatttatctttctatatatctatctctatacatatcatgtatctatctatctacctcttatctattttctttttttttttttttttgatggagtctcactctgtcacccagtctggagtgcagtggcgtgatctcggctcactgcaacctccgcctcccgggttcaagtgattctcctgactcagcctcccgggtagctgggactacagtcacccacgaccaagcccggctaatttttgtatttttagtagagatggggtttcaccatgttggccgggctggtctcgaactcccgacctcaagtgatccacctgcctcggcctcccaaagtgggattacaggcataaaccaccacacccggctatctatctattttctatcatctatctcatctatatatccattcatcctcacatctagataatagatacatagatatagaagagataaaacataggtagtagatagagatgatagataaatgaatgatagagtgatagatgatagataggtagataggtagagagatattttagataaatagataaatgatagagtatagaacggatggatggatggatggataaatggatagatagattgatagaaagtagataggtaggtagagatcatagatagataaataggtagatagatgatggagtgatagatgacagatgatttattgataaatagaatggatggacagatggatggatggatggatggatgagtggatagatagaacataggtagatagatgagatagatgatagataatagatggttggtagatgagatagatgataaatagatgatagatagatagatagaaagatgtgtgtgtgtctattattgttaccatctttaaatttttaagagtctttttctagttcttggtaagaagtgtttaaagcaaatgtatttgttctttttgttgactcatctgaatgccaaacaaaatgtgtgtgtgtgtgtgtgtgtgtgtgttgttacacacttgcattttcatctgttttttcacatgacccttaagaaggcaggaactctgccattgaaaaaactatctgaattattatttaaattcctttgccaagcagtccaaattcttataggctttacttacaggaggtgagttgttttttcatttaacgtagtttggttattcactgtcatacaaaacagaagttttggtgggtgagagtattaaattagtgtgtgtgtgtgtgtgtgtgtgtgcacatgcgcatgtgtgcatgtgtgtgtttaaaatggtttagtggctagaaatgaaaacaattcttcagaaaaagagaacatatacaattacattttataaaatttcaaaacacttaagcaaaaaaaattatcttctaagcatattatactaaatctagtgtatatttagctcaaaagaaaagtgctgctgggtgtggaggctcacacctgcaatcccagctcactgggaggccaaggcaagaggattgcttgagcccgggaattcaagaccacactgggcaacataatgagaccccatctgtgcaaaaaatacaaaaatcagctgggcatggtgatgtgccctgtagtcccagctactgaggaggcagatgtgggaggatctcttgagcccaggaggtcaaggctgcagtgagctgtgactgcaccactgcactccagcctggacgacagagaccctgtctcattaaaaacaaagtgctagtgattcgcaatctctttttgagaactgagatgcatctttctgcgggaccctacactggatgggttttagcagtctttccctcgataatggacagctgcaaaaaccatctcccactgactgtcttccctaggtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatggttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgaggctcgtaggatatttcaggtgagtcagggttggatggtcatcggctttcagaaggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgttaaaaaacagccatgtggcctccttccagtgtgtgtttgcctatttcctgcgatatcaggcttatattttatattaaaccaagggtagggcctttctattttattttcggccttttctattgtattttgtttttaaaatagtaagcatcgggctgggcgtggtggctcactcctgtaatgccagcactttgggaggctgaaacaggtggatcacgtgaggccaggagttcaagaccagcctgggcaacatggtgaggccccgtctctaccaaaaacacaaaaatattagccgggcatggtggcacacgtctgcaatcccagctactggggaggctgaggcacaagagttgcttgagctggggaggcagaggttgcagagagctgagatcacaccaccatactccagccagggcgacagagtgaggatctgtctcaaaaaaataaataaataaaatataataataataataataagcattatttgagctggaattgcaaggtaaaattttaacagtaaacaataaacatactttattttatttttgatttaaaatgttttttaactgtcatgtaataattgtacatatttatggggcatgtagtaaagttgcagtacacgtcatgtctactgatcaggtcacgggaattagcatatccatcatctccaacctgtaccattttttgtgttgggaacattcagtattctccttctatatatatatttgaaactatataatatatgattttgagctgtagtcatcctatagtgctatataccagtgatccccaacctttttggcaccagggaccagtttcatggaagacaatttttccagaaaccaggctggggggatggttttgggatgattcaggtgcatgacacttattgtgcactttatttctgttatgattacattgtaacatgcaatgaaataattatacaactcagcatcatgtagaatcagtgggagccctgagcttgttttcctgcaactggacagtcccatccaggggtgacaggagacagatcatcaggcattcgattctcataaggagcacgcaacctagatcccctcacatgcacagttcacggtaaggtttgcactgctatgggaatcttacgcggccgccgatctgcaggaggcagagctcgggtggtaatgggagcgatggcgagcggctatcaatacagatgaagctttgctcactcgccgctactcacctcctgctgtgcggcccagttcctaataggccatggaccagcactggtctgcagcccaggggttggggacccctgctatagaacactagaactaccttaaaaaaaaaaaacccaaaactggatctcatagaagtaagaactagaacagaggataccagaggtcaggaagggtagggagaaggggtgatggggagagatttgttaaagggtacaaaattacagctagataggaggagtcagttccaacaataaatttaaattatcagatggatttttcagaattgctggtcacagtgaaatgcatagaactgtttacttctaactttttgcgatcttgcaggatctctttaggaaaggtacccattttctgaactttgctttgtcagtttcattcattcattcgtcatatgcttattgagtgctctctttatacccagctgtgtgacatgggacaaatcaatacaccataagtttgggaatatacacttttttccacgagaaatcctcattgtcagaagtatcttcattcaatgggcacaatatgctgtgtatctcactgggtggctgtcaggggccaccgagagtgtcgttaaaaatgggcatgttgattgacgtctcatgtctccctagaatatataaaaccaaactgtgctttggccaccttgggcacatgtcgccaggacctcccgaggccgtgtcgcaggtgtgtgtcctcaaccttggcaaaagaaactttctaaactaactgagacctgtctcagattttcagggttcacaggtacagtgctgagtacgtgggtgggggtacctcactaccatagaaaataccctagtgacaaaccggcacgtgtaccccttagacctaacataaaagttgaaattatttaaaaataaataaataaatattatgagattattatcttgtggcaagtggaaatgatgtgggaaggaaaggatttctagatctgtcgaattggcagggtggattgatgcctacagatccacaggaataagttatagtatttttgttcctcaaagccacttggtcgaatcctgccaaaacctttggctgatgcttggaagcacgaaacaggtcctagtgttaacgcgttttggggtggaactgtagtttgaagcagaaaggggtttctttctgaccaccacccttgaattaggaaaagcagagcaattctttctggtttcataggcctctgctctttagtgtacagtaccattttaaaaattatttatttatgtatctttggccgattacagtgactcacacctgtacctggtactttgggaggccaaggcgggcagatcgcctgaggtcaggagttcaagaccagcctggccaacatggtgaaaccccgtctctaccaagaatacaaaaatttgtcaggcatggttgtgcatgcctgtaatcccagctactcaggaggctgaggcaggagaatcacttgaacccaggaggtggaggttgcagtgagctgagatcacaccactgcactccagcctagacaacagagtgagactctgtctcaaaaaaaaaaaaaaaaagaaagaaaaataaaataattaaatcatctattttaattattttattattttttatttttatttttttgacacggagtctcactcttgtccaagctggagtgcagtggcccgatcaccgcttcctgcagcctccaactccagggctcaggtgatcctcccacctcagcctctcaagtaactgggattacaggcatgtgccaccacacccagctaatttttttaaactttgtagaggcagggtctcataggagtctcactatgtggcccaggctggtctccaactcctggcctcaagcattcctcctgctttggcctcccaaagtactgaggattacaggcatgaaccactgtgcctggcccccattttttttaatagatcaaatgagttgcataggtttacaaacttgatgtcttctatccctgctctatccatcatcctaagaaacaaaatgaagtttttattggcacagacaatatctgttggaagcacattcgtgcaaatccagctatacctagtatgtgacatgtactgtgcaagaatatactttacacgggattgtagcatgccttgaggatgcttgtctggattccattgcatagttgctaaatgctgatgctctgtgagtctgtcattattgcagcattcatggcccaacactcagctgcacaaaagagcttttctgtttctctttccctcc

SEQ ID NO: 123 - DNA, 145827 bp, Homo sapiens
atcaagaaccatgcaacagcaagaaatgggttttgtggctctgtcatgatgccatctaggaggctatgtccccaccaggatgctggggccacgtgacacagtgctacacctattcttactctgggcagctgcctctcttctgtgttcttggtaaaatgagccacaagtttacccagacctgctagtgggtccatatgatctctccagttggcagcttatttgggatgaggcagagtgccttgatttacacataaggaaatgaggcttaggtaagctctgtaacttgcccaggtcacaagcctcctaagcgacagaggcaggattcaaactcagaccgtctcattccagagcctgtgatttggccaccactccacactgcctcccagaagccctgctctctggaaattttctctttttttctttctttttttttttttgagaaggagtttcactcttgttgcccaggctggagtgcaatggcgcgatcttggctcactgcaacctccgcctcccaggttcaagcaattctgcagcctcagcctcccgagtagctgggattacaggcgccggccatcacgcccggctaattttgtatttttagtagagacggggtttctccatgttgaggctggtcttgaactcctgacctcaggtgatcctcctgccttcgcctcccaaagtgctgggattacaggcttgagccaccgcgcccggcatgctctctggaaattttcttccacctcccagggcaacaccttaacctctgtgccgcactttcctcatctgcaagatggggggggaaagttccacctagaaaagctgatgtgactaagcattcagtgtgtgtgaggtctgcatctggcctggacacccacctggctgctgctggcctccgcaggctcttctggtctgttgctcagggaagcttccagcacactgcccacagcctgaaacaggtccctggtggctgcctggcgcctctggtcctcagggcgggccttggcactcactgtcaacagggcctcactggcatgctgtagagccaagctggcctcccactgggttcacccaaataaggaaaagcgatgtgagcctctgcttaagatagaccattcctgtgtcattcaagggacaagggaagcaaggaggggaacaagccaggaaagagctgggctagacctggcacacgagctccctgtatctccggcttgagaccagggcctcccaccttacagtcctctgagatcctctaggagagtagcctggtctgcctctgaatccttcccagaacgccctgcacagtgcccagcacatagcaggtcttcaagaacattcaatgactaggggacggatggatggatggatggatggatggatggatggatggatggataaatgaagggtggataggcagtttgataaatggatgtatggatgataggtggatgggtggaaaatggatggatggaggatgaatgaatgaatgggtggatggaggatgaatgggtgatgaatggatggatggatgggtgggtggatggatggtagatggatggatgggtggatggtgggtggatggatgaatggtgggggggtggatggatggagaatgaaggatggataagtgggtggatagatggatggatgacaggtggatggatgaatgggtggaagatgaatggatggaggatggatgaatgatggatgaatagatgggtggatggtagatgaatgaataggtggatggttgcgtgggtgggtgggcggatggattcagtacatattcaaattttgtagttttctatgtatttttgaaattatttgtctaatgtctggctgtctcagtaatctgaaaggaccgtaatggcagatgccatgtctacatgatttgctgctgaattctcaatgcgttgcacattacctggcacatacttgacattcaggaagcatttgttaaatgaatgatgaaattaatgcatgcatgaatggatagaaggatagagtggaggatgtgtacaggtccatgtatatacagtgtatatgcatgtaaatagatggattagcaaatggatgtgtaaatgggaagtgtcatatcaagaattagccccagaatcaagaccagccttgctggcttcaggctggaagattttaggagcacaacctcctaccagagtgcgtggggcaaagccaggacagttctcttctcttctgtttttttgtttgtttttgagatagattcttactgttgcccaggctggagtgcagtagcgcaagcatggcttactgtaacctcgaactcctgggctcaagtatcccttatgcctcagcctcctgagtagctgggactacaggtataagccagtatttaggtgttgttttttttttttttttttttgtaaagatgtggtttccctatgtttcacagactgggcttgaactctacggatcaagtgatcctactgcctcaggctcctgaagtgctgggattacaggcatgagccactgtgctggcccgctttccctgtttttagggcttctttttattgttattttttttcatagggtttgctctgtctgccatgctggagtgtagtggcacaatcatggctcactgcatcctcgaccttccgggctcaattgatcctcccacctcaacctcccaagtagctaggactacaggtgtgtaccatgatgcccaaccaattttgttttgctttgtttttgtttgtttgtttgtttttttgagatggagtctctatcacccaggctggagtgcagtggcacgatctcggctcactgcaacccccacctcctgggttgaagcaattctcctgcctcagcctcccgagtagctgggactacaggcgcacaccaccacgcccagctaatatttgtatttttagtagaaatggggtttcactatgttggccaggctggtctcaaactcctgacctcaggcagtccacctgcctcggcctcccaaagtgctgggattacaggcgtgagccaccgtgcccggcctttgttttgtttttgaagggatgaggtctcactatgttgcccaggctggtctcaaactcctggcctcaagcgatcctcctgcctctgcctcccaaaatgctgggattacagacgtcagccaccgtgcctcacctatggcttcttttttaacccttggctgtcagaaccctgggaacacggtgttttaatttgagttctccaagaagcagatcccagagcaagaatttgagagcaagtcatttatttggacatgatcccaagaaacacttgtggggagtagggggtgtgagacagggaagggtggaagccagtacaggagtgtgatcaagcccattacctgggattcactcctgcttgggattatccatcaagaggggtgaggtagctggggtgtttataagccagcttcattagtcactgaacactgcatgaattcacagccatatgggcaggtacagtaggctctgagggtcagagaagacccccagaaggataaggaagcacaggagctggcagccagatgtcaggctggcatgtactgaagttgagaacatgggcagtcagtagcagtgtctggactcacatttggccacccaaatattaatgagattcagttactccctcaacttgctcaccagcagatgcaggagtgagagtctgggcaaacaggccctctcacctagcgtgagatacatgggcagcaggaggggcaccttcccatgaatcgcccatgcaggacccctggaaagaagatgacagaggtcttggcagccccaaaatagccctgtgaccaagggaccccttcaacctatgctgatcacccacctgctgtgaaggagcgtgtcccatgttagcctctgtagatgggagctactcacctgggccgagggtgtgagttccttactccggcaggtcacctctctcagcacctcggccagctcctgcaccctctgcacgtcctccaagccggtggtgactgcagacagtgatcccagcacatgctctctgaccttggcacgggggagaaaggcagggagaggaaatgtaattctgtggctccatgaagtagtgtcaggaagatgcagggtcaggagtgaccagggttattagggggttctttttcttttctttcttttttttttttttttttgagtcagagtctcgctctgtcacccaggctggagtacactggcatgatctcgactcattgcaacctccgcctcctgggttcgggcctcagcctcctgagtagctgggattacaggtgcgcaccaccatcaccagctaattttttgtatttttagtagagacagggttttgccatgttggccaggctggtcttgaacttctgacctcaagtgatccacctgcctcagccttccaaagtgcaggtattacaggcgtgagccaccgcacctggcctcactggtggtttctaaagccctgcagacctctgtctgccttgtatgatgtgtgattaggcagataacagccccctcaagatgcccacattcacatccctgaaacctgtgaatatgttactgaatgtggcaaaaggcactttgactaagtcattttggagaagcaattaagttaaaaattctgagatggagagattatccgaacaggtgggaccaacgtcatcatacgacccttctaagagggaggtaggaacgttaatcagaacaggagatgggtgatggaggcaggggtagggggaagaaaaagagagggaaagaggatgaggtaagggtggggagagacagagggagaggagaggactttggagatgctgcgtggctggctttgaagataggagtcaaggagtgcaggcggcctctagaacccggaaaaggcaaggaatggcttctctcctggagcctccaggtttgcagctctgccatcaccttacttttggcctagtggaccccattttaaacttctggcctccagaactataaagtgaataaatgcgtgttgcgttaagccatgatctttgtggtcatttgtaacagcagccctagcaaacatatataggatgtctcaagctttctccaaatcttcaaattgaatctgtagaatttggcactatttgaaaataaattgtgtctcagcgtggcacctgtgaccagaatggcatgaaattcagaaactggatgactgttggtctggcatggatgggaggtctcaccggaggcttggggtccctgtgtgcctttgcagcagtggggacaagaacccccctacccagccctccactcctgtcttgggccaggccacgggcttcagggtcaagtgctttctacactacaaagcactaatgaggggctggtgaggggctttggtaggagcagagaaaaactaagaacatcatttcagcactgcccagtagaactgtcatttgtaactttatttaattttaataatgacttagatttaagcagcagccacttttgatggggcagagacaccgtggcctgttgctcacacctggctcagcctgacaggctttcccgaagcttccaagtatgagtgcatctgccatccattccagggacagccaggcctccatcccggctgtgtcttgggttgaggaaagaataggtcagtgtggcaggagactctttgcagaatattccagaagggaaactcagataatgggtaatctcacatttgcttctgcaggccctgaccccatcgtttgtcacctaccctgggtaaagatgtcaccggctctggaccctccggcaaatggactcacccagcaggagcccagcaggggacgagatggcaggaggagagagagctgggaggggtcattctcctgatgccctcggccaggtcaccgggggctggccgcctcattcttcaaaagccacagctcctaccagagagtccctctgtgggcagccgccccctggatcctgctcacggcaggccgggcctctggggtcctccacgctgtctagtttgttccctaagccctgcacacacctgtctcaacagagcccttgttaacatcttctcagcttcccagtgagagtttgacatctgtcttgtgccaggccccgggcatttcatggggagaccttgggttaggctgtgtggtctgtgtgcttggggaccacaggatgtccaggggaagcttcccattggtacttctcagagtgaatgtgaccaagaatgagagctgtgtgtgtgtgaaagtgtgtgagtgtgtatgtatgtgtatgtgtgaaagcataattgtgtgtgggagtatgtgtgtgtgtgacagcgtgtcagtgtatgtgtgtgagcatgtgtgtgagtttgtgtgtgcatgtgtatgtgtgtatatgagtgtgtgtgtgtgagcatctgtcagtgtgtgtatgtgtgtgagtatgagtcatatgagtgagtgtgtgagcatgtatgtatatgcgtataagtgtgtgagtatgtgtgtgggagtatgtgaatgtgtttgtgagtgtgtgtgtgtgaacatgtttgagtgtgtgtgtgtgcataagagtgtgtgtgaaagtgtgtatgtatgatgtgtgagagctaatgtgtatgtatgtggcagggggtctggggtaagagggctggaggtggagggggaacctctaaactgggtttgaacccaggcttcaccacttaccagacacagggacacaggcaggcacctctgattctcttaccctctgtttcctcagctgtaacatagatggaggcctcaccatttacgtcccagggttgtagtggggattacagatccatgaagccctaattcagggcctggcagctcatagcaggtgcttgatacatgttagtttctctcggtaagcgaccacaatgacaatccggcttcctgtattaagtacctaccaggcctctagcaccacactcagtaccttcctgcaaacctttcagggagccaagagaagtctttcttctcttctccgtgcccacaggggtgtgtgtgtgggtgtgtgcatgcacacacacgaacacaaactcatgtggcacatgctgggagtggacacaatcatacgttctgcaatagtttatcatactaggttgtaacaatggaacggccatttttgtagattaaaactgattgaatgttgacggtcttatctagttttttagttgcagtgatcgtaattcttatttaactcttactacaattgtatgaggagactagtattcttctatatggggaaactgagacttagagaggtttggtccctggcctgtgacaatgcgaatggtaagtgacaaagccgggacgccatctgtggtccaactccaaaccgctacccatgtgaccgaggacagtcccctttctgctctggggctctgccttgtcatctgaaacatgaaaagcaggggatgatgtgttctaaactccccccatcccagaggcctgtgcctccatgagggccagccgagaaagcaggttaccaaggaagaaggcattttcttcactttatgtcactcacccaaaagaccagagagggaggtggtgtcagccgcttgggagacaccacaggtttctcccctgatccatgaaccttgatccacagcccaaatggccgcacgcagaccctggggccccagaggaagggaatgaaaggagccccccagcttcccacgggtaccttctgtctgacgtctatgctcagtgactgtcctgagccctggctttcatgctcttggttcagcatggaggacacagccttggccagctggaggagctgctcggggccaccctcgccttgcagagctgtggggattttctctgacacggcagcctggaatgctacatcctcaacacatgtgtctccgagtgccacctgttaggaaatcagaaatatgctcagaacctgctaggaagaagctggcctctgaagtcaggggtcttcatgtggggtcagagaggcttggatgcctttggcctggcctgtgggctctcgagcacttcctgaggctggagggcacccagacctgctcgcaccaggcagctgacagccacccaaaccaagccttggttggctccagcctggcgcaagtcattgctctaccactggccgccctcctctcttggtctcaacctcttccacccccacctggcctctgacgcttgaaatcttcttggaatcttatccaggctcttccttgagtccttgttggctaatcttggtcctacttcttctgagctctctgaaggtgctggcctaactcatgccagagtcattctccaacccccctcacccacccaccagctcccaggaccctccccctattctggccactaaatcataacatctacaaaggtagagaccatgtctgttgtgtccctggctatacccccaggacgtggcccagggtagatgctctgtaaatatttgtggaaggaatggatgaatcactgacttatctggctatgcccctggctatcttccatccggccatccttttagtgaggttcatatgggtggagaatttttctcagtaaagaaacagtgaccactgccaccacctaccttagccatggcctgggtctgctgcgtgtcccctgcacgattggtggcagaaataactactgtcagcacaaagtcattgttctcctctccaagtggcagatacactgatgggagggcaggttcagggccacagtgtaggcaggaacctggcaaaaccagaaattgaccgatgagggggcatcgctaagccccaggtagactgcaacccactcaggtagaggctggtgacagggacacaaaagccacagctcttgaaggcatggtaggctctcgggattccacactttcaagtatgagacagtcacgtatgctgattcactgtcttctctaagcaactgcaggttgctgtaactttggaaaaattttactaaaatccataaaaaattgcaggaaaaacatcccatttacagttttttttttaaaaaaagtcaaggtggtaaaccaaattataagaggaagaaaaagaaggaggaggaggaggaggagcaacaatgacaacttaaaacttagctcaggggcgaggagttcaagaccagcctgggcaaattaggaagacgttgtttctacaaaaaaaagtaaaaattaggtctcgaactcctgacctcaggtgatccacccaccttagcctcccaaagttcctgggatgactgacatgagccaccacgcccagcctgggactcgtttttatgtagccacactttcctgcctccgtgctcacttggatgatgggggagaggtactaaagaggaatagcctattggaattagggcagctgtcctggcctttccctctggcgggacgcagtttgaaataacatccacttaccttgcttgaactttttcctttcagactcagccccattcacagccctcttaacggtgatgcatttccacatctattagacagggcgctcgtgaaaactacactctcttaggtattacaatagctgacgtgcactttccctaatcaaggtgtagtgtttatgccgttgtgatgtttgatgctggatttgggggaccatcctggcaacactactggtggctgactttggtggaaatttacaatctgattagagcattttcagagcacagaatgacaaagctctcccgggcgtgtggcttacatctgtaatcccagcactttgggaggccgaggcaggcagatcacctgaggtcaggagtttgagactagccgggctaacatagtgaaaccccatctctactaaaaatacaaaaattagccgggtgtggtggcgggcacctgtaatctcagctactcgggaagctgaggcaagagaatcgcttgaacccgggaggctgaggttgcagtgggccgagatcgtgccaccacactccagccttggcaacaaggcaaaactctgtctcaaaaaaaaaaaaaaaaaaagaagaagccaaagcccagtgggtggagatcagggctcagatgagccctccaaggaccaatcactctccaaatggaagaataaatgcaatgtgagtggctccctcatctctcctgctaatgccctgtggctgtcctggggtgtgagtggttagggtgaaagcagggagactgtgtagggttttatgcattgtggatggggtcttccatgtttgtcacctgtacacctttgcaaaaatgttctttcagttcagctagtcctgcaattatcacccattccctggggctgcttgcaaagcagcgtcaatgaaattgttgaagattctgttaaccagacccatctctgtcttcctgaatagctccaggcttctgggagtcccagctactacaagtgtgtgtgtgtgtgtgtgtgtgtgtgtgtgtgtgtgtgtgtgtgtgtgtgtgtgtgtgtgtgtgtggtgagcaggggttgggggatggtgtcttggtggtggccccacatggtcatacttttgggtatcctcgttcatttcactccatcactgtcccccacgccagggcaatggattttggcttccagttgtggaagagctattgatgagaccttcttctcatgtctctgtggactgatggctgagtcagtgtcttgaggctaggggttgaggtttaggggagccctcatcctaccaacctctctcgcacacggaacatattctttgcagctcccagagagaacaggcccctgttctgcaagaagatgagcccaggagctgagggaagagcagagtcttcagccggtacctgattccagacagaagcagaactccaggggtcccagggctgtggaggcgttgcagaagatggcaaagctcgtcagaacggtgccctcctctggggcaatagtgcaggcaggcacctcacggggaggcacagtgctgatcacataggtgtcctccccataggcatgcctggtcagtgctgggagtaaagagagatcatgttcagggggccacgtggggcccacaaactccatcctgctgttagattgccccctgagctcattaaacacaaagattcttgggctctacttcaaacccagaacttcagacatctctggatctgggaagagcccagaaatgtacatatctaacaattaaacaatgaaaccccaaaacaactccccctgatgcaagggatcccagggcctcactttgagaaactgggcagagataggggaagataattagacagacctgagcttgaattttagttctgccatttgttaaccgagtgacctcagacttgaccttttcttttccaattttgttttcctaattttttttctttttagagatagggtcttgcactgtcacctaggctagagtccagtggtgcaatcataacttactatagccttgaactcctacacttaagtgattccactgccttggcctctcgagtcagctagaaccacaggagtacaccattacggctggctaattttctaatttttgtagagacagggtctcgctctgttgccagggctggtcttgaactcctggcctcaagggatcctcccgcctcagcctcccaaagtgctgggattacaggcataagccactggacccgggctgagaacttgacctttttgagagtcagttcctcatctgtagaatgaggctgatgataatagcttccgcacaaagatcttgtgaggtgggagtatgctgggaaaatgctcaagatcacagagccaggaaagaccagaaccaggatccggaaacaggctgagcccaccccgaagcccacactcttcccaggcgccgagatcactgttaagagccacgagtggacctgcagtcacatcccacatcacctggagtagccacctacattttcagagagcgcatgcctggaagagctgggcataaagagaatttgaacccataaaaactcattccttggcctagacccaattcggaaagtttggggtggacccaagagtgtgcatgtttaactaattccttgtttatcctgatgtgcatggtctgtgggccacttcgggaaaaatggaagcaaagcaatccttcctaaaaagaatcatcacctccattgtttgtgtgtttgagaatctatgtttctcacacagggcttgttttaaacgagaagccctgaacaatcctggcagggtgtacaggttgcacgaccccagaatgacctgcttgtaacactggggttatctcattcatcctgcaaaataaccattctgaggcaggcatttcgattatcccagtttatatgtcaggaaactgaggcatagagaggcgaaatcctctgcctagagtctcccacgtagaaagcggaagtggtgcgatttacaccagagcctgcgctgtggcctctgcactaagctgatgccctggctgggtatggtgactcacagctgccatcccagcacttcaggaggctgggacaggaggatcgtttggctccaggagttcaggaccagactgggcaacatagtgagatcacatctctctatttcaatatttaaaagaaaaataaactgacacccaatatctgagtgtttctgggtttatctgggttccctgagaggagataaaagggaggtttcgcacctgtggctctgattcggatgacctctccccgggactgcagaaacgagctgttcaacagcaacgtggaggtgttgctctggaggagggttaaggaccttggccaaaatcctctgagtctgcaggcatccaggaggggctcagcctgaaagacaggatggcccagggctgctgacgctacagccaggccacaggactgcagcaggacagtggcttctgggtgctagacagcctttcagatttattactgatgaacggaggacaggcagccccagctccccaagaagtcacctggaatatacactttccagcctcactgcggtgtctgtcttagattgggctccccggaagcagagcctgagatggggatttgtgtgcaggttatttatttgtttatttttgagccaggcacagtggctcacacctctaatcccagcactttgggaggctgaggtgggtggatcatctgagctcaggagttcaagaccagcctggccaacatggggaaactctgtctctactaaaaatacgaaaatcagccgggcatggtgttatgtgcctgtaatcctggctacttgggaggctgaggcaggagaattgcttgaacccaggaggcagaggttgcagtgagctgagattgtgtcattgtactccagcctgggtgacagagtgagactctgtctcaaaaaaaaaaaaaaattaaaaagaaaatatttttgagacggagtctcactctgctgcccaggctagagtgcagtgtatgatctctgtgcactgcaacctctgcctcccaggttcaagtcattctcctgcctcggcctcccaagtagatagaattataggcacgcatcaccataccccgctaatgttttcgtatttttagtagagacggggtttcaccatgttggccaggctggtctcaaacccctgacctcaggtgatctgcctgcctcggcctcccaaagtgttgggattaaaggcttgagccaccatatccagccttgtgtgcaggttattgatggaaggaggattcacagggaaaagcagtgcagagagggaaacagcagagaacaaaacaaggcaaaaaacagttactggaggcatccagcctctgcctggtcacacggagagccctgaagtgtaagttgcacaactgaaatcaccctacctggggacagagaagctgggctattagaccctccacccatcagtcgttggccaatggtcaggccacaaaagctggagttaggatcgtccgcctgggaagcaggacttttgctgagatgccaagagcacccgctgcaaagtttctccagagcttatgctcctttgtgcccatttgccctgctgtcaattccctgattttctccccagcccaataccctgagtcccacaccacaggctctgaatggaattgacccaaccctggcccagtaccgggcatgcgacacgggtgtgctgaaagcgcaagggagatttccattcttgagtggttgtcactgtgctcacctgctctgttggggtgttgtccaaataccagctgaacatagccactggagagtcctcccccatggtgaccctgagcagaatgtctttgctggcattaactggcctgcagttcctctcacagctgaaaggcagacagaggacagagtgaggaagctccccgaggcattgctatcatctggatgtttgtcccctgaaacctcatgttgaaatatgatccccaatgttggaggcggggcttcatgggaggtgtttgggtcatggggttggattcctcatgactggatgaatgcctccctcgggagcgagttcttgctctattagtcaccaccggagctggttgctaaaaagatggccgggagcagtggctcacgtctgtaatcccagcactttgagaggcccaggcgggcagatcatgtgaggttaggagtttgagaccagcctggccaacatggtgaaaccctgtctctactaaaaatacaaaaattagtgggatgtggtggtgggtgcctgtagtcccagctactcgggagtctgaggcaggagaatcatttgaaccagggagatggaggttgcagtgagccaagatcacaccactgcactccaacctgggtgacagagtaacactccatctccaaaaaaaaaaaaaaaaaaaaagagcctggcacctcccacccttctctgcacacaccaggtccccttcatctttcactgtaagtggaagcagcctgaggcccttatcagatacagatgtccagtcttggattttccaaccataagaatcatgagccaaataaatctcttttcttctttcttttctttttcttttctttttttttttttttttgagacagagtctcgctctgtcgcccaggctgcagtgcagtggcgcgatcttggctcactgcaacctctgcctcccagattcaagcaattctcctgcctcagcctcctgaatagctgagattacagacaggcaccaccatacccaactaatttgtattttcagtagagacagcgttttgctgtgttggcctggctggtcttgaactcttggcttcaagtgatccacccgcctcaacctcccaaagtgctgggattacaggcatgagccactgcgcccagccaaccatttttctgtataaattacctagcctcagatattcctttataacaatgcaaaatgggccgggcgcggtggctcacacctgtaatcccagcactttgggaggccgaggctggtggatcacgaggtcaggagatcgagaccatcctggctaacacggtgaaaccccgtctctactaaaaatacaaaaaattagccaggcgtggtggcaggcgcctgtagtcccagctactcgggaggctgaggcaggagaatggcgtgaacccgggaggcggagcttgcagtgagccgagatagcgccactgcactccggcctgggtgaaagagcaagactccgtctcaaaaaaaaaaaaaaaaaaaaaaaaaatgcaaaacggactcagacaggcattgtgaccactggcctggtcttttgtccagtccttctcaagtcctttgagagggtaggaaatggccctttttcaaattaaagatggaataaaagccgcccctgccccaaccaacactgggacgtagccttggttgtgaagatggactgagtcatggcctgactgaattcccatgtcattcactgacagcgtaatgatacggaaggtgaatgaggctgagacaggacctgggttctaatcctgtccttgtcacttatgaagggtcaccttgtgtgcatcacttaaactttttttttttttttttttttttttgagactgagtctcactctatcgcccaggctagagtgcagtggcacgatctcggctcactacaacctccacctcctggttcaagagattctcctgcctcagcctcccgagtagctgggattataggcgctcaccaccatgcccggctaacgtttgtatttttttagtagagacagggtttcactgtgttggccaggctggtcttaaactcctgacctcaggtgatccgcccgcctcggcctcccaaagtgctgggattacaggtatgagccaccatgcccagccgaatcacttaaactctctaagcctcagtttcctcacctgcaaaatgaggggatagcctagataatttctgtgattctttttagttcagataatagtaaactaatgctgtggttcaacagcacgcctgccatgcacacattacttccattgtctctagcttgtccaatgctcacaatagccctatgagtgacatattagcatccccacatcacaggtgagctaaccaggccccgagagcttatgtgatttgtcctaagtgatgtaacttctaagtgggcagatagaatgtgaaccatcgtgtctggatccaaactcttggccttctctataatgtctctgtgaaggccaaagcaactccatttcagatgctaatctgccacgttgactactgattaaccccaattccaggaatgcctctaagatttctattctctctacagttctttgtgtaagagcatgtacttactatgagtgctgccctgaaagagattcacatagtattcttacctttccctacgactgtcctacacattcctttcctatggtatataagccctggttctggcgggtaatggcgctggctttcaccatcttgtcttgcagctgccctagacatcatggtttctgttcgcaagtctcaattaaatgtttctttctaagaaactaaatttgtcagcttctttctctggcctctctgcttcctcgaactttgcgggaaggtttgcatagacctgccctccacaggacggtcccccagtttcccctttggtctgaacttgatgacagctcttgaacttcctacttatctcctcatgtctgccctagtccaagtgtgcaggacattctctatctgcctctccaatccagtctcctcccacgtgcggctctgacctgggagactgagctctatacactgcatcacccaagctgccacaccctccagcttctaactgggtccagccaatgggaaccattgatagaggattggagggtgagaggagagagtttggggaatttattcacggctttccctgctcttttccctgatgggctgcaggtgagagatgctgtgcttctccaaccaaggccacagctccctacgtatgtagtcctgcctaatcttacctctgcattcctgggggtgataatggcttcccttggttgtagtcctgccttgtcgcccctgcttcattgccttatacctgccctcacctgtaaatagtcccttcatcagctctcttccattcattcctggtttggctgagccatcagcttcctgcagggactggctgatagtccaagcaaacttgacctcctaccttgactcctgcaagagcctgggcaatctccctgggtcttctcttgccctcttccaagtcattctccactgagccaccagagcatattgaagtcacatgcttagaactcttggttgcttggcttggcatggtggctcattcctgtaatcccagcaatttgggaggccgaggcaggtgggtcacctgaggtgaggagtttgagactagcctatccaacatggtgaaaccctgcctctacaaaaaatacaaaaattagctgcgcacggtggcatgtgtgcctgtaatcccagatactcaggagtctgaggcacgagaaatgtttgaacctgggaggcggaggctgcagtgagctgcgatggtgccactgcactccagcctgggtgacagagtgagactccatttcaaaaaaataaaaataaaaataaagaactcttgggtggtttctctgtatcactcttaggaaaaaggctaaaatcttgatatgaccggcaaggccccacttgagccaggccctgcctacactaccagctccttcccacccttctcttctccatcctcaggacattggcctctttcgctccctgatgattctctgctccctccctttgcccgctctgttcctgctccagctgccccttccctgccctgtgaatttctcctgaacacctctgctgagctgcagttcctgagagaagtctctctaaccccagtcagggcagttttcatagaggtgcgctctctgccttcttcattcgtgtccagaagtgctgatcaccaggtggtagtaacccctatgacaacagagaccaccacagcaagccttgccccaaggcagccccagcctcagtgggtcctcagtaagtgttggctgaacgaatgaatcaggaccctggaggaactgcccacgtgccccacctgactcgaggcctgagttcccagggcgcagacacgtagaggcactgctctgccctgttctccagctcttggcctctcagaacagccaggcgcagggtgacagcagagtcaggcggcggcaggcaggatgctggaaccaccagctccctctggtctgtgcgaagcagctgcctctcaacacagctgctccacagagcccagcaagaccctgagagaaatggacagacactatgatccatcaggagccctgaacgtggcacacactgctagcttctggttttgaaaggggtcatgaataataacatcagctctaaatagacattttaattttttaatgtcagttttattatttatttattttgagatggagtttcccccttattgccaaggccggagtgcaatggcaccatcttgcctcactgcaacctccgcctcctgggttcaaatgattctcctgtctcagcctccagagtagctaggattacaggcatgcaccaccacacctggctaatttttgtatttttactggagttggggtttcaacacgttggccaggctggtctcgaacttccaacctcaggtgacccacccacctcggccttccaaaatgctgggattacaggcctgagccaccacacccggccaaaacgtcacttttaatgcaggttgcagaaatggtgctatggaaggatgcttttgggaaaaagaaccatgcttcacccaaactctgagcaaatctgcaggatgtggttggcttgtgttgcactggtgctcaggaaggtgtgtagcaggagaggggccaggaggatctgtggccctgggagaaggtccagggcagcttcttatcccggtatatttgtcattccatgtggatgaggctgtccacagcgccaagtccctgtgggctactacggcggcctgggaggttgtactgccatctgggaggctgctgtgtcacctcctgctttatgttagcagcttcctaagtttctgtatcctctgcccttcaactctattgacagatgtttactcatcaatacctcacctcccaccatctccaatatggtgacaggcatatagcagcagagaggccaggaagatctaaatccccaggagaatattcccaagattcctgggactattccaagaattccaagattccctagatctacagccctgggagaacagtcccaagatatgttccctgagcatatttccaaaatatgttcagggttcaggctcatcagctcggtcgcctaaactctggacttgcatactctgtattcagataaggagaatgaatattcagagggatgtcattaccacgtaacaattaacatcaaaagccttaaaatgttgcatgacttttgacccagttattccatttctacaaatttatttatgaaagtaaccacagttgtaaatagagattgaactgtataagagcaaacaatgtgaaacaatctaaatgtccaaaaagagggtaaagaaatgatcgcacatcagccgggcactgcggctcacgcctgtaatcccagcactttgggaggccgaggcaggtggatcacctgaggtcaggagttcgagaccagcctggccaacatagtgaaacctcatctctactaaaagtacaacaattagttgggcatggtggcacgtgtctacaattccagctactcgggacctgaggcaggagaatcgcttgaacctgggaggtggaggttgcagtgagccgagattgcgccactgcactccaacctgggtgacagagcgagactccatctcaaaaaagaaaaaaaaatcacacatcaacattatggtctattgtgcagctattaagaaaatcaatatagagacgataccacgacattataatatgcaaatatgcaggttacattgttcaatgagaaaagggtaaagaaaacagtatgaataacatttctttctttctttctttctttttttttttgagacggagtcttactctgtcgcccaggctggagtgtagtggcacaatctcagctcactgcaacctctacctccaacattcaagcgattctcctgcctcagccttttgagtagctgggattacaggcacccaccaccatacctggctaatttttatatttttagtagagacggggtttcaccacattggccaggctggtctcgaactcccgtcctcaagtgatccccccacctcaacctcccaaagtgctgggattacaggcatgagccaccgtgcctggcccatttattttatgtctaaaagctaaaagaatgtgtatgtagctaggctatattcctgtaaaaaggaggataccatttctacaatgtgagcgctagtgctgccatcttggtttgttggaaaatgcctgactcacttcccccttctagattctctccctagggatataccaaagggctggggaaaggggaggagtccacaccagagaagaggagcactttatcacttttgtttggaattgtcagcgtatggaccagcttttcaggtttcattattgttttaaaattctctagatccccttgctgcctgcattcagggccacccttggtctgtcactgctttctcccaccttctattttttttttttttttttttgagacgcagtcttgctctgttgcccaggccagagtgcaatggcacaatctcagctcactgcaacctccacctcccaggtgcaaacaattctcctgcctcagcttcctgagtagctggaattacaggtgtgcgccaccacgcctggctaatttttgtatttttagtagagacggggttttgccaagttgaccaggctggtctcaaactcctgacctccagtgatccacctgcctcggtctcccaaagtgctgggattacaggtgtgagccaccacgcccggccccacctcctatttccatggaatttgcaagctctggcatgtacaagttatacaaaatgtaggccatagggaaagctggtgcgaagattaagaaaaagaacagcaaaatctgaccactgctcaccacttcttagtgaaacaggacaattcaagaactctatcattggccaggcgcggtggctcacacctgtaatccgagcactttgagaggccaaggcgggtatatcgcttgaggtcaggagttcgagactaacctggccaacatagtgaaaccctgtctctactaaaaatacaaaaattagctgggcgtggtggcaggcacctgtaatcccagctacttgggaggctgaggcaggagaatggcttgaacccaggaagtggaggttgcagtgagccaagatcacaccgttgcacaccagcctgggcaacaagagtgaaactccatctcaaaaaaaaaaaaaaaaaaagaactctattgtcacctaccacatgaccattggaagcgtaactccttgtcattgtctggccagcccagggtcactgtcgtgaaaggatccacatatggaccaggttggatgtacacctccatatcgcctttatctttctgcaaaaaaaagcagccagctggtgagactccaactacagttagctcaggctcactgtggggtgctgttggcattcccctttcaccccagagcagtctgcaccaagagcagctgcagtgtaaggcgtggggtggagacagaccctggccaatccccctggcttccttcccctcatggggcgtggagttggttgctcaggatccctgggcaagtcacgttattctgagtgttggctcggggtacacggggtgttcctggagtaagttctggtgggacttgttaaacagcttgggctgtggagcttcttgctcaagccccgaagtcctgacctgaaataacacagggctccagtggaactcaagccccagtggcctcccgtggcctgagaataaaatccaaatttcttgccttggcaactaaggctccgcgtgatctggcctctgtccacgtgtccataatctcctacatccctccctccaacaggctccagccacgctggcttcaggccatcgcctgcctctcagatctgcccactcagaaagctcttgttctgctttcaggcatggctggctggcttatcttcatgtgtccgcttacatgtcacctctggagaggccatgtctgaccacatcagccagaccaccctgttcgttgctatcgttgcactctattggttcttattagatacttaccacaattcctaattctatgataatttgtttgttggagttttttttttgagacagagtcttactctgttacccaggctggagtgcagtggcacggccatggctcactgcgcctcaacctctcaggcccaaactatcctcccacttcagcctcccaagtagctgggaccataggcatgtaccttaatgcctggctaatttttaattttgtttttttttttttgagatgagggtctcactttcttgcttgaactcctgggctcaagtgatcctcccaccttggcctcccaaagtgctgggattacaggcgtgagccactgtaccgggccgatatgttcgttagtatcactcagtaagcttcctgaaggcggagaccatatgtgcttattcactattgcattcccagcccctgataccaagccttgaatgttgtagatgcacagtaagtctttgttgtagaataagtgcacgcacgaacaacgtcaacagcaaggagctgaactcagtcttgttataaaaactgaagagcttggtctgttttcttttcttcctgctttctaatataagcattaaaagcgataaatttctctctgagcactgctttagctgcattccacaaatgtgcataggttgtattgtcattatcatgtagttagaaattttttctaatttcccttgtgatttcttcttgacctattgatttttttacaagtgtgctgtttaattgccaagatatctaacagatatctacatatcctagatagctcattatagatttacaacataactctgttgtgattagacaacttgctttgtttgaattcagtcattttgggcctcttctcaaatggaagaagcctcagggattcctagtgctctgggtattggtaccaaaaaaccaaaactcaaaactaaaacagagtgcttggacatcttttccttgtgaggttaaacgttttttaaagacaatactcacactctttccttcagcattcatcccagatggttcttggagaccggaaggggctgtgaacacagtgggaacgggtatcaagctttggttggaaaccttataaaaggctgtcaaaatatagagtcagagagtcatgtggaaaatgccaccaggggcgtcagcctgtctttgaaaatggtttaagggaacatagcaaacattcaggtcctagggaaatggattaaaagtgagtcatcttgtccaccactggactaaagacacccctttggtagttgagaaagaggcagctgccagtgcagataaaacacaagatttagagtcagacagatgcagctatgcactgctaatgtgtgtttttgttttgttttgtttgttgtttttgttttttgagacacagtcttgctctgtctctcaggctggagtgcagtggggcaatcttggctcaatgcaacctctgtctcctggttcaagtgcttctcctgcctcagcctcctgagtagccgggattacaggcacccaccaccacacccagataatttttttttttttttttttttgagacggagtctcgctctgtcgcccaggcgggactgcggactgcagtggcgcaatctcggctcactgcaagctccgcctcccgggttcacgccattctcctgcctcagcctcccgagtagctgggactacaggcgcccgccaccgcgcccggctaattttttttttgtatttttagtagagacggggtttcaccttgttagccaggatggtctcgatctcctgacctcatgatccacccgcctcggcctcccaaagtgctgggattacaggcgtgagccaccgcgcccggccaacccagataattttttgtatttttagtagagacggcgtttcaccatgttggccaggctggtcttaaactcttgacctcaggtgatccgcccatctcaacctcccaaagtgtagggattagaggcatgagccactgcacccagcctgcactgctaatgtttaactaccagtaaaggaggtgggagtgagaagccctgatttgtagggtttgtcaatttccatggtataaatgttcccaccaatctataagcctgatgctactgaatatagagtgaggagagatgggcacgctcacctctggcaagtgggtggagtcggcaccacacactaccctgttgtcagatcctcttactggcctcccattggctatgtgaaccgggcaggtgagttatcctctctgagtcttggtttcctcatttgtaaaaatacctggagtccatccccatttctcagggctccaggaagactgaatgtggtgctgtttatagaattgctttgtaaactatacatctagaaagaatgtcatcctggctaacacagtgaaaccccatctctactaaaaatacaaaaaaattagctgggcttggtggcgggcgcctgtagtcccagctactcgggaggctgaggcaggaggatcgcttgaacctgggaggcggagcttgcagtgagccaagatggctccactgcactccagcctgggcatcagagcaagatcctgtctcaaaaaaaaaaaaaaaaaaagaaagaaagaaagaaacaaagaacgctagtttttcaagtttaaacaatggaaaaagatacaatcaattgatgtctctgaaaatatatatatttttgagatggagtctagctctgttgcccagcctgtagtgcagtggcgtgatctcggttcactgcaatctgcccctcccgggttcaagcaattctcctgcctcagcctgctaagtggctggggttataggtgtgcaccaccacacccagctaatttttgtatttttagtagagacagggtttcaccatgttggccaggctggtctcgaacctctgacctccagtgatccacccgcttcgacctcccaaagtgctgggatcacaggcgtgagccactgtgcctggcctactgaaaatattgaaatattaatgattaatatctaattaaagtgtagtgcttaaagtaggaacttagagttatttcatgtgattcactaaggccctggatatattaaggtctgagtaccactgatctttaaaaaattctctcccagtgaattctcattcacacaactataattccaaaggcatgtaaaactgtacaaatcaaggctaagatgccagagaaaggggactttcttaaccttaagaaggaaggcagtccaatcaccctgaatgaaaaaattaggagaaacatttgctgcctttgatcctgcatgaatcagccatgtgacttctgcaaagtcaattaaactttctgggtctcaaatcccacatctggctgtcgaatttccaggcatctatgatcccctcccttggtagcagcatctacgggtgatattttccctaagaaccatccctccccaactctcaggccttggtttgggtgaagctgaccctacattgtactccagcgtgggcgtgagaccctgacctgccaaactgactgctgcttcccctggtctcagcagctggtccaggagaaaccatgaactgagcttcagccagcaagaggcagcctcaggacttctactagaaatatccatcaagacgtactctttctcctctggggttaaagatcaaagcctggggtcatcttgctactgctgggaagagagaatccaaaagaagtcaacacagaaccagaggaggaaagaggcaggtttctgaagacactgtctgagcgactcatccagctgtgtttaagaacaggtctactccctgggcttttcattttcattttcttttttcttttttttttttggtcggggggtggggacaccatctcactttgtcacccaggctggagtgcagtggcatgatcttggctaaatgcaacctctgcctcccagattcaagcaattctcctggcctcagcctccccagtagctgggactacaggtgtgtgccaccacgcccagctaattattgtatttttagtagagacaggctttcgccatgttggccaggctggtctcaaactcctgacctcaagtgatccaccacctcggcctcccaaaatgctgggattgtaggcatgagccacggtgcccagctggcttttcattttctgagctgataaaatttccttttgacccaagccagtttcaccttcgtttctgtcccttgctacttgaattgtcctagcaaacacattcaagtgaaccctacctctgtgatggctactctcagctagttccccaacagccattaccccagccttcctcctggcagccagaatccaccttctcccacagaaactgaaaatgctgggtatctgcttttccagtgcactttatagcagcggacctgaccctactttggtcatggtatctgaggtgatgattgcttagagtgagtgggaaagatttttcccctaataaaaagaggtgcacaggaggaaacccctgctcccgctgctggtacgctgcgttgacatgtaatatccggaactgcagcagtcactttgattccttgagcaacaagcctaaggcagcaccaaagctctaaggatggcagacgagaaagatagactgagcctggtttctcgctggcatcactgagccaccgaaccaaccctggaagtgcttacctcctaacttcttatgtgagtcaagaaagccctgaatctgaagctacttaggttggaccttctgttacttgcagcttaaagcatcataatgaacgcaaactcttgttttagaattctgtgtcagtggttggccgggtgcggtggttcacgcctgtaatcccagcactttgggaggctgagacgggcggatcatgaggtcaggagatcgagaccatcctggctaacatggtgaaacccggtctctactaaaaatacaaaaaaattagctaggcgtagtagtgggcacctgtagtcccagcaactcaggaggctgaggcaggagaatggtgtaaacccaggaggcagagcttgcagtgagccgagatcatgccactgcactccagcctgggtgacagagtgagactccatctcaaaaaaaaaaaaaaaaaaaaaaaaaagaattctgtgtcagtggtgaaatgttttactgtaaacatcattgcctccttagaataactggagaattctaaccatctgtagaacaagatacatattcagagccgtgtttggaaaggcccctcactggagcccaagcaggtgcaatgctctggactcttggtaaaaggttttatgctcccttgcagaaacaccttgcctgtgatagtgatgttcccgatttccaaactcaggttggagaaggcattcctcaccagcatggtgaccagaaaggtgcctgcaatacaaaggacccagagtcacagccattgtcatgaacttgaccaagaaaactctcccagcttgcttctctagtccaccgatgcctccaacgaaatctttcacctctgagcatttaatgaatccctgctgtatgtcaggcatggtgcaaggctctggggacacagagatgaaggagcttggttcttgtcctcaagggccttatcatgtagtagacacataggacagtgaacgccaaaccacgggaggaatcggcatggggcacagtgggcattgggtgggcccgcttcaacctcaggagagaaagaaatggttcacaggatagagccagggctggagctaaattccaaaggagaagtaggttctcgatagataagactgcagattcccaagagggagacacatagcaggattgtcagaagcgtggagacagtggaaaaggatattttattttattttactttactttattttatttttgagacaggatcttactctgtcatccaaactagagtgcagtggcacgatctcagctcaccacaacctccacctcccaggctcaagcaattctcctgcttcagcctcccgagtacctgagattacaggctcatgtcaccacgccaggctaatttttgtatttttagtagagacagggtttcaccgtgttggccaggcttggagaaggatttgtaagatttatttagatacatgtgtgtcccatcccttctccctcatggggaaggggctatgggtaggggctaccttctgtgttctcaagcccagagagaaatgcttgagagaggagccttccttggaaagcccggtatgtgtctgtttggggtccgcatggacaggcttcatactcatgcccttgaaggaacagtctgtgacgggaagacgtgcgggtgggaaggggacgggaggaaggggctccatttctgcgtctgggaaataattgcatttggctgggagtcggccaagacatgggtcagaatgttctgtggaccagatgtgtgccttggggagacggatgctgacgaggggagggagaatgaggagagtccaacagagaggggaggtggccagggagaagcagccagggcgtgtgaccagctaaaggggaggcatcccccaccaccccaggaacaaaggcctataaggcccagctgggggccccaagaacccagagaagctcctacaagaaagaggcagcttgaaacatctgctagccctcaagagccaggccagctaggactcggccagcaccaccaagtgcaaatgtccctgccctgtcccgttccctttccatccttccactcccgccacccctggagtcatccaaatctgttggccttaggggcaggaacagtctgttaatcatctaatagtgagcaaaagtcacaaagcacatggatattttatcagagagggatcatcttcccctgtggagtgacctttatagcagcgactttcatggcaggagtaatttttataggtgacaaagcaaaacctgcatctggcttataacccacgcgtggtgtgattttccagctgcagcagcctctagactttccctcttccaagctggacccttggtatctggcaaagcccggatggttttcttctcaaacctattgtcccttctgctatctggtttgtggagttgcttgcagagggcatggtaaccccacacctgcacagtatcacccgttttctaacacacttctgagatccagggggagctacgggcaggtcctggatgggctggagactctgccattctcatcacatttctgcctgctgatctcatccgggccctcaagaactctctgttccttacagattaaatgcaaatgggcgctgtggccacctcccctggctggtgcctgccagtctgtcctcccgtcagcatcattgcaaatacttctgagatagaccagagatgggacttggacccctgccctgcctcatcgaggactctactacaagctggttggggagggtggcccatggcaggcacagaccccagtcagatcatccagacgttgcaccacaaatcttgctcaaggtgccatgcccactgagtgcagaccttgaggaaacgaaaacaaacagctcccaccttaaatcttactcaagggagttaaccctatagcccgcacacacagaagaccagaaaaatgaccatctttaccctttgcctcattataatactaaaaatcatgcccgagggtggagctttaacatgctaatgagacataccacacatcaagaagcatgtgaccagactgcacaggcgctgaacattccccacctccacatgcttaaacatcgcccttttcccatcctacctcctttcagaatgccgggagtggtggctcatgcttataaacccagcactttgggaggtcgaggtgggcagatcatatgaggtcaggagttcaagaccagcctggccaacatggttaaaccccgtttccactaaaaataaaatagtcaggcatggtggtacatgcctgtagtctcagtgactcaggaggctgaggcaggagaatctcttgaaccagggaggtgaaggttgcagtgagctgagatcacgccactgcactccagcctgggtgacagagtgggactccatctcaaaaaaaaaaaaaaaaagacaggccgggcacgagggctcacgcctgtaatgccagcacttcgggaggccaaggtgggtggatcacctgaggttgggagttcaagagcagcctggccaacatggtgaaacccctctctactaaaaataccaaaaaaattctccgtgcgtggtggcgcatgtctgtaatcccagctgcttgggaggctgaggcacgagaattgcttgaacccaggaggcaaaggttgcagtgagtcaagatcacgccactgactgcactccagcctggaagacagagcaagactccatctctaaaaaaaaaaaaaaaaaaaaaagaacgccttctggactttttggggagtcagcccctgaacctccactccagtgctgccttctttatgtttgaacataagcctctaacaaaagcctcgtccaggaaagtttgagtacatcagagcctaagaccccatggtcggcaacacttcctctctccatccccatctctgccattcttggtttttacctctttcccgctagggcatcacctgcagttccccaaaccacactcttctctagagatgtttgaagaaatctgaatatgcctggtctcttacaggggccctaaatgggggtgattttgccccccaggggacatttggcaatgtctgacatttttgtcatcatgacttggggtgctggtgttactagcatctggtgaataaaagccagagatgctgctaaaactccttcagtaccagcccccaactgtaacgaggaatgatccagctccgaatgtcagaagtgccgaagtggagagctgataactcaacgatggcagattacatctggctgttccttatcttatgacccaggcaggatgctgtgaaccaaatctatgtcccggacacactggaaaactggccggcaggaccctgggcaccaagtcacaaagggaagaggaggggcatcagaaggggagccactaaccccatgtaccttcaaccggaacagccaggcggcaaatcccaaatggctctccaaagctcacttgctcgtgggagaaggttgcattgagtccagccacctcaaaggtcagctcttccggggtgccctgagccaatgagatggtgatcaataggtcctgtccaagctccaaatggtcagaagcccaggaggcctgcagccctgacagcagctccaccaagtggactgtaatgtttctggagattgtagaggtggtggtgttgccggtggcttggatctccaggcggtgcctcccagggcccatcagtttctgggtttctctgtccaggatcagattgtacggtagcgagcccttttgggtggtggactcggccagggttatgtcacccaaaagcacagtgtaagtcactcctgttcctaagtggggtaagaaaaattaaagaatgttggtaacaaccatgcggttgataatactatggcagctcagagtcagtctctgaagcctgattctggatacaaacttggatacagatgcagacataaagaaatatgtaaggatatgcccccttctcaaatattaatggtggttatccctgagtattaggttaatgactgatttcgtctttcttttgagacagggtctggcgctgtcgcccaggctggagtgcagtggtgcgatctcagctcactgcaacctctgcctccccggttcaagtgattctcctgcctcggcctctggagtagctgggattacaggcgcctgctaccacacccagctaattttttgtatttttagtagagacagggtttcaccgtgttagccaggatggtcttgaactcctgaccttggatttgcccgcctcagcctcccaaagtgctggggtgacaggcgtaagccaccgctcccggccgtgattttgtcatctgggggtccgctctgttcatttgcatattctaacttatttatactatacatgtcttacccgagaacctaaatatttgtaattaaaaaattaccacatttagttgccagggatgtcctggtcgggggaggaggaggaggactaaaagggagcatttcttaagggtgggggctgatttttatgcatgagaattagctttgggtcttgttttaagcaggagcaagtaaagccattccttcatcctacactggtgaccgcccagaaccctgcaaaccaacatgagaactcagcccgttcacgggaagatgggggctcccttgcaggttgcagatggttgttcttactggatgataaatattgcggttgactcttaaaatctgacttaaatcaacaaattaggattccttccaataaaaaccaagctagcgtagttctcatctgggtgatgatgatgataactacgatataagccccatgagaatgggaaccctgactttcatatttactgctgcctcgcccacacccggcagagtagtaggcactcaattatattagtaggatgagtaaataaatgaaggattattttgtttcctcaggggaacatatgagccctcttcatccaacaaacatgcaagaacagaaggggtttcctgagggctgtgttaaagccccattatgacttccacagctattgctatgagagggctccaggtgggatgtgaggtcaaaccgagccacctgctcattgcactagctctctgctgccctgtttacatcaacaggcctctattctaatctcaaactggtcctgggcttcaggaaaaacgctgccctgggtgaggatgagtcttagccaggagagtctctattgagagaaaggatgataatttaaaatatttaacaaccagcacagcatgggcgccaaccaattagaatggatgctctgataaatcagaatagacactgcgaccaacaaatagatgccatgaccaatcagaatagatgctgtgaccaatcagaatggacaccctgacccatcaaaatagacatgacaaccaatcagagcagtctctgtgaccgattagaaaacacaggctgggcgcggtggctcatgcctgtaatcccagcactttgggagtccgaggcgggtggatcatgaggtcaggagttcaagaccagcctggccaatatggtgaaaccctgtctctactaaaaatacaaaaattagctgggtgtggtggtgggcgcctgtaatcccagctacttgggaggctgaggcaggagaatcgcttgaatccaggaggcggaggttgcactgagctaagatcatgccattgcactccatcctgggacacagcgagactccatctcaaaaaaaaaaaaaaaaaaaaaggaaaacacactgtgggcaggcacagtggctcatgcctgtaatcccaacattttgggaggccgaggtgggcaggttacctgatgtcaggagttcaagaccagcctggccaacatggcgaaatcccatccctactaaaatagaaaaaaataaaaaattaacctggcatggtggcacgcacctgtagtcccagctacccaggaggctgaagcacgagaatcactggaacccgggtggtggaagttgcagtgagctgagatcgcaccactgcactccagcctggatgacagagcaagactctgtctcaaaaaaaaagaaaagacactgtgaccgatcagaatggacatgacaatcaatcagagcagtctctgtgaccaatcagaaaacaccctgtgaccaatgagaatggacctcagccataacagttggcatggctataccagtgggtgcagctgaatactggccttggccaggggcaacttgattgtgccaagctagtcgatgctggctgtactgagatgggctcaggcccagttggtagcagtcccagtgccacctcatcctagttaaattcccaaaaggaagtgactcggaagttcggttctacagggatgcaaagaagggcctttggaaggctaggagcactcactaccttactagccttctgactctgggcaaatgttttaacctttctgtgtcttcatttcttcatctgtaacatgaagataatactactatgtaatgagtagacaagtttatgcaaagcacttagaacagtgcctggcacacactaggtgctaaataaatgaataaatgatagtttaaaaatgaactcggtcaggtgtggtggctcacacctataatcccagcaccttgggaggccaagctaggtggatcatctgaggtcaggagtttgagaccagcctgaccaacatggtgaaaccctgtctctactaaatacaaaaaattagccaggtgtggtggtgcatgcttgtaatcccagctacttgggaggctgaggcaggggaatcacttgaacccaggcggtataggttgcagtgagctgagattgtgccgttgcactccacctgggcaaccagagcaaaactccatctcaaaaaaaaagaactcagtaggtgatccttgttactatttatttacttttttttgaaacagggtctcactctgttgtcctggctggcatgcagtagcatgatctcagctcactacagcctcgacctcccgggttcaagccatactcccacctcagccacccaagtagctgcaactacaggcatgtgcaaccatacctgactaatttttgtactttttgtacaaatggggtctcaccctgttgcccaggcttgtcccgaacttctgggctcaagcgatgcgcccgcctcagcctcccaaagtgttggaattgcaggctcaagccactgcacccagcccactatttattaaggtctgggagttggatagatttggaggaaatcagtgattttatagcttgccttgatgtgcccaattctgcagactcacctccatcaagctccacctgaatccacagaggatccccaaagacagcctggcagagagggccggctcctgactgggacaggccggagcatgcagtcacactgagcgtctccatcttgtctcgcacggtcacctgcctctgagctgtcacatgccactcactggttgtgcattcagcaaacacggtgaattccccaggagatgtgaactggtgggtcacattgctggacacattgccggccacagtcagggacatgaccagtgttggggaaacacaaagacacgcatttacacatgcactgacagggtttggatctgcgctcctgcccaaatctcatgttgaattataatccccaatgttggaggtggggcctggtggaaggtgattggctcataggggcgttttctcgcgagtggcttggcaccatcgccctgatgctgttctcttggtagtgagtgggttttcacaagatctggttgtttaaaagtgtatggctggccagccttggtggcttatgcctgtaatcccagcacttcgggaggccgaggcgggcagatcgcttgaggtcaggagacagagaccagcctggccaacgtggcgaaaccccatctctactaaaaacacaaaagttagctgggcgtggtggtgcacacctgtaatcccaggtactagggaggctgaggcaggaggatcgcttgaacccagaaggcggaggttgcagtgagctgagatcgcaccactgcattacaggctgggcgacagagtaagagcctgtctcaaaaaaaaaaaaaaaaaaaaaaaaaaaaaaaaaaatccagcgagtactagtaacactagcaataatagtaacaacttagactatgtcgttcctggcctgaaaaccctcctattatcctctgtagtgggtgctacagggaatcccccagattccacccttcaagcctgagcatgcattcccccagtacacctgtgagctgtggctgagggcttacagctgaatccatgtccaggagtcccttttagccaaagggagctgcctcgctcaaacctacctcccctcccatggacatctgcaccccacgagtgctcagtgccggggtataatggtctggctctctggcctcaactggaagcaactctgagggccatctctgctcagaggtttctgcaggatcgtcagggtctctgtggcccctgcatcccagttcaactctcctcttgccccatcttactactcccttcccatgctccacaacagagtctgtttcctggttcctgtgagacaaagtagcaaactcaaggagataggtgtgctcatttctgttagccagcataatcacaggaagcccctgactgcagtgacaggcagccctccagaacactttgaagacaaaacagaatagagtgctcggcttccacgtctctagcctgagtcactatatccctaaaaagataaatgactggtccttttcttacatataagataatgtctcgctgggtgcagtggctcacgcctgtaatcccagcactttgggaggccgaggtgggcggatcacgaggtcaggagattgagaccatcctggctaacacggtgaaaccccgtctctacaaaaatacaaaaaaaaaaaatttagccaggcgtggtggcgggcgcctgtagtcccaactacttgggaggctgaggcaggagaatggcgtgaacccgggaggaggagcttgcagtgggccgagatcgcgccactgcactccagcctgggtgacagagcaagactccgtcttaaagaaaaaaaaaaaaagataacatctgagatggctggtgattatgcttctgcaatctacaacaagattttttttttttttttttgagacagagtctttctctgttgctcaggctggagagcagtagcaggatctccgctcactgaaaccttcgcctgccaggttcaagcgattctcctccatcagcctcctgtgtagctgggaatacaggcatgcaccaccacgtccagctaatttttttttttttttttttttttttagtagagatggagtttcaccatgttgaccgggctggtcttgagctcctgaccccaagcgatctgcccaccttggcctcccaaagtgctgggattacaggcatgagccaccgaagccggccaacaagatatactttagtcatctagaggcagatgcactcttgcacccaaactttgatgtgattttacgtggactgaacctccacaacccatatagaagctgtgagctgaaacactgttttggagcagtctggcagaacctctttgaaagacctcccaggctgtagttctcagtctgtcgtcctgaacaaaactaactttaattatttaaaaagcttgatttttctttagttgacagaccccacctacgttagactggctagcatcaacagctcttcaggaccaggctcctgctgagtttttcagcatctttcattcttccacagagtcctgaactccaggcatggcgaggtccttgcagttatttgaatacgccacatgctttcaggtccatgctactctcttttctctagatccattgctcttgccttataattctggttccccgagagaggactttagctctaggtcactctaaggctcctgctgttttgtggattattagtttcagacaaatctctgcacgcccaatatcagctgtgcgcagaagcagccgattaacggaagaacaatgtcaatccctagatttgccagaaggtggcgctcagctaaccaacgctggattcacacagatttcaccaaaagcaaattgttctgtaaggcccgtaatacagtttcagaaatgtggaaaattttccatgacaaacacagaaaaaaaaaaggccctccatgcaaatgaatataaggcaaggtaaaaaggagcttctaacagagaagtcttctgactcctaagcaatgcaattcttcccaggagctcttattatttatcaacaatggatacgaagggtttgatttaaacatctcacctcttagactaatgatgagttaagaaaaaggaggctgcaccaacacataagagaaaagcacagtgatatttacacaaaaaaatgtggcttccgtacattcaaaaatcaaaattcatgctattttccctatcataacctgagttctgtggctgctagtattgataagaaggcatcagaaaggcatttcccagtgtttataaaaatgatttttaaaaggtgggtggtgaccaggcacaatcgctcacgcctgtaatcccagcactttgaaaagccgagatgggcagatcatctgaggtcaggagttcaagaccagcctggacaacatggcaaaaccccacctctatctactaaaaatacaaaaattagctgggcgtggtggagcatgcctgtagtcccagctactcgggagacagaggcaggagaatcgcttgaacctgggatatggaggttgcggtgagccgagatcatgccactgcactccagcctgggtgacagagcaagactctgccaatcctccacccgccccccccccccccaaaaaaaaggtgggtgggtagtttcaaggtccaacaaatctttaatgtaaaggaagatggactatttgggtggggcaatggtggaggaggtgccaccatctatttcctttgaaagagaaaaaaatgtcagtgattgttgtttagagctaatgcccagagagactgcaaatgtcaaacagtgctgtgtcttagattttaatcgcacaaaaacttccagagaataatacaacaaacacccttggattcgccatccagacttaacaaacattaacatttggtcccatttgcttctgttctaaaccactgtttatcactgaaaagtcctgtgtagctgtgggtcatagcggggctacatttaggcaattttgacttatgccaaattcaagttctacaagatttgggggctgaaagattgtgtaacttacaatctgtcgttttctttacaaactcatagcagtcaggaagaaacccacagaacagtggcataggtatttgtatcacccagatatttgcccccaaaacatcactgtaaatagtttctcatttgacaccatgaaacattcaaggcagccacgaacacaaatgtgacagggggccatgtgctgtggctcacacctgtactaccagcactgtgggaggccgagggggtagatcacttgtggttagaggttcgacaccaacctagccaacgtggtgaaaccctgtccctactaaaaatacaaatattagccaggcatggcggcacatgcttgtagttctagctacttgggaggctgaggcaggagaatcgcttgaacccaggaggtggaggttgcagtgagccgagatcgagccattgcactccagcctgggcgatggagaaagaccctgcctcaaaaaaaaaaaaaaaaaaaaagaaagaaagaaaagaaaagaaaagaaaacctatgaggtagagtgtttgcaaaagtagcagcaacagttcctcccatcccatatagaagcacctcgcagtgtggctccacactccttctatcagtaggtggggtctattcctccacctcttgaatctggtcttggccatggaacttgctttggccaacggtatcttagaaaatgtaacacaagcagagatttgaaaaaatgtttgcgcattgggctccgctgctaggaacactgtgtgaatgagcctaggctaacctgttgagtgatgagcagcatatgcttctagctgacatccagctgaccactaggcatgtgagtgagtgaggtcttcccggacagcctaccccagccaactccactcagacaagaaaagccgcccagctctccaaagaaccgtaagaaatggtaactattgttttaagccaccaagttttgggttggtttgttatgtggcaaaaaaactgatgatacaacctggctcaaggctcagagatttctcttacctcggcgggttgtagggatcaaaagtgtggctgtctcctgtactaattatacaggacaggtttcctatgtagggtgagaggagccacgtcagggagatggtgacattgtcaaagatgaaactctcactggacaccatcagctgcagggctgtggattaaaacataaaatgctgcatgcacttgtgaagcaaaattgcacatttctgtttataaccgactctcttctggctacctgtccagtatttttatgtgggtctttttttttttttttttttttttctcacagggtcttgctctttcacccaggctggagtacagtgatgcgatcatggctcactgcagcctcgatctttccaggctcaggtgatcttcccacctcagtagagactgagtagctgggactacaggtatgtgctaccacacccactaatatttatttttattttttgagacagggtttcactctgtcgcccagggtggagggcaatagcatgatctctgctcactgcaacctctgcctgctaggttcaagtgattctcccacctcagcctcccaagtagctgggattacaggtgcatgccactacggctggctaatttttgtattttttggtagagacagagtttcaccatgttggccaatggtctcgaactactgacttcaagtgatctactcccctcagcctcccaaagtcctgggattacaggcatgagccaccacacccagcctaatttttagattttttgtagagacggggtttctccacgttgtccaggcttgtctccaactcctgggctcagactatcctcctccctcccaaagtgctgggattacaggcgtgagccaccgcgtccagccaaggggagcaactttgaatgagggagtctcttagcacacagagatcagcccacgtgggtggctgctgtctctgttttcaggggaagctggacatgccataaaatcagagggacatttctatgctcaagcaagtcggggactcaccttcccggcactggtactgcacccacaggtaactgccctgagtcggacacaggtttccaaagtaggtctcatctgctgccacctggcatgactgtagctcctggcactggcctgggaagcacgcacatcccagcggaagcaggaatggtgtgcaagacaaaagaggatacattcaacagagctgtacagagatgaatggcctctcacccactcattcatttacccaccatccgcccaacaaatagcttttgatatctcctgaagaccaggtactgggctaggtactcaggtgagggagaagtaggatttctgtcctcaagtagttcagggtctagcatcctggtctcaaacttcagcttgcaacagatccccctgtgagtcttgtgaagataccatattccagaccccaccctcagcgattctgattcagtaggtatggagtgcagctggagaatatgcatttctaaccagttcctatgggatgctgatcctgacattgctggcccagggaccccacttcaagaaccactggtccagcagcgtctagagagatggcccaaaatagaaatctacacccagagaaccggcagaggaggcaagattaggaatcctgcgtctatcatggtaccacatgcccacagaagggaggagcagggacagcccattccagaagcttcagggtcatccagcacctctccctcctgcccagcgagatctgttagatgcccacagggaagcctgggagaaagaaacaggtccagaacacccacctgtgcttctcccagttacctgctaggtcccacttcttctgggcagttggccctgggcccacagagccaccctcaccctgccatgcttgtatcacagcgaactacattttccaaactcccttggccactggctcccaggtaggcttggccaatggccggcactactgaaagactggagggtggtgtattcatttccaatcactgttgtaacaacttaccactaacttaatgacttaaatctacatagatttggctgggagtggtggctcacacctataatcccagcactttgggaggcagaggtgggcagattacctgaggtcaggagctcgagaccagcctggccaacatggcaaaaccctgtctctactaaaaatacaaaaattagctgggcgtgatggcacatgcctgtaatcccagctactcaggaggctgaggcaggagaatagcttgagcctgagaggtgaagattgcagtgagcagagatcacgccattgcacccaatcctggattacagaacaagactcagtctcaaaacaaacaaacaaacaaaaacgcagatttttgtccaggtatggtggctcatgcctgtaatcccagcaatttgggaggctgagtcaggtggatcacttgaggtcagaagttcgaggccagactggccaacaagatgaaactccatctctaccaaaaatacaaaaactagctgggtgtggtggcacgcgcccgtagtcccagctacttaggagggtgaggcaggagaatcacttgaaccagggaggtggacgttgcagtgagctgagattgcgccactgcactccagccaaggcaacagagcaagactttgtctcaaaactaaaataaacaaaaataaagcagcacagattttttaaatctcacaattctgtatggtggtcagaagtctgggtgggctcagctggcctctgctcatatcacagggccgacaccaaggtgtcagggctgtgtttctttttttttttttttttgagatggagttttgctcttgttgcccaggctggagtgtagtggtgcgatctcggctcaccgcaatctctgtctcccaggttcaagcgattctcctgcctcagcctactgagtagctgggattacaggcatgtgccaccacaaccagctcattttgtatttttagtagagatggggtttctccatgttggtcagcctggtcttgaactcccaacctcaggtgatccacctgcctcggcctcccaaagtactgggtttacaggtgtgagtcactgcccctggccattttttttttttttttttgatacggagtctcgccatgtcacccaggctggagtgcagtggtgccatcttggctcactgcaacctctgcctctcagattcaagcaattctcctgcctcaccctcctgaatagttggggctccagatgtacaccaccatacccggctaatttttgtatttttagtagagacagggtttcaccatgttggacaggctggccttgaactcctgatgtcagatgatccacccacctcagcctcccaaagcactgggattacaggtgtgagccatcgtacccagcctcttgctttttttaagcatctcttctcccttgacacagcagttcccccagtggaagctccaattaactggcagctgtcagcatttaactagactcagaccctaccccccaggattctgattcagtaagtatggggtgcagctggagagtgtgcacgtctaacaagctcccaggggatgctgatcccgatactgctggcccagagccagctggaacagagcatgcagaaatttcaaccccatttgcagagtgcatacaaggtgctacactcttcccccaggttctcctgaccctcacaggagccccatgaaacttagaaagattctgcaacttgcctggatcacccaggcagcaggggctgagctgggatttgaaccccaacctgccgcccttttgccatgtaccctgctgcccacatcccagggggttctgccccatccttggactcggtctaagcagtttgcttagacaaactgggggtggcagcagggctcaccttccagctcacaaattaaaccacgcataatattcaacatccccttgtaatggataaactgcctcaagacgcagaggccacgtccctgctgaggtttttttctaatactgttgttacccagcgagaccatcctgggctctctctccaccatcacggttcatactgcagtccacacctgagcctgccacctcatgtcctcaccaccttgtcccccagtctttctcgtggctggatcctgcacttccctcacagccaggctcctgatgccgcccccgtaaagctttcctgagccccacctccaccccgtgatctggggggcccctctgatcaaaagggaacacgagccaccaccacatctctgttctcagattaaacagactcaaagagaggtctaattccagaacttgaggacagagttttttctatgactcttcgtagccacatataatccacttaaaaaaaaaaaaaaactaaatctgatctaattccaggatttaacacgccttgcagacaaaatttaaaatcccttcaggtccccagatgccttgaggctcagaatgtggcccaaagacatttgggatcctaagtggcatcacttgggagtgagttggaaatcaagtcggaggtttttaaaaatttttggttcactgcaacatctccaggacatagaacagtacctggcacatagtaggtacaaaataagttttgcatgactaaatagatagtgtttgctcttctgggttgcggcatttatcacagcattagttaattgcctgtatatcactgtctccccactccgccgcaagctctttgaaaaacagagcttgggccaggtgcggtggctcatgccggtaattccagcactttgagaggccaaggtgggtggatcactggaggccaggaggtacagaccagcccgggcaacatggtgaaaccctttctctacaaaaaatacaaaaattagctgggtgtgagggtgcttgcctctaattccagctacttgggtggctgaggcaggagaatcgcttgagcccgggaggcggaggttgcagtgagccacgactgtgccactgcactccagcctgggcaacagagcaagactccatctcaaaaaaaaaaaaaaaaaaaaaaaaaaaaaaagcaccaccaaaaaaaaccaagtgtttattggctaactgaatgaatgagggaccagggtgcttagatacagaccccgcgggatcctctctgcgctcctcctccgactcccacaacagggctcccctctaacgtgctctctgagctgtgggtaccacatttcaggaacttgcagctgagcctttgaggaaacagctcactaagccccagcagtgccttggtgaggaaggtacatccattctcccgtccggggccctttctccttgcaggggccacagcctcaggaacgctggagtaagaagagtcagtgaaaaccagccagctgattttagcgtttcctttccccatgcctgctccaaaaggcaggaggacagaggagccattctcagttccccgaggcaggagaaagttctgggagtactggcgtccctccctgaatcttcaaagggtctttgggcagaagcagaggctcagaggagagtgccaaaaggcacaactggggaggctggcccccaggacctgaggcttgcagcctggccacacggggctgtgtcctcacttagccaagaagcagcaggccacttgctttcctggaccctccagcggggacagtggtgactgcagcagaaagaagagggtttcccgatgtcctggaccagggaagtctctgaggagtttttacctcctagcagggtgcaagaaacccccataatcccggaaattgaatcctagtcactgggcaagcgcaactcagaagtagatttaatctgatttagaaaaacaaagccctagagtaactctcccacgtgaacaagataccatctatcaggagcttggcttcagcgttattcacagtcacagagattaagaaccaacctttctcaacaggagaagagacaaatggcggcacagttacacaacagatgaaacaaataaaccagcacaacatgtatcaagacggataatacatctcaaaaacaagatgttgagcaaaacacaggaaccaaaatgaaaagaaaaatgcattctatagaacgacacacaatatgataccatttatataaacattaaaaccctgcaaagtggccaggcacagtggctcacacttgtaatcccaggaaggccaaggtgggcggatcacctgaggtcaggagttcgagaccagcctggcaaacatggtgaaaccccgtctctactaaaaatataaaaaattaacctggtgtggtggcgcacgcctgtagtcccagctactcgggaggctgaggcacaagaatcgcttcaacccaggaggcagaggttgcagtgaaaagaaattgtgccactgcattccagcctgggtgacagactgagactccgtctcaaaaataaataaataaaaaataaattaaaaaaatagatttaaaaaaaagccctgcaaaagcaacagtctgtagtgtttaggaatacgtgcctagaaggtgaaaataaagcaggcgcagtggctcacgcccgtaatcccaacatttggggaggccgaggcaggcggatggcctaagctcaggagttcgagatcagcctggtcaacatggtgaaaccccgtctcttctaagaatacaaaaactggccaggagtggtggcacctgcctgtaatcccagctactcgggaggctgaggcattagaatcgcttgaacccaggaagcagagattgcagtgagctaagatcgggccactgcactctagcctgggcaagagtgagactctctctcaaaataaagagagggatccacaggagtctcctagtgttgtattcatttttctttttcctttttcttttctttttttcttttttgagacagagtcttgttccatcgcccaggctggagtgcgatgatctgatttcggctcactgcaacttccgcctccagggctcaagcgattctcctgcctcagcctcccaaatacctgggattacaggcatgtgccaccagcccggctaatttttgtatttttagtagagatggggtttcaccatgttggccaggctggtctggaattcctgacctcaggtgatccacctgccttggcctcccaagtgctgagattacaggcatgagccaccacgcccgactgtattgatttttctaacgagggaatcttaagcaaatgaggcacggtgttcagatctgatgaaggtgggtagtagatctgtgggagttcattacagtattttctattcttgtctatacgtttggagtatttcaaaaatttaaaaattaagttaaaaaagtgatgtttcctgcatccagcaggggtcgaggcacgccatgcccaccagatccatggctgtgtttgatgtcggggagggtggaccacagccccctgcttccttgctccgtgcgatgggcagggactggccagttttcccccatgttggaggcccacggtcagagatgaagattatcagaggcttccggaaccctttgctgagcacagaataccagcaactgccctctgctggccgccagagctgcagagcccttgggccctacctgccacctcctccttgacgttggcccagctgcatccctgctccagatctgaaggacgcccggcatcctgggtgcagaaatggggattctggcgcccgtagacggcatcctggacctggatgacctgccccaagccacagtgcacggtggcattgagtccctcgcaggccaggctctggccaacccctgaggcaaagggaaggcaagacattaggggggctcacggttacagacaggtgagtgccggttcacgggaagaggagggtcccgggggttgggctgagatgcaagaacccgataggagccgcttggcaggggtgataaattgaatatgattgtcggcagcattgtgctgagccaggttccctgggatcagatccagcccagccacacactgctgctgtgtgaccttcagcaagttagttagcttctctgtgcccccactctcatactaaacctcatgcaggccgggctccgtggctcacccctgtaatctcagcactttgggaggccgagacgggcggaccacttgaggtcaggagttcgagaccagcctggccaacatggtgaaaccccgtctctattaaaaaaaatacaaaaattatctggggatggtggctcgcacctgtaatcccagctactcgggaggttgagacaggagaatcacttgaacctgggaagcggaggttgcagtgagccaagatcacaccactccagcctcagtgacagagcaagactccatctcagaaaaaaaaaaaaaaaaaagcgggaaagacagaaacagagatgagacaggtgggcaggcaggaaggtgggcaggtggatggggacagggcagggatgagtgacggagcatcacgtgggcagagagagatgcatagagacagggagagaaagctgcggacagaggtaaggtcagaaaaacacacacaggtcagctcttcagcagggagatggggacagaaaccggcaggccctgaagagcgagagggagacagagagaccacagaggcaggaagagagtcagagaccaagggagagaaagagaaagagttagagaaaaacagaaggggaagaaagacccagagaaaactgagacaggggaggcggcaagagaaagagaaggtcagagagatggaggcaggaacaggagggagaggcgagcctggagagaggcctgcaggcaggcagggagacagggtgggagatgggaactcaggggcacgggccactcacggaactcgcacatgaaggcgaaggtctgggcgcagtccgaggtcacccactcagaggaagggcctctcccgatgtggccgcaggtgtcaggggcagcggcggcctgccctccatgccagttgctgtaggtcacattggaggtgtccaaccaagtccccggccctggaagggcaacacgaccaccaggactcagtaactgtcttcaaactccatttatacaaatgcaggactcacgcctgctctgccgctgctgggcagcaggtcagcaattaatgttgatgggatggagacctctctctccaggaccaataaagttctcttcctcactgtcatcatcaaacactcaatgtaagaactggaacaccaaattggagagcttgcaaaaggtgctttgattaaataaatgaggctgccagctctgtctaaccataatcaataatttatttattttgagatggggtcttgctctgtcacccaggttggagtgcagtggtgccatttcagctcgctacaagctccacctcccaggctcaagtgatcctcccagcttagcctcctgagtagctgagaccacaggtgcaagccgctatgcctggctgatttttttgtatttctggcagagacagggattttgtcttgttgcccaggctggcctccaactcctgagctcaaactccacccacctcagtctcccaaagttctggaattgcaggcatgagccaccacacctggccctgagcacagtctaaggaagagccaggggccaggcccagtggttcatgcttgtgatcctaacattgtggaggtgggaggatcacttgcacccaggagtttaagaccagcctgggcaacctagagagaccttgtctctacaaaaaaaaaaaaaaaaaaatttagtcaggcatgctgcctgtggtcccagctactcgggaggctgagttgggaggattgcttgagctgaggttggggctacagtgagccatgatcgtgcccctatattctggcctgggagacagagcaagaccctgtctcaaaataataataataataataataataataataataataataaagtccagaagtgggctaagggatgttttaacatatcatcttcttcataagctgtgtcccttgccaagtacacctgggcagtgctgagttaaaacatgagcagttattgttactttgggcctcttcagatccttgaaaatactgatgtaactctttaaaaggagtgtgtgtgtgtttatgtgtgtgtgtgtgtgtgtgtaaaacagaaccatgtcgaggacaccagagagctagaaaacactaaatatcaaaatttactatggattgggcatggtggctcacgcctggaatcccagcactttgggaggccaaggtggatggatcacttgaggccaggagttcaagaccagactggccaacatggtgaaaccctgtctctattagaattacaaaaattagccataattccagctactagggaggctgaggcaggggaatcacttgaacccgggaggcagaggtcgcagtgagccaagatggtgccgccactgcactccagcctgggaaacagagtgagattgtctcaaaaaacaaacatttattatgggtactcagaaacgtaattattaatttattgaaagagactcatgcaaatgaaatggttttaaaaaatccaaagggtctaaaatgaaagtatcttccctctccaagctatgggcttctccatcattgttatgtttctcataaatgattccaggatgaattgaattgtatccacacatcagcatctatgagtgcctgaaatctacttacataaatgtcatgtgattgcacacagtatctggcccttgcttcttaaatgacattaaatattggaggttgttgcctatcagcctagttagaactacctcattttctgcaacagccacacggtatccctggagaggtgttaataggcacacctcctctagctggatgtgaaaggatgttcaatacacagaaatcggcaattgttgcatctacacctcaagaaaccattcaggagacattgtctgcaggggcgtcttaagaattcaaatccccttggctgtgggttttcttaaatgagcttcccggtagctcatttattaaaacacttccatccacgctggtgttgttctgtggctgttcggcacaggccatgtctcatttctcaaacccagtagcttctacaggggcaaagagaacctctgggtaccaaggtgcccagtaggaaagtcaggcttagcattgctctgactggtagagaccccactgtgcaccaccagctatgtcatgttgagcacgtcttttctctctagacttcattttcctcctccgtgaaaggagagtagccacgcttacctcatgggatccgtgtgaggcttaaatgcaaatgttttcttgtccattctctctctctctttttttttttttttttttttttgagacagtttctctctgtgttgtccaggctggagtgcaatggcacaatcttggctcactggaacctctgtctcctgggttgaagggattctcctgcctcagcctcctgagtagctgggattacaggtgcgtgctaccatgcccagctaatttttctatgtttagtagagatgaggtttcaccatgttggccagtctgatctcgaactcctgaccttgagtgatccacctgcctcggcctcccaaagtgctgggattacaagcgtgacccaccacgcccagcctccttgtccattctcaattgtgtctaggcactgggaaaacaaaaatggccagggtatggttctttccttgaagggcttgtagtctaggagggagacagacaacttagctgtttaagccacagcaaaagtactgccttggaagtgtgaacagggccctgcaggctcgtagagaacgactcacctgactgcactgggtgggggaaggagccttcagagaataaaggaggactaagactttcaggaccattaaaattagactgtgaatggaactatgctaagcacttggtctgctttaatgtcagagcaagtggggaaagacaagtgggacactttaaaaaatagcttagtcattattttctgagactcagttttctcatctgtaaaatggggacataaggccgggcgcagtggctaccacctgtaatcccagcactttgggaggccaaggcaggcggatcacaaggtcaggagatcgagaccatcttggctaacacggtgaaaccccgtctctattcaaaatacaaaaaattagccgagcatagtggcatctgcctgtaatcccagctacttgggaggctgaggcagaagaatcacttgaaccagggaggcagaggttgcagtgagccgcgatcgtgccactgcactccagcctgggcaacagagagagactctgtctcaaaaataaataaataaataaataaataaataaataaaaaatggggacatgatttttctcattgttattgtaagaattcaacatgatagtgacaacgaagcactcaggatagtgcctggcactatcctagcaagaatcaaagcagtcagagtattactattaggaacaggcaaagaagcgaacatttctagagggtcagaatttgatgtgccagattctgtgctaggcattagacatgaattatttaatccacaacacaaccaaagggaagggtatccataccatgagaattaggtcgtattaatttgttccatgtttctttgggtgagaagtgatggcaagaattgcaaacacaagtttctcataaaacagcgatcacggcacctaccctccgtggttccattccgtgccaagttccacgtgagtccaatccaccattccctgtcctgggagatgtgcttctgcagaaaccactgggtgccttcgtcctgaatgaagaccaaatggcctccttgcccctcgcaccagctctgggcatcacggaaggtgcgtccgagtggcacaaattcatagcaagcatctctgaaggccacctggctgttagagcaaaagctgccttcctctggcttaacagtggtggccctaagcctcagagcaagcaccaggagtaccaagcccactgcactcatgcttgaaccactgctggggcctctggatggagctcgctcttgggactttcatatgcgggtgccctcacatccacccgtcatccatcttcccttctgtctttgcatcacataatggcagctaccttttgttgaagaaacaaaaggctcagcttgacagtgtctgcgtttttgcgtcacccagctctttgttccacgcctgctccaaagcctattaatttgtcagatggtcttctcgggaaagataaagttgctatatcacctgtctgcttatctttcagtcaactgttagcggtggataaaaagtccttgctattggttttatgtcattaccctgagggctgtatgtttcgtgcaaagccatcagcatgtgggaagtgtgtgataaaagaaaaatgggaggaaggttggagaatggcaggaaggcaggaagacggtaaagaaaccaagttgcttttatatccaagcccattgtgccgagcggcagctgtgcccaaatgatacccattctctccccagcgtggctgaaatcctaatagatatttggtcccctctctgattcaccacattattcatcacccatacctgctggagaataaaaatcccctaaaaaatttattggatgtcataagctcagaactgaccatccttatccactacttacaccttcccgtgggtttccatggtccatggatcaagttcaaatttcctagctttgtatacaaggctttgtatggtctggcctccgagagtatttccaaacacatcctcccaaatgtggagaaacaagctgtctctctgcttgctggtggtaaattggtacaacctctattgtgggcaatgtgataatatccataaaaattttaaaagcacaaactctataatgtagcaattacacatctaggaattacaccaacaggtaaattcatacatgtgtgaaatgccatatgaataagattattcttggcagaatttgttaagaaggaaaaattggaaacaacctaaatgtccattgataggaaacgggttcacaaaacatggtctatcatatataaccacttttaaaatgaacaaattcttcctctgcaaatttggaaggatccctaaggtttttgttttttatttgtttgttttgagacacagagtctcgctctgtcgcccaggctggagtacagtggcgcaatctcagctcactgcagcctccacctcctgggttcaagcaattctcgcgtctcagcctcccgggtagctgggactacaggcaggcaccaccacgccctgctaattttttgtattttagtagagatgggctttcaccaagttgcccaggatggcctcgaactcctgaactaaggcaatccacccacctcagcctcccaaagtgctaggattacagatgtgagccaatgtacctggtgagatttttgttaatattaaaagctaagtatgagatattgtatataattcagtcccatttgcataaaaacatatctaaatatttatttgtatgtgtataatatagctcataagaaacatacaagaggccgggcgcgttggctcacgcctgtgatcccagcactttgggaggccgaggtgggtggatcgcttgagctcaggaattcaaaaccagcttggccaacatggtgaaacctggtctctactcaaaacagaaaaaaattagccaggcatggttgtgcatgcctgtaatgccagctacttgggaagctgaggcaggagaattgtttgagcctgggaggcagaggttgcagtgagctgagatcacgccattgcactccagcctgggcaacaagagtgaaactcagtctcaaaaaaacaaaaacaaaaacaaaaacaaaacaacaacaacaaaacacatacaagagctggacgagatgactcacacctataatcccaaaacgttgggaggccgaggcgggcggatcaccctgaggtcaggagttggagaccagcttggccaacgtggcaaaaccccatctctactaaaaatacaaaaaattaaccaggcgtggttgcatgtgcctgtgatcccagctactcaggaggctgaggcaggagaatcacttgaacctgggaggcggaggttgcagtgagccgagatcacaccactgcactccaacctgggcgacagaatgagactctgtctcaaaaaaataaaaataaaagcccatagttggatgatgtggtctgcataagaaattagtaatctgaggttacagagggagacttgcaatgtggtgagaccctggagtgttcagaaaaggtgtaaggtatataattcctccagccagagacattagagaatgcagttgtctaatatttggctttagaccgttaacttgctctgacataagtcactctttctctttccccattgcccctcctctatcacgtggcaacctctaatctttttttttttttttttttttttttttttttgaggcggagtcgtgctctgtcatgcaggctggagtgcagtggctcgatcttggttcactgcaacctccacctcctgggttcaagtgattctcgagcctcagcctcccgagtagctgagattacaggcgcgtgccaccacgcccagctgatttttgtatctctaatctattttctgactctatggatttgcctattctggatgtttcacctaaatggagtcatacaatacgtggacttttgtgtttggctactttcacttagcatcatgttttcaaggttcatccacgttgtagcatgtacttcactcctttttatggctgaattatatcccatcctatggataaaccacattttatctattatcggttgatagacatttgggttgttttactgtgtgaatttcttagggaagggacatctcttaatctctgtctaccccatgtctggctcataataagactcaaggaatatttgccagcctggccccatctcccagttccctggagattaccctgttgcctctgtcattttcctagaaaccactgcaatccttctggagtgaccctgccagacagagaatgggaaagggctagagcccaggataggatgcaggatcgttgctgactcaggctaggacacaggctgagcagaacaggcctgttatctctagaggtcaaccttctaataactttccttcgaaaactctgtggaaagtcacacgcagtgataatagaaagggtaaaggcttaatttatgtccctaatggaagttgcttggggacatttgataacaaatgcaaatctgcaggctaaattccatgttcacattctttacattctgataaattgcagactcctgggcacagtgttcttcttgttgacatcagctcccaatgtcccttaacctctgtgtgcatgaagctccactgaaagtagtcaggacatggctggaccctgtgagcattatttccagtgatctgatccagctgtctgagcctccaagtgggatcagcaatatgaaaacagaaagacagcaagtttggtttaaataaggcattgaggccaggcacagaggctcacgcctgtaatcccagcactttgggaggctgagacaggtggatcacctgaggtcaggagttcgagactcagcctgaccaacgtaaagaaaccccaactctgctaaaaatacaaaattagccaggcatggtggcagatgcctgaaatcccagctactggggacgctgaggcagaattgcttgaaccagggaagcagaggttggggtgagccaagatcgcaccattgcactccagcctgggcaacaagagcgaaactccatctcaaaagataaaaaatgaaaataaggcattgagtccataaaaagaaccataaagatagttatgccctgttattccagttattccagtctggggaatattcccatcttactttgagtcccccagaagccaactgagaccaagattaagagcaaggagtctatttgctttttgttttcgggttttgttttttttttttgagacagtctcactttgtcacccaggctggattgcagtgtcgccgtctcggctcattacagcctccgtctcccgggttcaagcagttatcctacctcatcctcctgagtagctggaattacaggcacacgccatcacatccggctaatttttgtatttttagcagagatggagtttcaccatgttagccaggctggtcttgaactcctgggctcaaatgatccgccctcctcggtctcccaaagtgctgggattacaggtgtgagccattgcacctggcctcaaggagtctatttgggggggaatctaggaagccctggccggggaagaggagtatatttctctataggaattggcggctttatcagtcatatttaatcttggttctcctttagatcgtaaagagaacacagcagaagaattcccatggtcccattaccctaacacattttcatttcttcagggttccttcatacaccttgttcccttgaagacaggtgttttcccaggcactactgtagtgtctgtgattagttcataagcatttcctgcttagcattagacaggaaggcttttccatgttgctaatgggctttgaaattgacatggtggtggcagagcctccttttactaaatggacattgctaaatcagtcccatattgctggacaggtcatgtggattttagtcatctgtttctcatttctcaacacaactttgaacatcttcttgcatgcatgctttagcctgggctgagttatctcttgaggattgtagcagacactatcagtgctcaccctaacccacacacctgccatgcagacatctgtggctctgcctccctctgcatatgtgcgacaggatggaagtgcctggaagttagcacctctcaggagaaactctcaaccttgactgagcagaattggtgaatcaatgccctgactcctgaagataactctgaggcgtgttcccaccggctccaggagatccccagccagactgagtttcagttgctcatgatggtgataggcttgagaatgtattgttaacatcttttctcctcctttatcttaggtcctcattcccctgctgttatttcctaggttcaaatcttaggcttctccagagaaacagaatcaataggagatagacagatcaatagacacagatagatagatagatgcatagatacgtagacacatagacagatgaatagatagatggatattataataataaaaaaagaaaatcaataaataaagcaaaaaaaaaaaaaaaaaaaaaaaaccagagccaggcacggtggctcacacgtgtaatcccagcactttgggaggccgaggcaggtggatcacctgaggtcaggagtttggaaccagcctgaccaaaatggtgaaaccccatatctacaaaaatacaaaaattagcagggcatggtggtgtgtgcctgtaatcccattactcaggaggctgaggtagaagaattgcttgaacctgggaggtggaggttttagtgagccaaaggtttcagtgagccaagattgcgtcattagactccagcctgggcgacgagagcaaaaactgtctaaaaaaaaaaaaaaaaggaaccaaataggccagacacagtggctcatgcctgatgcctgtaatcccagcactttgggaggccgagtcaggtggatcacttgagaccaggagtttaagaccatcctggtctacatagcgaaatcccttctctacaaaaaatacaaaaattagttcggtgtggttgcatgcccctgtaatcccagccacgtgggagaatgaggcaggagaatcattatgatcatggaagctaagaagtccataatctgttgtctgcaacctggagaaccacgaaagccactggtctaaccctctccaagtctaaaggcccaggaaccaggagctctgatgtccaaaggcaggagaaacggatatcccagctcattttttgttctactcaggtcctccatgatgcccatccacactggggagggtgggtgtgccttactcagtacactgatccaaatgccagtcttttctggaaacaacctcacagacacattcagacatactgttttaccagctctctggggaatcccttagcccagtcaagttgacacgtaaaattaaccatcacaacctcccaaataaatttcttgctcttgaatcctacttctgggggaacccaagcctagacagacatattcccaggacgagggcacctggaccacaggggtgaatatcttcatgattcttgttgtagactcaatgccctatttaaaccaaattaattatctttccgttgctcatgtgaccgatcccacctgaagactaagactggtagatcaaatcccaggacgtaccctcgcacagccaagtggggtcctggggtcctgactgcttccctgatggcttcaattctgtacttggagaccatctttgagcaactgataacaacctcagtctttggaatgatgagctcttgattatttattgatttattatttattgatttatttattgtagagatggggtctcacactgacacccaagctggagggcagtgtcatgatcacagcataccacagcctcaaactcctggattcaattgacccacccgcctcagcctcctgagtagctgggactataggtatgtgccaccaagccaagctaatttttaaaaatttattttttagagacgggagtctctgactcagcttcccaagtagctggtactataggtgcacaccaccatccctggctaatttttgcattttttatagaggtggggtttcaccatgctggccaaaactcctggcctcaagtgatccatccacttctgcctcccaaagtgctgggattacaggtatgagccaccacgcctggccccagctaatttttttttttttttttgagacggagtctcactctgtcgcccaggctggagtgaagtggcgagatctcggctcactgaaagctcctcctcctgggttcacgccattctcctgcctcagcctcccgagttgctgggaactacaggtgcccgccaccacacctcgctaattttttgtagttttagtagagacagggtttcaccgtgttagccaggatggtcttgatcttctgacctcatgatccacctgcctcggcctcccaaagtgctgggattacaggcatgagccactgcgcccggccagccccagcgaatttttttttttttaagtttttatagagatgggggtcttggtatattgcccaggctaatcttgaactcctgggctcaagcaatcctcttgcctcagcctcacagaatgctgggattaaagccatgagtcactgcacccagccttgatagttattttttaaattgaatttttgtcaagcatccttgattgaaccctaattacatagatggtggaaatttggttttccagctcaggcatcaggataacttattttttatgcatttatttatcagcaatgccttctgtatttcaatcttatcaattcttccttctacgcatgggatattagtgctatataaattatagcacttataattgttccttgccttcttatcttccttgttagactttgaactcatttaggtcaggagataacgattctccagttttctgtctccaatactccacatgacactagtcttaactgctctgtagaatgttgtagaattaatgaatcttcttaaatattgatggcataatttatggtcttttgttcagtagcaaaggttttttgttttgttttgtttgtttgtttgtttgtttgttttgagatggagttttgctcctgtcgcccaggctggagtgcaatggcaagatcttggctcactgcaacctctgcctcctgggttcaagcaattatcctgcctcagcctcccaagtagctgggattacaggggcccgccaccatgcccagctaatttttgtatttttagtagctacagggtttcaccatgttctccaggctggtcttgaactcctgacctcaggtgatctgcctgtctcgccctcccaaagtgctgggattacaggcgtgagccactgcccccagtgaagtttttcctccagaagccccaaggacgctgtctggttacccgtgctgttctccctttgcggggacagcaggtgccacctttgaggggacttcggctgtcactatggactctgctatctaagatttcaaagatctctttgttatctggtcaacttatcgctctggctaattagaggcaccatttagaagcaaacttaattggaaaattgcaaagtaatttaaatatgataatattatctccaaaaggttaatattaactaatcttagctaatcattttgtaatcagagatatagaattacaaaataaggctgttgtgtttttaatagcatgaaaactttttgaactcgcttttatttcttaacctcatgactgttctataggctccacccgtcctgtgggacaagtggcctcagggaaggagcgacacctcttccctgccccttcccaaaatcattcaaggaaaaggatcccatggtcaaatctcccacctccatcacatattgtatgatctctgaccttaccaagtttctgctgctttgtccataagatggggataataatagttcctgccaaacagtgcctgtgcaaggattagaagattcgatgggtgcaaaatgcagagaagggggcacactctatgtgaactcccttccttctccagccccgaagttcacgtttttgctctccgcaaaaggaggaggtgaaggcattctacttcctctgagagtatcttagagcctcccaagggctgagtgtgtgtgattctactcccagccttccaccctcccagtgcaaacccaattctgctatctctggattgctacagaagcagcactgtcaacttgtgcaaacatgtgtgccttgtgaggaatccaggagatctccaacccgacaccaatgccaggaggggcctggtaaaggccttcatgcaatgcagacctccttgctctgtgtttcttcccaaggcctgtgtgcaatgcagactttctccctctatgctctaattttcttcctggtttcctctcagcaactcgcacctccactcccacaatctgttggaaattttcctgttccctccgttcctctctcttttgctcacctttcttgcttttctcccgccacagccctacacaacgcacacctctccctcccacaatccagagcaatttgtgtagcggccaccccatgtaatatattgaatctgggcacaagcaggtcctgctagtaggaacgctcttcttgtcttctccacatggccaatgcctagcaatccttcaggtcttggagcaaacattagtctttctgtgatgtccgctctccactgcgctcctccagccttgtacgatgtcccataccttcctctgttgccaagcatgctgtgttctatatttatggaaccgatgaatgaatggatacatggactaatttacatttttaccattgtcagccacggacttccctgacattgcaccctctcaactggctttccatccagccataactgccttggcctcccttggtcgcctataaatgccatcttagcagttctgctaactcagcactgtcaatagaactttctgtgatcatggaaatgttctgtgactgtactgtccagtataacagccaccaaccacacagggccacagagcccttgaaatgtggctactgtgaatgaggagctcactttttcatttaacttcgttgcaattaacgtatatttaaatgtaaatagccgagtgtgcttagcggctactgtgttgaacagcacagctaagctgtcacatgaatagcttcactgaacatcttctcctaggatgctattgcctgcagtataaaggccatattcttataaaagctgcacagtgcaatccttaatccacttaccagccccaggtagtggagatgaacatggctgcaagtacagattctagagccaagcccagctctgggatactgagcaagtttcttagcttctctgtgcctcactttccttatctttaaaatggggcaaaaccacctaaactcaggattattgtgaggaggacatggactcgtatgtgtaaaagggttagaagagggtctggcatatataaagctctcaataaatggccaatagtcctcctgcctggagagttcaccccctcctccttccccatccaaatacttcccactctcaagggctcagctgtgcaccccctcctccaggaagccttctttcctaatcctccacagcatcaccaagctttccttcctcagaacccctatgatagttcctatctgtgcctcttgtagagcagctattctaggcaactaattattacttactgtgtatgtatatggcttcacagccaggctaaaagagacttaaatcccaacgttcctgtgtattggtgtctatttttcaactgcatgcaagtaactcaaaattagtatgtttgattattatattggctggccgtttcagtttttctgtctttcccaagaaaagaaagggggaaagaatgctctgagtgcctactgtattttaagcactgtgacatacacagttttacactgtttaatttaaactttgtagccagtcaatgaggcagatgttataatttccatttcagagatcaggaaactgagggtctgagacttaagtacgtggttcagacatttagtttgtaagcggaagaactgaaacacaaatgcaaatgagtctgtcggggtagctagtttccaaagatggccccaaagggaccatatagcccagaccctatagtcacaaccttgaatggtccctcctcacggaatttttgctggccctgtgattggttctaaccaatagaaggcagtggaagctaaactatctcaattctggtgtagccttaaaaggtattggcaacttctgcttcctctctctcgtgtcactcacctttgggagacatttgatgctatgtattataagaagtttggctactgtgctggtaagatctcacagagagaaagcgaggccaaggcccagcccctctaacatcctagtcatcctagtcaattccagcaaccatgtaaggaaagctgagcaatgaaagcagaagaactgcccagctgagcccacgcaacctgcagaacttagaaagcgtatggatgattgttgttttaagccactacattttggagtgggatgttacacagcaataaataaccaaaactcttacataagatgtgccatttctctctacattgccattgcccctgttctcttatgcactggccagttttcagtcccgttttaaggcagtgaatgcattatacaaattgtctgtgaaacactcacctttgctctcctagctcttccccagccagcagctctgaaaggtgggaagcattacagttttgtggggaagaacatgtactgatcggctgttgacctacctcaagttactccacatcgctgagactataaaattaagattgctactgacatccttgcaaggatgtggagggattaaaagaaagactgctgctagaacacttagcccagtaaccagcacgtgcaagcattcagatcagaggctggaggagagcaggccaggagacagcttctactggaaccaacccctcatcccattctccccacattagtgaaaacaacagaacacaggggtcaggcctccatgggttcagagcaatgccagagcttttgaggggaagagcagctgctgcttcatgtcgatgggttttcaacatgaaggcagttctgcaaaccactgtgagacaccttcccctttgggaaatatatgtccagcctcagcctccaaacaaaaagaacatcatgagggccaaaaaaggcagagactgggtgtcattaatcacctctattccctcagagtttggcgtgtagtaggtgtcaggtccaaaaaggcacagatttgttttgttcactgctacatttccagcacatagtaggtgctcaatcaatatgtgttgaatgggccagggtcggtggctcatgcctgtaatctcaacactttgggaggccaaggcaggtggatcgcttgagctcaggagtttgggaccacttgcccaattgcctgggcaatatggcaaaacaccatttccacaaaatacaaaaaaattagcctagagtggtggcacaggcctattgtcccagctattcaagaggctgaggtgggaggatcacttgaacataggaggttgaggctgcagtgagctgagactgcaccattgcactccagcctgggtgacagagtgagaccctgtctcaaaaaaaaaaaaaaaaggtgttgaatgcactgcctgcagcggacactgtcagttgcctatcctaggccattccctcctttttccttgataatggaattctgacaagatccaggtggcaatgatgccactccaggggtgactgggaggaaattaaattaaagtttgtctgaggaaattaaagcgctcctgttcctctttgttgaggattggttaggggtggtcatgtgacacagttctattcagccaatgaggcacaagagaaaatctgctcagaggattctgggaaagatttccctccagcataaaatgagaggtctacaaagaaaactcctcttctgtccctgccttatcttcctgcttttccacatctctatgtgaggccatgatttcccaggcaacggcaatcattcataaccagaactgaacaagccaacagtgagaagacaaccttctgaggctagaagtgtggaagcccttgctaggcgagcttccgcgtcaaccagcatgccacctctcgatggcttgatgtctgcaataaatgcacatctttggagtttcagcagatgttctgctacctgcagcaaaagtgtcttcccttacacattgtgacttaatgatattgttacgggctgaattgtgttctgtaaaattcatacgttgaagccctaacaccccatacggcagaatgtgactgtatttggagatagggtcgttaaaaaggtgattaaattaaaatgagtccattaggttggcccctgatccaatataattggtctcattacaagaagaggaaatttgattgggcacagcagcttgtgcctgcagtcctagctactcaggaggctgaggcaggaggatggcttgagcccaggtgtttgagactgtagtgagctatgattgcaccactgcactccagtctgggcaacagagtgagaccatgtctcttaaataaataaataaaatttaaaaatgaaagaagaggaaattcagacacaccaagagacaccaaggatgtgcgcacagagaaagatgatatgaagacacagcaagaaatcacacctgctaccttcatctcccaaacaacctgataccttgttttttttgtttgtttgtttgtttggttttttgtttgtttggtttcgcttttttgagacggagtcttactctgttgcccaggctggagtgcaggggtgcaatcatagctcactgcagtgtcaaacacacctggctggagtggtgggatctcagctcactgcaacctctgccttgccacttcaagcaattctcctgcctcagcctccccagtagctgagattactggcatgtgccacgatgcctggctaattttgtatgtttagtaaagacggggtttcacgatgttggccaggctggtcttgaactcctgacctggggcaatccgctcatcgaggcctcccaaagtgctgggattacaggcatgagccaccatgcccagccaaaacctgataccttgatctcagactcctagcccctagaactgtgagaaaaaaaaattctgttgtttaagccacccagtctgtggcatttgctatggcagccctagcaaacttacacagatatctattgttaggcttaatttattaccaccattagttttttttgtgggggtatttttgtatgtggtgtgtgtttgtttgttttgagatagggtctctgtcgtccaggctgaagtgaagtggtgcaaacatggctcactgcagcctcaaactccctgagctcaggcgatcctcccacttcagcctcccaagtagctgggaccacaggtgtttgccaccaccaccactgccagctaatttttctatttttcatagaggcaaggtctcgctgtgttgcccaggctggtctcagacttctgacctcaagtgttccatcagcctcagcctcatcctcccaaagtgctgggattacaggtgtgagccaccgtgcccggactccatttgtattttcaaaaacctttatcttactatctaactgtcccttgggtgcagttggaacctggataagagagcttgccctttctctgatataagaatgcagtgacaccaacccaagacccaagactggtcctctcagggcccatccacccattacttcattcagtaaaaatccagcagacacccatcgtgcgttggagctgtgtagaattgtcagagtaagtactttgaagtcgggctgcctggctgtgcctcctaatttgagctgctcctcactttgagaccgagggcaagcaagttatcttccctgtactctctgaccttgagaatggtggtaggaacacacatctcataggactgtgtaaggccagggtgagccagtgcaggtaaactgctcagttgcttttctgaatatgcaaagattgacaagaagggagatcacagtcatgttttgactcatatatatatatatatatatatatatatatatatatatatataaatatatatatatatatatatataaattattattttttttttgagacagattcttgctctgttgcccaggctggagtgcagtggtagaatctcagctcactgcaaccttcacctgccaggttcaagcaattctcctgcctcagcctcccaagaagctgggattacaggtgcacaccactataccaggctaatttttgtatttttagtagagacggggttttaccatatttgccaggctggtctcgaactcctgacctcaagtgatctgcccgcctcggcctcccaaagtgctgggattacaggcttgagccaccgcacctggcatgtcttcactcatatggttttgttgtaacccttccaacaagccctgtgacacagatactgccacccccattttgccgagtgaagtgaggttcagagaagtcacgtgacaaaagctgcagggttgctgaatctcagagctgaggtccaaacccaggtcttctgacctctaagccctgagctctttcttgcaccgtggtggtgtcgtttttttcccagagcccttagagtatgccagacattcccatgtaatcctcacaagaacgcagcttccacaagctaggaataaagaactctgacatggatacacgtgtttagaccacacagcgggataaactggcaagttattggaggtcttactggaaaggtggttcatagggaaatgccctctaagagaatgggaggaaaaggtaaaggcattgtttggtaactgtctgagaccaggtgcttttgctagaccctatacaataggcttgaggtgctaatatcgttatgcctcactttatagttgaaaaaaaggaggctcaaagagggtagaatggcccagacacacagaaaatggacgagctggccaggcgcgatggctcacgcctctaaccccagcactttgggaggccaaggcgggtggatcacttgaggtcaggggtttcagagcagcccggccaatatggtgaaaccccatctctactaaaaatacaaaaattagctggggatggtggcaggcacctgtaatcccagctgcttgggaggataaggcagaagaatcgcttgaacccggaaggcagagactgcagtgagccaagatcacgccactgcactccagcctgggtgacagaacgagactccatctcaaaaaatataaaaggatgagctgcaatttttttttttctgagttggagtctcactctgtcacccacgctggagtacagtggcaccatcttggctcactgcaacctccacctcctggtttcaagtgattctcctgcctcagcctcttgagtagctgggattacaggtgcccatcaccatgcccagctaatttttgtattgtatttttagtagaaacgaggtttcaccatgttggccaggtaggtcttgaactcctgacctcaggtgatctgcctgccttggcctcccaaagtgatgggattataagcatgagccaccatgcctagccaatcagctataatttaaatttagtttcaactcaggcatgtagcatctttcctctgggtcaggtcttctcaactcctgctgcacacatgtaggtactttttattatttttttaattattattattattttgagacggagtcttgctctgtcgcccaggctagagtgcagtggcgcgatctcggctcactgcaagctctgcctcctgggttcacgccattctcctgcctcaggctcccgagtagctgggactacaggcacctgccaccacgcccggctaattttttgtatttttagtagagacggggtttcacggtgttagccaggatggtcttgatctcctgacctcgtgatccgcccgcctctgcctccgtatgttttatttttgagataagggcttgctttgttgcccaggctggagtccagtgctgctatcacagttcactgcagcctcaacctcccagactcaagtgatcctcccacctcagcctcccaagtagttgggactacaggcacgcaccaccatgcccagctaattttttttggtagagacggagcctcaatatgttgcctaggctggtcttaattcctgggctcaagtgatcctcccgccttggcctccgaaagtgctaggattacaggtgtgagccactacacccggccaacataaaaaaaaaaaactgatggctgagatccaccttcagagattctgcgtcagtgggtctggagtgaggcccagcactgatacatttagtactgccaatcaggtgattccaatgtgtgccagggcggaagcacagccagaccacacagctgtcaggaatgaacggcccaaggtgctggcatgtgctctcagcccagaccggaccatcattattctcagctgggttgcataaaggccagtgccactgccttttcttactctacccacagagcaaatgactggttctttctttaagcaaaatacgttaagatgagttcattaacttcaatcagtgcatatagcaagttgaatacgaatttcaggcaatggcaacacacgaagatacacgaataatagggaagctcagatcaaattcaggcattgttttgccctcttgataggccaggaagttgaagtttctttttaactattctgtttacttatttattttttgagacagagtctcactctgtggccgaggctggagtgcagtggtgccatctcagcttactgcaatgtctgcctcacaggttcaagcgattttcctgcctcagcctccttagcatctgggattgcaggcgtcttccaccacgcctggataatttttgtatttttagtagagacaggatttcgccgtgttggccaggctggtctcgaactcctgacctcaagtgacccgccaaccatggcctcccaaagttctgggattacaggcatgagccaccactcctggcccgtcttttttactattctttatagtttctgagaaaagcctttggttcccgttcgttattttttaaataggtacatgaaacattttatgtctccttcttccaaaaagaaaataatgaattaagtggctctttatgtatgattattagaggggagcatcggggcctttactaaaaacaaaacaaaatgtaaaacctttcccgtctctgctgaaggggttccctgctgtgcagcagacattcagtgatcacagagcttagctcaagtttctcctaattcccagcacctctgattcccagcatctcttcttgttctgatcataaacaactccagctcttggattacgtcgggcaacataacagcaggcacggaattctctctgcttatttagaacctagtctgaagcaagcttttttttttttttggttaagtcaaaagtgaaactggagagggaaagctgagggaacaataagaggattaaagattagctatgacacatggcttggaaattaacctttaaccaaacatcttataagtaacgccagcgcagcttcccttgtgaatgtaaagagatccagggctcttggagagggacaagtgagagccagccaaaaaggaaaaagcaaaggcagaaacggcatcaggagagacagagatgtgaaggagggaaggagcaggagagcaggaaggaaacgcaggaggagggagcagcatctcctgtgaacacagaggagcacctgtttgctgttaaaatcgatctccctcggcaccctgagcaatggatataatatttggcaggaataggaaagaacagctggagcctgtgagggccaaagtgacaggtgagcattctgataaacactgggctctttcttctatttattttattattttttttttttttgaggcggagtctcgctctgtcgcccgggctggagtccagtggcttgatctcggcccactgcaacctctgcctcctgggttcaaacgatcctcccaccacagcctcccgagtagctgagattacaggcacccaccaccaagcccggctaatctgtgtgtttttagtagagacggggtttcagcatgttggccaggctggtctcgaactcctagcctcaagtgatccacccacctcggcctccgaaagtgctaggattacaggggtgagccactgcacctggcttcttccttgtgtttagatggacactattttttcctgatgatataagtaatactaattgtaaattacttttggaaagtctggaaaacagtacagagaggggacacattttctgtgaaaatctaggtattcttttacacattataactccgtttgcaaagggaggagagtcagtctcactgttcccaggaaaaaagcattggaatgccccagtgggtacatagacaatgggattaatctgcaaactgctgcctgtctcagatgcatgatgtatttgtgcaaatgtatgcattctaaattagtttcaaaatgcttagaggggcgtgcatgagctcccacgcatgcacatccaccacgcacacttgcaggggattgcagagtctgatgtgattttctctcaggaactcacaggtgtgagctcctgcagagcctataggagtaggaccttctatcctttagaggctctgtgtttcgcttaatcttttatatctctttttcctcctcttttgagttgccactttcctggtaccatttcgactctaaagggcagttcctggttctggactcccgggtccccagagtggtgctcgctcagttttaagaacagctgagtcagctcaggcctgcaggcattttcatctgctagatggactggaattgttcataaggagaggacaactgtgagtgattttcgtgagaacatcagattgaagcttttcaactgagcaattgccttgggagtcttttgaaacaaaaaaaaaatagcttttatgtatatattttcctggttacaaaggtaaggcacaatctatagctatcaatctgtatatatatatagctgtatgtatattaaattatatataaattaattaggagtgcaaatgagaacatggaaggaaataaaatcagctgtattttgaaatctcttaaccactattaatatttgggtctatttcctttaactttttaaaacataggtagatcaattgatagattactatatttgtaaacagtttttcaaaaagcaaatgtatactattacatttttattttttttctcaatttgactgttcatctgtacatattttattttttaaaaagacaccccacggccaggtgcggtggctcacgcctgtggtcccagcactttcggaggccaaagagggtggatcacttgaagccaggagtttgagaccagcctggctaacatggcgaaatccctctctactaaaaatacacaaattagccaggggtggtggcatgcacctgtagtcccagctactcaggaggatgaggtagtagaattgcttgaaccccggaggcagaggttgcagtgagctgagatcgtgccactgcactctggccttggcaagagtgagaccctgtctcaaaaataaataaataaaaaaaaaccaggcaccccagcctggccaacctggtatggtgaaacactgtctttattatttggttggtgcaaaaataatcgcggtttttgccattactttcaatgcatttaattttaatttttttttttttttgagaaggagtttcactcttgttgcccaggctggagtgtaatggcgcgatctcggctcaccacaacctctgcctcctgggttcaagcgattcttctgcctcagcctcccaaatagctggaatgacaggcatgcaccaccacacccggctaattttgtatttttagctgaaacagggtatctccatgttggtcaggctggtcgcaaactcccaacctcagttgatccgcccgtgttggcctcccagagtgctgggattataggcgtgaaccaccatgcccggcctgaaattttattttaaataaaaatacaaaaattagccaggcatggtggtgcatatctataagcccagctcctcaggagactgggcatgagaatcacttgaacccaggaggcagaggttgtagtgagccaagatcgcaccactgtactccagcctgggcaacagagtgagactctgtctccaaaagaaaacaaaaaggcacctatgatacctaccttttcgtgccctggaatattttgtaccctttacacctcatgtttaatgactgcatgaaatccttggaaatgttagaaaacatgaattctagaacacgagaggctgagtgagccccaaagatcagcagcggttctcaaaggggtggccccggacctgcagcataagcatcacctgggtgctgggtagaaataaacatccttgggccctacccagacccacggggtcagacacttggggggtggagctcagcaagctgtgtgttcacaagccctcaggcgattccaaaggtaagaaccattcctctacatcaagcctccctattgacagatgggaaactgaggcagaggggcagtgacttgccaaggccaggcagcctgcagagaacaggcctcctgactctccgtccaggcctgggttgagcctaatcagttggtgacatccatgggcaaacagctaactaaaaactgtgcctgggttgacacgtccatgcagggagcacatgcaaaggttttggctttgtaactggctgtgccgacacacgtgtgttctgagacctctttggcaacttaagcatttcctgcctcagtgttcttttctgtttgatgaatgtagcctggcacctcccacatagggttgctgcaacgattaagtggtttaatccacctagaacacagtggctggtgtatgaatgcatgtaagtgttcttgtcctatctagggctttaattatattctcagatgcctctctccctgctctttctcaagcctgccccctctcctgtgccctgggtgcctgtgcctggcgccacgattatgtaggtgcccaaggcaagagacttggctgtctttttttttttttttttttttttttgaggcggagtttcactctgtcgcccaggcaagagtgcaatggcgcaatcttcggctcactgcaatctcctcctcctaggttcaatcgattctcctgcctcagcctccccagtagctgggattacaggcacccaccaccacacccagctaatttttgtattttcagtagtgacggggtttcaccatattggccaggctagtctcaaacttctgacctcgagtgatccatccgccttggcctcccctagtgctaggataacaggcctgagccaccgcgctggcctcggctgtcatttttcagtgctccactgcacatccccctgtatttagtcaaatagaggcccatcagttctgtgtgttccatctatctttgttcatccatttctctccatccctgtggaatccccgggtcctctctctggtcttcctgcctctctcagggaatttcccagtccacaatccacaccatgggtggagacaaccttcgaagctccaagttcctattccatttataacaggggtccccgaccctcgagccgtggaccagtaccagtctgtagcctgttaggaaccgggccgcacagcattacggcccgagttctgcctcctctcagatcggtggcattagattctcatatgagtgcaaaccctactgtgagcgtgaaccctgtcgtgaactgcacataggagggatctaggttgtgcgctccttataagaatcgacccctcaaccccaccatccatggaaaaattatcttccacaaaaccagtccctggtgccaaaaagtttggggaccactgatctatatggaatccagaacaggcaaatccataggaaagaagatgggtgcctgccaggggctggggtaaggggagaagggggagtgacagctaatgcataagggagatggctttttggagtgatgaaatgttctggaattaggtgatggttgcgcaacattgtgaatacactagaaccccctgaactgtacattttaaaatgatgagttttatctcaaatttttttaaattgcagaaaatatctggtcctgtccttccctattataaccatcaaaggtgccccattcttctgaggattagatcaggacccttagtgtgatcctgttgacctttgtcccctggcccccgttatttctgcagtttcattgcttacagttttcttgcttgaaaatgacggtccagtcttactaaacagcttgcccgtctcctggtcttgatcattcattcattcattcattcattcatttatgagacggagtcttgctctgtcacccaggctggagtgcagtggcgtgatctcagctcactgcaacctcccccttccgggtttaagcaattctcctgtctcagcctccagagtggttgggattacaggcacccgtcatcacacctggctaatttttgtatttttggtggaggcggggtttcaccatgttggccaggcttgtctccagctcctgacctcaagcgatctgcctgcctcacctcccaaagtgctgggattcaggtatgcctcggcatgcccagcctcctggttttggtcttcttgttttgggttcctccagaggcaagaattcaaggctaagtggtttatttggcacgtgatcccaagaaacatcaggaggaactcagggaaacagagagaaggaaaccaataaatggggcattgtcgagccattggctgctgaggccattggagctaaatcctctgggtatgacgtaaaacatgcctctcgtgatcccaactgagggcaaggcaacggcgggatttgtcccccaattctgcatccatcactgggtgagagcagcttccaggggcattacctatccgaggtgcttcctgctcttcctgcatgtaggcaaagcctgccccacccgcagtcagaaccaagcactcaggcagggagctgcaggcatttgcagaaagcagcctgtaggaagggacgaacgctgagaggacttgggtggaggcaccaacagcattttctgcagcaccctgcctctagagcagggctgtcccctagaaagagaacctatgccacacgtgcacttttaaattttctggtagaaacattgaaaaaagtcaaaagaagcaggtgaaattatttcagtggtatattttaacacaacaaatccaagatattatcagttcaacatgaaatcaatatttaaaaaattgctaatgagatggttcacttttgttcatactaagtctttgaaatctggtgtatatttcattcttatagcacatgtcatttcagaccaaccacatttcaagtgctgatagctaccatattggacagtacagctctagaatgttctttccttttgcctttgtgaggcgaatacctactctccctcaagacttagccaggttgcctcctctaggaagctgaccacaccctcctgctctcagcccacccgagggctgttctgtttcacaaagaacctttttctacgtctgtagcgttgcccctatctttttttttttttttttttaattttttgagacaaggtcttgctctgttgcccaggctggagtggagtggtgtgatcactgcagcctggagctcccaggctcaagcgatcctcccacctcaacctcccaagcagctgggactacaggcatatgccaccacaatgagctatgtttttttggggggtttttttgacacagagtttcgctcttgttgcccagactttagtgcagtggtacaatctcggctcgctgcaacctctgcctcctgggttcaagtgattctcctgcctcagcctcccgagtagctgggattacaggcgctcactatgacgcccagctaatgttttgtatttttagtagaggtgggatttcatcatgttggccaggctggtcttgaactcctgacctcaggtgatccacccacctaggcttcccaaagtgctgggattacaggcgtgagccaacacacaaccagcattgccttgaccacagtggatcttgggtgtctgtttattcatctgtctcttaatggtcagtaggcagtttgaggacagggacagtgtctccatcttggtatcctcagtgctagccaactgcccaacacattatacactttctggaaatgactgtagaataaacgaacagatgcaaggagtggtactgggaccacaactctcaaattcctttccatgaccatttcttccagcattttggtttgcaggtggaaacgggaaactaaacattctctcttttctcaggcaagattccagcatggctgcagggaaccctgctccgcaatgggcctgggatgcacacagttggggagtccagatacaaccattggttcgacggccttgccctgctccacagcttcaccatcagagacggtgagaacacccacgagtgtgctgccactgctgcagcaaaggaccccaaatgcagtgccttaaaacagcacaaatttattcttttagggattggaggtcagaagtctaaatcgggtctcactgaactgaaatcaaggtgttcatagggccacattcagttctggaggctctaggaaaaatatccacgttcttccgttttctatcttctagaagccgctttccttgacttgtggctccatctctgtcttttttttttttttttttttttttttctctgagacggagttttgctcttgttgcccaagctggagtgcaatggtgcaatcttgactcacggcaacctgcatctcccaggttccagtgattctcctgcctcagcctcctgagtagctgggattacaggcatgtgacaccatgcccagctaatttttgtacttttggtctcaaactcctgacctcagatgatccgcccacctcgtgctcccaaagtgctgggattacaggcatgagccactgcgcccggcctccatctctatctttaaagcagcagcagagcatcttgtcttgcaatctctctctctctccttccatcctcacacctcctcctctgactgactttcctgcctccctcttataaggacccttgtgattacattgaatccactcagataatccctagataatctcccatctcaaaatccttattcacatctacaaagtccattttgatatgtcaggtcacacattcaacaggttctagggatttggatgtggagatatttgtcaggggtgcattattcagccaaccgcaagcacagactttcctaaaaaggaggccaaggttctttttcaaatagttaatcttgcaaaataatatacatcctcaatcaggtaggcaagagcaggtggaagagtacaggaatcagacatgcctaaagttgaaacaggaaatggacagagctggtagctgggcgcagtggctcatgcctgtaattccatcactttgggaggccaaggcaggcagatcattcagggtcgggagtttgagaccaacctggccaacatagcgaaaccccatctccaccaaaaatacaaaaattagctggtcatagtggcacacacctgtaatcccagctactagggaggctgaggcacgagaattgcttgaacccaggaagcagaggttgcagtgagctgaaattgtgccactgcactccagcctgggagacagagccagactttgtctcaaaaaaaaaaaaaaaaaagaagagtacagagctggaaagagcaaagctgcatatattgcccattaagcaagacagagccagaccacttacacaataagccgagggatctccctgagtggaaagggaaatggataaatatagggcatcacaaataaggcgaattctgagttcaggtgtctggctcatgaggtgggatgtaaattctttgctgttggccattgagccagtttatgctacaaaatcaagagccgagttcttaaagaggtccaggatggatttagcgggcttcgggtcacacagtggacagatttgtgtccaaatgctccaggctttccaaaatttttctttaattcctgtgttctaatgtggtcaaactgggattacgttaagtctctcagcctcagtttcctcatcagtaaaatgagcttgttcatcctcccctggagagctgttgggatcattggaagtattggacgttctagcaagggcctgacacctggtagatgcttaagagattaaaaatcaccattgaccaggcacagtggctcatgcctgtaatcccaacaccttgagaggcggaggcaggagtgttgcttgatcccaggagttccagaccaatctgtgcaacatagtgagaccccatttctattttattttattttattttttatttttatttttatttatgtttttgagacagagtttcgctcttgttgcccaggctggtgtgcaatggtgcaatctcagctcaccacagcctccacttcctgggttcaagtaattctcctgcctcagcctcccgagtagctgggattacagggatgcgccaccatactcagctaattttgtatttttagtacagatggggtttctccatgttggtcaggctgttctcgaacttccaacctcaggtgatctgcccacctcggcctcccaaagtgctggggttacaggcatgagccaccacgcccggcccatcccatttctattttaatttattttaaaaaaataattaaacataaaaataaaaccactatctgtggctttgaatcccagctccaccatcctagctaacatgcacctaaactgtgtaactttggccaaggtactgaccctgtctgtctcagtctcttctgtaaaatggacatatcaatagcgtatctcatggagctgctattagatctaaacgaatgtgtaaacagctctgtattatgtctcgtgcacaacacctgctcaataagcatttgttcttaatttcatataactactggccagtcgcgatggctcacacctgtattcccagcactttgggaggccgaggcgggtggatcacctgagatcaggagttcgagaccagcctggccaacatggtgaaaccccgtctctactaaaaatacaaaaaattagctgagcgttgtggtgagcacctgtaatcccagctacttgggaggctgagacaggagaatcgcttgaactcgggaggcagcggttgcagtgagctgagattgcaccattgcactccagcctgggcaacaagagcgaggctccctctcacaaaaaaaaaaaaaaaaaaaaattatataactattaatttcttttgagctagtcagcaattattttttgaatgtgtactctatgccagtgccttgctctaacatttacacatgaatagagacacgatgggtgaaaagcgcgagctctgagtctgcaataccttgcagattttactgtgactcagctacagaatgggtggttccatattttgctgacagcactaaatcttaatgattcctttcttttctaaacagaagttcccaatgattcttggaaataaatactgttctggatgaggaacatagaaggtaaatgcaccagtggtggccgggcgcggtggctcacgcctgtaatcccagcactttggggagccaaggtgggcagatcacctgaagtcgggagttcaagaccagcctggccaacatgggaaaatcctatctctactaaaaatacaaaaattagccggatgtggtggcaggcaactgtaatcccagctacttgggaggctgagataggataattgcttgaactcaagaggcagaggctgtggtgagttgagatcatgccactgcactccagcctgggtgacacagtgagactccgtctcaagaaaaaaagcaccagtggttttccttccatgaggccttgcttccccaggctgccagctcctccatggtctctttctttcttttttttttttttttgagatggagtctcactccgttacccaggttggagtgtggtggcgcaatctcggctcactgcaaccttcgccttccaggttcaagtgattctcatgtctcagcctccggcgtagctaggattacaggcacatgccaccacatctggctagtttttttttctttttttgagacagagtctggctctgtcacccaggctggagtgcagtggcacgatctcggctcattgcaaactccacctcccgggttcacgccattctcctgtgtcagcctcccgagtagctgggactacaggctcccaccaccacgcctggctaattttttgtatttttagtagagacggggtttcaccgtgttagccaggatggtcttgatctcctgacctcgtgatctgaccgcctcggcctcccaaaatgctgggattacaggtgtgagccactgtgcccggccccggctaggtttttttgtatttttagtagagatgggggtttcatcatgttggccaggccggtctcgaactcctgacctcaggtgattcaccagcatgggcctcccaaagtgctgggattacaggcgtgagccaccgcgcccggccgagtcagttttattcacaatctggcattggctgggaaaataggaaacccaggaattacacccaatgatttgttttccctccatctttctcttagacctaggccagcgtctgagggttcatgccccattctgcttggcaggcatcattttgccaatctgtggcatagggtgggaaggcccagagtgcggggagcctgcctgaattgtggtgtcttcatcatctagcatggggcctggcccagaggggcgcttggaaactgtatatggagctgagatggtacagtgaggcagtcattgttttggtagacagaggcaatactttcccagtcaaactcttcaatatttactacaaagagggtttgctgggccctgccccaagtgtttcatgtccatccacaactcagccctccccgtcactcctgaggaggatagcctggggactaccacagttttagagataaggaatgaagtcccagagaggccaagtcacttacccagaagcacacagctaagagttggtaaagctcagacatagacgcaatactctctaacttcagaatcccaagtcctaaccattgtgcaattcagccctgtttccccttcccaccagctcctgcctccccatctctccatcccaatcctctcagtgctgccagcttgccaatgctggtgtggcatagcctggcttcatctctcctctcctctaggactctccgtggcaccccattgtctaatggtgggaagatacaccagaaatgttcagttccactctagcgggttcagaagagaacacgtggggaagttggggtccctgataagctgaaaacaaagccaataactctcaaaaagtggtttgtgtgcctcctttctcaataaagcttttttttttttttttttttgagatggagtctcactgtgttgcccaggctggagtacagtggcacgatctcagctcactgcaggctctgcctcccaggttcaagcgattctcgtgcctcggcctctggagtagctaggattacaggcatgagccaccatgcccagctaatttttgtatttttagtagagatagggtctcgccatgttggccaggttggtctcgacctcctgacctcaggtgatccacttgcctgggccttccaaagtgctgggatgacaagtgtgagccaccgcgtctggccattcagtaaagctttgaatcctgaaagctgcacagggcttgagtgcatcatagtcctcaaagatagcgtttgtgtttctaacacacttcccaggtgaccccgagccctctgaggtttgacaatccctccacaatgggcctctagcctggctgcccaggcctaaccaaaaccatgttattaatactaataatcagaagaaccatgggctagtgaatagccttctgtacctttttaaagcacccaggtgattccagtgtagatgcaggttaggtgcttaagaccaaacatctaacttagagaaaagactttggagcaagaaacaaaaaggcagaaaatagcttgtggccttcagcagaggccagtagaaattaatgctctaaaaaaaaaacaaagagggaccagaggttgtggttcatgcctataatcccagcacttttagaggctgaggtgggaggatcccttgagcccaggagttcaagacaagcctgggtaacatagtgagacctggtacctaccagaaaatcaaaaagttatccaggcgtggtggtatgcacctatagtcccagcatcttaggagactgaggcaggaggatcacttgagccttggaggcagaggctgcagtgagccgagatcacacctctgcactccatcctgggtgacagagtgagacttcatctaaaaaaaattaaaaaagaaaaacatgtaaaaaataacaaagatatgaacaaaaaaagcagagtacagagggagaagctgggtgaagggtacaagaacactcctttctgtacatctaaaattatttcaaagcaaaaagtttttacaaagcacgcatagaaatgagtgattccaagtctccctcattaatgatatctgttaattttccgataaaattaacaggcaaagtcattgtcccaccaggatttgaacattggaaagtttcttttatatatacccacacacacacacacacgcacacacacacacacacatatatgtgtgtgtgtgtgtgtatatatatctatatcttcccttcttccccaaaatatcaaacttgacctagttctagaagatcccaggcaggagcacgtctgttggcgtatgtcccttcagaaggaatgtggctaattgggctctcctgaaagcagactgctggggaatgcatggaggctccttctgtaatctcaacctcaaagtccagggtcagccttgagtaattccagacacctactttcctgtggtcaccaggcactccatgctctggggctggatgtttataggaaatgggcagcctgttcactacccagcctgggtgtttatatttctttctttctttttttttcttttcttgtgtgtgtgggtgtgtgtttttgttttgttttgttttgttttgttttttgagatggagacttgctctgtcacccaggctggattgcggtggcatgatctcagctcactgcaacctctacctcccaggctcaattctcctgcctcagcctcccgagtggctgggattacagacacccggcaccatgcccagctaatttttatattttcagtagagacggggtttcaccatgttggtcaggctggtcttgaactcctgacctcaggtgatccacctgcctcggcctcccaaagtgctgggattataggcgtgagccacagcacccagccaatatttcaagtgaacataattcaacatttcaggtcaagcaccttagccaatgccttgtgggtggtgactcccagcaacagtaaccagtgaaagacaggctggctcaaaggggagatcagggtggccttaagtgggcctctgtctccatgtagcatgtagctgaggaccagtgagtatgtgtggccttgctcacccacagatgagtccgcctgccacccggattttcttggacaatgcagtttcaacagcctttgtttacgaagtgcatgctgggagtcaatgcgcaggaccccttacattaccacatctcatttaaaactgcccacctcaccacttgaggtcaggagttcaagaccatcctggccaacatggtgaaaccccctctctagtaaaaatacaaatattagccaggcatggtggcaggcacctgtcatgccacctactcaggatgctgaggcaggagaactgcttgaacccaggaggtggaagttgcagtgagccgagatcgcactactgcactccagcctgggtgacggagcaagatgttgtctcaaatataaaaaataaagataataaaactgcccacctagaaggggaggactatgtgattcccagcttccagtcaaggagactgaggctcgatgagattaagagacctgcccaaggtcacccaacctggatgagatgaaacctagagccgaagccttgatcactctgtctactgcatctcaatactctacgcagcttttcttgagcacctactatgtgcacagtgctttgcaagcctcaaatgtcacgtgactctgcaaggactgtgtcacgatcctcatgtcatagtggaggggacagattcttgactgttaccaaggtcaagtgcatggttggtacatgatgaagccaggattcatatccatgtggagattgagcctccttagcaacaggaatcctggccattctgctcattgttatattttcactcctggcccatcagggcagttaataaataatggttgaaagcatgaactcagggcctggtcagccccaaagctcaggctcctaaccgttcctccatatttctttctgctgcccaggaataaatctccccctacagaaatatctcagtgaggctgggcaccgtgcctcacacttgtaatcccagcacttcaggatgccaaggcgggaggatcgcttgagtccaggagttcaagaccagcctaggcaatatagcaagatcccatctctacaaaaaataaaaaattagccaggcatggtagcacgcacctatagtcccagttacttgggaaactgaggtgggaggatcactcgagcctgggagattgaggctgcagtgagctgtaattgcgccactgcccttagcctggtgacagcaagaccctgtctcacaaagaaaggagaaagaaatatctcagtgacacttattcacacagtaaccacccctgaaaagatgtttgcataaaggctagatgattgtctcttaggaacacaaataacctcctgaagactggaggaggaactagcaggtctttcatgatctccctcaattttattttattgtatatttttttctttgagatagagtctccctctgtcacccaggcaggagttcaatggcacagtctcagctcactgcaacctctgcctcctgggttcaagcaattctcctgcctcagcctcctgagtagctgggactatgggtgcgtgccaccacgcccggctaatttttttttttttttttttttttttttgtatttttagtagagacagggtttcaccatgttgaccaggctggtctcgaactcctgacctcagacgatccgcccatcttggcctcccaaagtgctgggattacaggcataagccaccacaccaagcatttttttttttttaatagataagggcttcctacattgcccaggctgatctcgaacacctagcctcacctttttatgtgccaggacaacaagcctgagccaccacgcctcccctcaattttcttataattagtgttactattattgtcattatgtccatccaagtgcacaggtgggagtcattgccactggaatgtacattcaaatcctttggcaatggacatggaaacacaaccccaagggcaaaacaagttgaaactcttcaaagtcaagatagcggttaccctggagggggaagaggttagtgacaaggtggatatatgaggctagcgttcagggggctgctctggtcctgtttctctttttgaggcagggtcttgctctgttgcccaggctgaagtgcagtagtgcgatcttggctcactgtagccttgacctcccaggctcaagtgatcctcccgcctcagcctcctgaacagctgggactaccatacccatctgatttttgtattatttgtagagatggggtctcgccatgctgcccaagtagtcttgaactcctgggctcaagcgatcctcccctctgggcctctcaaactgctgggattacaggcatgagccattgcacctggccccaggtcctgtttcttgatcaggatgtagtttgcgtgggtagctcccctttgtgaaacctcagcaggctggatgtcatcaagctgcacatctctgtaggagtgattttaattggaaggtgcagacagaacactcaaactgattgttcttgctgtgttaggatcttggttaagagggccagctttagatgcccattgctggccttcgactccagattaccactcgctagctgtgtggcttaacacaagctgcttaacctctctgtgcctcaattttattagctgggaaataagtctgcagggctgtgagtacccaagccctttgtacttcatttggtaaaaaagttggaacctttaagcactgtttagatcttgctttattttgctattaattaacaaatgacattatgttatttttttttattttttatttttttgagatggagtctcgctctgttgcccaggctggagtgcagtggcgtgatctcagctcactgcaacctctgcctcctgggttcgagcgattctcctgcctcagcctcccaagtagctggtagctgggactacaggtgcctcccaccacacccagctaatttttgtatttttagtagagacagggtttcaccgtataggccaggctggtctcaaactcctgaccttgtgatccgcctgcctcagcctcccaaagtgctgggattataggagtgagccaccatgcccagcctttctttctttctttttatttatttatttatttatctttgacattgagtctcgctctgttgcccaggctggacttcagtggcacgatttcggctcactgcaagctccgcctcccaggttcaagcaattgaacctcccgagtagctgggaccacaggtgcccagtaccccggctaattttttttgtatttttagtagagatggagtttccccatgttggccaggctggtcttgaactcctgacctcaaatgatccacctgcctctacctcccaaattgctaggattacaggcatgaggcactgcgcatggccgatttttttttttttccagcgaatgcatttctggttggagtattctacttgcttccagtgttgtgagtatgaaaccagataacacacatcaagtgcccagcacagtgtttagcatgctggtgctcaatcgatgctggctgttagtactagtttccttttcctaagatatcaaaaggcactgggcgagaatttcttggaaacatgttttctcctctaagcccatcctgtggcagtcaacatatgatgggcgtttctgaggtcaactttttgcttattggaatgcaatgtcactgtgtcccaggcttggcttttccgtgtgttgtaattgtagcaacactggaagcacatactataccacgaaaatgaaatgcgttctgtaaaaggaaaaaatcttaatgtcatttgcgaattaacagcaaaataaaataaaacactgcctctttcaggcccctccccgaggtttcaaactgcccaggaaataaagttctcagggctggtgcggtggttcatgcctgtaatcccagcactttgggaggccgaggcaggcagttcacccgagcttaggagtttgagaccagcccggccaacagagtaaaacctcgtctctactaaaaatacaaaaattagtcggacatggtggcacatgcctgtagtcccagctatttgggaagctgaggcaggagaatcgttcgaacctgagacgtggaggttacagtgagccaagatcgtaccactggactccagcctgggcgacagagtgactccatctcaaaaaaagaaaaaaaaaaagttatcaggcctgcaaacctagtaggacccctcaacccatttcccaatttcatttcactcctgtcctccaaatccctctctaatgttccagcccagccgaactcaacgcctgcaagaagggttctgcattttcccaactccaggcctttgcttacagacctcttagcgggtgaacaggacagctctgccctctctccccagcatattgcagtcaaattctactcatcctttaagagctgtttcatgcaccacctcctccctgaagcttctcctgacttattcccagctgggaaggacctcctctcacccctgccccaggaggaatccatggatgtgggttttttgttgttgttgcgtttttttgtttatttgttttttgagacggggtctcgctctgtcgtccaggctatagggcagtggcgcgatctcggctcactgcagcctctgcctcttgggttcaggcaattctgtctcctcagcctcctgagtagctgggattacaagggtgtgccaccacacccagctaatttttgcatttttagtagagatggggtttcaccatgttggccaggctggtctcaaactcctgacctcaggtgatccacccactttggcctcccaaagtgctgggattacaggcgtgagccaccgcacctggcctagatgtgttattttacatagcaaaagaaacttcgcaggctaggcaaacgcctgtaatcccagcactttgggaggccgaggcaggtgggtctcctgtggtcaggagttcgagaccagtctgaccaacatggcaaaaccctgtctctactaaaaatattttaaaaattagctgggcatggtggcacatgcctgtaataccagctactcggggaggctgaggcaggagaatcttttgaaccagagaggctgagcttgcagtgagccaagattccaccattgcactccagcctgggtgacagagtgagactccatctcaaaaaaaaaaaaaaaaagagagagactttgtagatgtgattagatgaaggatcttgagatgggggaggtgatctgacattagggatgggcccagtgtaatctcaagagagaagcaggagcgtcagcctcagaggagatgtgataccgggacaggagacaggggtcacagtgacgcagccatgaccagggaaggcagcagcttctcaaagctagaaaaatcaaggaacagacctcccctggagcctccaaaaggaactagccctgtggacaccttgattttagctctgtaatccccatttcagactttcttccaaactctgagataatgactgtatgttgtgtgaagccactaagtgaggggtaagtcgttacagcagccgtagaaaactaacacgggtctagaaccatctggtatattttgaggttggtctcaatggactggtcaagagatttatgccatgagttagactctctgcagaatttggatgaattagacattgaacacaggtctgaccctctattgctatgcaggattgggcatcaggtcacctcctggttgtgttcaatatcaaacgttactccagggagactgaagtgatcaactgggcttctggaggcagcgctcccaggactgaacggggccctggggaaaaccaccccacatatgcagccttctagattagtcctccagctctgctccttccctggagggacacaaacagggtggaagggatgactgattctggtcagcactctcagatgggtgaccctgggcaaggtgaaagaatgtttctgagcctgagttccttcctatggaaaatggagctaagaacagacatattttgcattgacatattttgcattatcacattttgcattgctataaaggaatacccaagaccgggtaatttataaagaaaagaggtttatttggctcacggttctgcaggctgtacaggaagcaagccaccagcatctgtttggtttctggcgagggcctcaaaaagctttggctcatggcagaaggcaaagggggagcaggcatgtcacatggtgaaagagagagagagagaggagggagggatcttttaaacaaccagatgttgcatgaactaatagagtgagaactcactcatcaccagaacaacactaagccattcatgagggacccacccccatcacccagacacctcctcctaggcccacctgcaacatcacaggcttcaacatgagatttgcaaggaacaaaacattcaaaccgtaacacatacttatccagccatactgttgtgagtcaggagtgagaaaatgtgtgtctaaaattatattccaggccgggcatggtggctcacgcttgtaatttcagcactttgggaggctgaggcgggtggatcacctgaggtcaggagttcaagactagcctggccaacgtggtgaaaccccatctctactaaaaatacaaaaatttgctggtcgtggtggcgcatgcctataatcctagccactcaggaggctgagtcaggagaatcacttgaacccaggaggcggaggttgcagtgagccgagatcgcaccattatattccagcctgggcaacaagagcaaaactcaaaaaaataataataataaataaaattatatttaaaatgcgaattgtatcggccctgtgtactaaaggagcttgtcctagtgaaataaccaccttcttctcccagtaaaacccatacaaggactgacattgattttaaagccctgtgaaggcgtcagcctgagattatgctggttcttctcttgcaggtgaagtctattacaggagcaaatacctgagaagcgatacctacaacaccaatattgaggcaaacaggattgtggtgtctgagtttggaacaatggcctatccggacccctgcaaaaacatattttccaagtaactgcctattttaaatctgagcaaatttcatgctttttgctatccttgatggctgaaataaccagcatttgctcctctgacaattctctttagggtagatgaaaactccacatgactgccctttaaccagaggtgctacacagttcttgatcactgattgccagagagactaagagcatttgacaaattattagaagccctcccacatggctggtgggaaagcgatttggaatcatctgtcaaaattataaatgcgtattcccttcagcctagagatctgcttacttgcatagaaaatgacacatgcaccaggtatttgtcatttatggctgcatcatttgttataacaagtagctgaaaacaacccaaatgttcattaaaagaggactggttaaatccgtaacagtaaaactgtacgagaaaatgccatgtagaagtaaaaaggaatgaggatgttctctttgcactctacagaagcttttccaagatagactaagtggaaaaaaaaaaaaaaaggaaggtgtagaaagagcatgttataagctgtactttgtgtgaaaaagcagtaagaaatctaaattaaattttgcttgtacatgcataaagaaactaggaaaggatgcacaggggcagatggatgttgaggagagggagagattttttgctgtatatattttatttcatttcatttcattttattcatttatttatttatttaagatggagtttcactcttcttgtccaagctggagtgcaatggcgcaatctcagttcaccgcaacctctgccccccaggttcaagtgattctcctgcctcagcctcccaagtagctgggattacaggcacccaccaccacgcccggctaatttttatattttcagtagagacggggtttcaccatgttgatcaggctggtcttgaactcctgatcttaggtgatccacccaccttggcatcccaaagtgctaggattacaggcatgagccactgcgcctggccactgtatacattttaaatcatctggattagtatccatatgaatgtgttacatatctgacagttaaattcttggccagggaatcaggcctgccatcagtatcttctttctgaaactctctagatgtagaagagttatgaaagagttgaagggtggactggcccagagatggaagattgcttctgcttttttgagaactgaagtcatctctcccattccagtatccagctctagggctagctcagagcaagcactgaattcacatttgcaaataggaggtgtggagtaggagccagtgagaaaggaggaggaaagagcaaaggaatttaaaaccaccatacttacctggtaggggagatagcaggatcacgaatttgaaaccacgacctggaggtcctggaaccaagcctcctttttgttccagtgtttgccagtaggaggagcactccccaatacaccgatacaggatttgccaatttcatcacccataaacccctctggtttttctttcttcttgctttgagtataccttctgatcaaatgagctatgtgttcttaactcataattagtttgttttcctttttaaattaaaaactaatttcctggataaattcgagataaccagtgtggactcacattcctggcaaagcagatatcagctacgttgttaggctttgggagccgttacgggttcatatacgatttccgtagagcttcttgacatactttggaacagtatgtcttgctggctctgatgttagagacctttgggttttggggagcccaggaggatcagctggtgaccatggcattccggccgactcatttcttagctaactcaacgtggaggtgtctttggggtgtctgagttcttaggattcctcaggtgacccattgggacccagttgctttttcttccttagttgaagtaaagcattttttttttttctttgagacagagtctcgctctttcgcccaggctggagtgtagtggcgccatctcggttcactgcaagctccgcctcccgggttcacgccattctcctgcctcagcctcccgagtagctgggactacaggcgcctgccaccacgcccggctgattttttgtattttttagtacagacggggtttcaccgtgttggccaggatggtctcaatctcctgacctcgtgatccacctgcctcggcctcccacagtgctgggattacaggcacccggccgaagtaaagcatttttaagtggtaggaaaactaaagccatcaaggatagacttctctggctgggtggacatagccactgactctgttgatttgcttttctccccagagctttctcctacttgtctcacaccatccccgatttcaccgacaactgcctgatcaacatcatgaagtgcggagaagacttctacgcgacctcagagaccaattacatcaggaaaatcaacccacagactctggaaaccctggagaaggtatcaacacatatgtaaccagcatcacttcctgactcaagaaagggagagtcggcgacggccggggtgaggttgctcagcctgcaagcagcttaccaggggagcccctcctctaacaccgttggatcccgtgccctagcgccacacttactgctagatgctaggcagggactgtgttgtttttatcttcgtgtctgtatcagtttcctggggctgatgtaaccaagtcctacaaaaaagattgctttaaacaacagaaattggctgggtgtggtgacctacacctgtaattccagcactttgggaggtcaaggtgggcagatcacctgaggtcaggagtttgagaccagcctggccaacatggtgaaaccccatctctaccaaaaatacaaaaattagccaggcgtggtggcatgtgcctgtaatcccagctactctgaggctgaggcaggagaatcgcttgaactcaggagggggaggttgcagtgagcccagattgcaccactgcactccagcctgcatgacagagtgagactctgtctcaaacaaaaacaaaaaaaaaaaaaaaaaaaacaagacaaacaaataaaaaaacagaaatttactctctcacagttctggaggttaaaagtctgaaaccaaggtgtcagcccggccatgctctctctgaagactctagaggagggtcctccctggccccttcctggcttctagcggttgccggcaacccctggtgttcctcagcttgtagatgcatccctccagcctctgcctcagtcttcacactgcctctccttatggggctatgtgtccaaatgttctgccttttttttttttttttttttgaaaaagtgtcttgctctgtcgcccagactggagtgcagtggtgcgatctcagctcactgcaacctccgcctcctgggttcaagcgattcttctgcctcagcctcctgagtagctgggactacaggcacgtgccaccacacttcactaattttttgtatttttggtacagatggggtttcaccgtgttagccaggctggtcttgatctcctgacctcatgattggccctcatgattacaggcgtgagccattgcacccaaccatgttctgccttttatagagacacaagtcattgcattagggcccaccccagtgcagtatgacctcatcttaacttaatgacatctataaagaccttatttccaagtaaggtcacattcacaggtacccaaggtgaggacttcaacctatcttttttgcaagacacaattcaacccataactctgttcataattcttggcactgagggagttcactgagaatttgaatgaatgactgttgaaatgcctgcgattctcagcaatcctaccttctattgacctgaagagggaggcattaggcaaaaagctagggcacaaaaatcagtgcccaagcacatacctttcctgggaagaatcaagtcaacattttggtgggaatcaatagacccactttcaattttctccagctggctgttcaaaattccgatgtctctgcaatacgttttaacgatctgttaaagagatgaggcttttcttagctgtgaaattatgtccagctccttttaagctagacggcatcggtccaactgatgatgctttccacagggctacagagaggaaatgctggaagagaaaggagttatctgactctgggctggaggttgtgtttttctaggggaggaagcgcagacggttggtctgcggccactccatcattctgcagctgtggactgcagagtgagggtcattattcagctcgttgatcaaacttcactttgaccaaatgtttttgtaacctctccattcccagaataatcgtctaagagaggcctagagatttatgcttctgtgcaatgcaaaagggcagaatttaagccagaatgacagaactgtggccaagattagctcgaaggctacctctctgcccaggtcattgctcagagctttctgcagtgaggaatcttgtttccatgttgaggattccagcaaggtcaggcaacaggattggaacgatagccacagaagcacaccagctccctaactcccctgcaacctattagctgtctgagtccctcaaatccccatgtgaggttgtataaggtcacaagagtgaaagtcttctttaaaagcaaattctgtatcgttttcagatcaacagagtgcaaaaatatccctcatctctctgaacctagaatcagtcacgttttcataggacttcaacctttctcctttgaaaaaccagatgatgtcatatcttgcaggttgattatcgtaaatactttaaaaaacaggaggtgtcatatcttgcaggttgattatcgtaaatacgtggcggtaaatctggcaacgtcacatccccattatgatgaggctggaaatgttctaaacatgggcacatccattgtggaaaaggggaagacaaagtatgtgatttttaagatccctgccacagtaccaggtaggccactctggggaattgaataaaacacaaacaaccaagtgtggcttcttctgaagagttctgtttttcgttgatgacacaagatccagtgtggtactttctcccgtagattattgaggtggaccatgaagtcagtactttcctttagaagagaagaggagatgctgggattcctcttggaagaaagaaatccctttactattctaatttccttttatttaggctccagtttattattttattaatttatctacccatctaccatccatccatccatcatctatttaccatccaaccattccttcatctaccatccatccattcatgcatctactcaccgtccatctatccaccattcattcagctactcactatccatccacccacctacccaccattcatccacctatccatcacccatccaccatccgtccacccatccacctatccaccccttatctagccagccactcaccatccatccattcatccattcacccacctacccatccacccacacaccatccctccatccatccatctacccactatccatctacccacccatccacccatccacccaccatgaatccattcaaccatctacccattctcccatccatccacccatccaccatccatccattcatccatccacccaccacccatccaccatctatctacccacccacccgcccacccatcatgaatccatttatccatctacccattctcccatccatcaacccattcacttacccaccatccatccatccattgagcttcccacccacccatccatccatcattcatccatccatccacccacccatccaccatccatccattcatccatccacccacacaccatctacccatccatccgtccacccaccatccatccaccatccatctacctacccatccacccacccaccatgaatccattcatccatctacatgttctgccatccatccactcatccacttatccaccatccatccattgagccacccacctgcccatccatccatcattcatccatctacccaccatctatacacccaccattcatccatctatccatctaccatccatccatccacccacccaacatccatctaccatgtgcatctaccacccatctattcactcaccatccttccatccaccatctatccatccacccaccatccatctgtctactatccaccgattcatgcatgcacccacccacccacctatcgattcatccttccatccattcagtttttcagtctcctgacaaaactttctatgacaaggttatgccacctactttcattcctagcccctgcagccaagtttccagggctgtttagggagctcagtcctgctgggatccactccagatccctgccctgttctccaggccttctggaccttctccatgtggggctgggatcttggagcaaagcccaggctgactgtgattgcatgatcctgagggggaggaggcggaggctcttagcccatgtttgtccaggaccctcctgggaaccacacccaggagacctaggcctgtgaggacagctgacaggactcaggagacagtgcagaactacaacggtgcttcctctgaccttctagtttaaaaaaaactagtttctgcctgtgatccttgctgctcccccatcccccactgtcttgtagagccccctgagcaaactaccaggcactgcctggagatatgagccttcgaggtcagaaggtacacggagtgtacttgctaaatagaactctcattaattaagccagtaaagggatataggggtcaagctcagaatcctagaatgccatacctggggattgtctaggcatttgagtttgccaccttgtattacagaggaggactgtgaggctcaggggatcagatgacacaccccagtcacacagctcccaggagccactgacatcctgcaagcagagatcctctgagcacctgctccatgctggcggtggcactgcgactcatgccccatcctgctcctcccaggccacagtgcttttcgtttcagtttgcattgtgttccatttgttttataaagacgataactatcccacaaccccacagcatccctcccaccagccagctgtttacagggtgcacaggtggccacaagagaggtggggaagtttgcagataactcattataagccagccgtaggcctgggtggggaggccttttgaccagcgagtgactcatgcttgcagaggaataagaaaactgaacacgtattgagcaccttccatgtttgggtgcagggcgaggcacatggatgactgctttatttcattctgttctctaccttcactgtatgagagtcgtaatccctgataaaagaggaggaaggcgaagggggctgtgttttcttggcttaaccctatgactctgaccataatgatagcccattccactaagcctcagtttcccatctataaaatggccattctacagccccgcttgactatctgcatttatataaaacccctaattatggccgggcgcagtggctcacacctgtaatcccagcactttgggaggccgaggcgggcagatcacctgaggtcaggagttcgagaacagcctggccaacatggcaaaaccccatctctactaaaaatgcaaaaattagccaagcatggtggcgtgagcctattgtaccagctactcgggaggctgaggcaggagaattgcttgaacctgggaggcggagattgaagtgggctgagatcgtgcccctacattccagtctgggcagcagagggagactctatctcagacaaaccggtggaggcaggatttagcccccaggctataggtgaagaccccttacctggagggctccctcttggttcagtggttttcagattgtatatggggtgggtgctgagtggaaggtctcagcctggccccctgcagcagctgcagcaaccttgttgtctgtctacacgttgctgtttaatgtaaaggtttttttcagcaatcaagtcagtttgtaggtgatggtggtgtggtcttgggggggcagccagatcctgcacaattcctgaggcttgctttttgtcttgctagagggcaagaagcaggggaagagcccctggaagcacacagaggtgttctgctccatcccatcccgctccctgctctccccaagctactaccacagctttggagtcaccgagaactatgtcatcttccttgagcagcctttcaggttggatattctcaagatggcaaccgcatacatccggagaatgagctgggcctcctgcctggctttccacagggaggagaaggtgaggtctggctggactctagcccagtgggtgctggctgaccatggagggaggctggtgtgcaggagggtgaagtttaaggcaaggaagtggcatggaagagggaggaggctaccagaggcatctacccaccttccagcaagttctgaagctggatggtccttcagaatggcccccaggcctttgtacccccacggtgatgagttattggatgaggctgtccaggcaagggggtgccatcttgggcaaacatggaagccctggcagtccccatatgcccagcagcaaaaggagtgagtcctcagtccttatggagagctgggctcctccccacctccgccctgttgacaagaccccttaaccatgtctgctaccagtgtgtagcgttggggcggtagcggccagaggtttagacattgtaatgacagtatgttccaccagacagttcaatagaaacctctccttccattcaggtacacctgagtgctcaaagtatgtatgcacgtattgcatgcttgtatatgcacatatgcatgtatatgtgtacatgtatatgtgcatgtatgtgcatatgtgtatgaatacatgtacgtgtgcatgggtgtatgtatgtattactagtgtttatttacttgttgggtttttattgtgggggggttgtttttgagacagagtgttgctctgtcacccaggctggagtgcactggtacaatcacagctcagtgcaccctcaacctcccaggctcaagtgatcctcccaagtagctggaaccagaggcacatgtctctatgcctggctaattttttgttgttttgtagagattggggtcttgctatgttgcccaggctagcctcaaactctggactcaagtgatcctcctcccttcccctcccaaagtactgggattacatgtgtgagccattgcacctggtctttttttttttttttttttttttgcgttgtcacttcacttttgtaaaatatccagtagttctcagtgttacctattcaaagaatatacaagtatagaaagccatgtataaaatcctccccaactcacttcccccctcctgcctcccatccacccccacgtctgaagggagccactgctacccactgacactgtgttactccaccatctctgccttcacgtgcacttttagtttttcttttttttttttttcagatagagtctcactctgtcacccaggctggagcgcagtggtgcgatatcagttcactgtaacctccgcctacgtatcaagctattctcctctctcagcctcctgagtagttgggattataggcacacgccacaatgcctagtgaatttatttatttatttattttttgagatggagttccatgcttgtcgcctaggctggaatgcaatggcacattcttggctcactgcaccctccacctcctgggttcaagcgattctcctgcctccacctcctgagtagttgggattacaggcaagtgccaccatgcctggctaattttttgtatttttagtagagatggggttttgccatgttggccaggctagtcttgaactcctgacctcaagtgatccacctgcccggcctcccaaagtgctgggattacagcatgagccactgtgccctgccaaggctccagtcttagatggagcctggcacctggcagattctccccaacttggtcattgccagggagctgggatgtcaggacaatggaacaaggggaccgtgcacactggagcgtctctccaaacactgtcctcctagtgactgcaaagactctggcagcaaagcatccctcctctccatctgaaagatatacttatggaagtacaataaacagctctcattttggggggcacttttgcctgtctggtgttgtggagcacacacagaatgcagaatggggacatagtcctgagcctagctcctggcggggctgggttttgttcagcccccagatgccacagtgccaggctgagagagggtgagctgagcccttgatatgtgtcctttttcagacttatatccacatcatcgaccaaaggaccaggcagcctgtgcagaccaagttttacacagacgccatggtggtcttccatcacgtcaacgcctacgaagaggacggctgcatcgtgtttgacgtcattgcctacgaggacaacagcctctaccagctcttctacctggccaacctgaaccaggacttcaaggagaactccaggctcacctcggtccccaccctcaggaggtttgccgtgcccctccacgtggacaaggtaatggcttccaaggaggtcccttttctttctagagagatatcggcccaggtgggaagttactttggcccttatttgattgacattgaaatccaaatgaactgttcttgaaaaaaaaaaaagttttcattgtttttcccaaagtagtaccgattcataataaaaactttagaaaatatagataagtaaaaaggagaaaaaaatccctataaacctaccaccgaagatgatcactgtggatatatatgtttgtctcccagtctctctctctgtgtctgtgtgtgtgtgtgtgtgtgtgtgtgtgaatcttcattttaatcatattgtacataatttttttttttttgagacgtagtctcgctctgtcacccaggctggagtgcagtgttgcgatctctgctcgctgcaagctccacctcccaggctcacgccattctcctgcctcagcctctggagtagctgggactacaggtgcccgccaccatgcccagagaattttttgtatttttagtagagacggggtttcaccgtgttagccaggatggtctggatctcccgacctcgtgatccacccgcctcggcctcccaaagtgctgggattacaggcgtgagccactgcacctggctgtcttacataatttttaacagctttattgagatgtaattgacacagcatacaatttgcccttttatttatttttttttttattttttttgagacagagtcttgctctgtcacccaggctggagtgcagtgccatgatctaagctcactgcaacctctgcctcctggattcaagcggttctcctgcctcggcctctcaagtacctgggattacaggcgcctgccaccacgcccagctaatttttgtatttttagaaaagacggggtttcaccatgttgctcaggctgttctcgaactcctgacctcaggtgatccacccaccttggcctcccaaagagctgagattacaggcgtgagccaccatgcctggcctaatttgcccatttaaagtgtttgacagcctttggtatgttttcacagttgtgcatccaccaccacgataaattttagaacattttcatcacctccaaaacacaccccacaccccttagccatcacctcctagtcttcccctccctgccccaggcaacctgtcatctgctctctgtctctgcagacttgccctttctagacatcacgtataaatggagtcttacaatacgtgatcttttgtgtccggctcctttcacacagcacagtgttgtcaaggctcatctgtgttgtagtccgtataagtgcttcatttctttttgttgttgttgttggtttttgcttgtttgtttgttttgagacagtctcgctctgccgcccaggctggagtgcagtggtgtaatctcggctcattgcaacctctgcctctgaggttcaagcaattcttgtgcctcagcctcctgagtagctgggattacaggtgcccaccaccatgcctaagtttttgtatttttagtagaggtgaagtttcgccatgttgcccaggccggtcttgaactcctgaactcaggcaatctgcccccctacgtctcccaaagtgctggggtttcaggtgtgagccacagtgcccggccagtacttcatttctttttatggattaataggtacatactatcttacagactgcttttcttttctttcttttttttttttttttttgagaaggagtctcgctctgtggcccaggctggagtgcagtggcgcagtctcagctcactgcaagctccgcctcccaggttcaagccattctccttcctcagcctcccaagtagctgggactacagacacctgccaccacgcctggctaattttttttttgtattttttagtagagacagggtttcaccgtgttagccaggatggtctcaacctcctgacctcatgatccgcccgccttggcctcccaaagtgctgggattacaggcgtgagccaccgcgcccggcccagactgcttttctacctatttatgtatcgaaacatctctccatgacattaaatattctttgaaacatcactttaaacatttgcctaatcgttcatggcagggattcatcaccatttgcttacacaattctctgatgttggaagttccgttcttgcactaagaatgaccaccaggccagacattatccccaattagggtgatgtggcccaggctctgggctttacttacagagacttacaaaggcttctggctccagaactcactgacttcatgacttaattaatttaagtgaaaccaaattcaattcaattaaatgttgatggcttacattgactaaatgcaagttatgtgccaggtactttgctaagcattttgtttttcttacctcacttaatgatcaaaacaacctgtgggaaacgtccctgtagaagcctcattttacagatgaacaaactgaggctcagagaagttaagaaatgtgggcaaggtcacagcccagagtggcagagccaagactggaacctgccccagtctgtctctaaacccccattttttttttctttttgtgggggatggagtcttgttgtgtcacccaggctggagtgcagtggtttaatctcggctcactgcaatctccgcctcctgggttctagcgattctcctgtctcagtttcccaagaagctgggattacaggcatgtgccagcacacacagctcattttttgtttgtttgtttgtatttttagtagagatggggtttcaccatgttggccaggctggtcttgaactcctgacctcaagttatccacccacctcggccttccaaagtgctgagattacaggcatgagccaccgtggccggccctaaacccctgtttgtaactacgaaggaggaggaactctgctattctccccagtagccctaagtcctaggaaagagcctcagatgggccacacttggcactctgcaggcctggcagacggtcctacagtgtccagggagccttttcccacccttaccgcccagtttctcagtgcaggaattcagccaccctcccagccagcgggcaggggagctggcgtttgaactgaggtttgtctgactccagagctggggtcctctcccatctctccagcattttcccacccatggccatttgtgtgtctctgccatggtttttgtcatattttatatcacctctacttaacatttaaaaatccttttttttttttcatttcaatcaattcactctctacttagctcatttgaaaggaaacacatcactacccagtagaaagctggcaatgcttgctgcacagagaagacaagcatgagaataaaatagtggaaataaagcagaggtcttgagctccagccagagggctgtggcttaccaagacctgatctctctgtgaaaaagccaagttttaaaagtattaggcattaaagacatcgtggcaccgcactgagactctccttgacctagtcagaacaactggaagagaaaaaggcattgattttctcccctatgtgactcagggctattggatgaacagccacgtcccatgaaatcagcacatgagccctgggcgcctgcaccccttgctccagaagcaccgcagtgcagcccctcagactttctcctggttccaggaagtactgaggagtaacaaggcacaaaggtagtaagtctcaaggctgacctcagcctagggatagtacacagagaggaacatactccctcccactgccacaccttacaagattttataaccttttgtcatgctcgagaatgctttgctgccttggaaccaagctaagaatgttagcttgtgtatctttttttttttttttttttttttgagacagagtctcgctctgtcgcccaggctggagtgcagtggcgtgatctcggctcactgcaagctccgcctcccgggttcacgccattctgctgcctcagcctccctagtggctgggactacaggcgcccgccactacacctggcttattgttttgtatttttggtagagacggggtttcaccgtattagccaggatggtctcgatcttctgacctcgtgatccgcctgcctcagccttccaaagtgctgggattacaggcgtgagccactgcgcccagccccctagcttgtgtatctttaaaagccatcaggtgttcaggcacagtggctcacgcctgtaatcccaacactttaggaggcccaggcaggtgatcacctgaggtcaggagttcaacaccagcctggccaacaaggtgaaaccctgtctctgctaaaaatgtaaaaattagcttggcgtggtggcccctgcctgtaatcttagctactcaggaggctgaggcaggagaattgcttgaacccaggaggtggaggctgcagtgagctgagatcccaccactgcactccagcctgatcccgccactgcactccagcatgggcaacagagtgagactccatctcaaaaaaaaaaaaaaagaaagctgtcatatgaaccatctgctgctttgaaactagcaaaggaaagcaagccctgggatgggtagctccagccacgctttttaattgctacttattgtcccttaaatatgtcttcttactgcactttcaatggctccgcctgcatagtgaaatcagaaagtcaggcaggtggacagagccttacatgccctgatccagcagctttggctccaccccatccagaggtttactggagaagcgacttcaggaagatgctgcccttactcagatgccctctgggcctgaggcctttgcaggacattgctttcccctctgtctgaaaccctgtcctcctgggctgacactcctgctccccctggctggctgcacattgggatcccctggagagccctgagacccccatgtccgggccttggcttccgcccagaccggggaagcccaggcccgggtgtggtctcagaaacccccagtgattctgcagtgcagccgtggcagagaacctccaaggtcagggatcagcagcatgaccccgcagctgagtccgtatcctctaatggcgccttgtaactctttgtcaacatttatctcaagtgtaagtaacttgttcatttccctcttcctgttcaagcctaagttctgggaggacagggactctgtctcatcagcagttcatctgctgcactcagagggtgctcttaaatatttgaaatgaatgaatgaatgatgaatacatgaaaaatgggaagcaagttctctaaaagggcgcagcatcttccttcagcctttggaacccgtcccaagtgaaaagtgcttcccacatagaacaggcaatagcaaattctatttaaaaggccaggaggtcctgaatgtcccagattctcttgctttgggaccagctggggtcaaaggaaggcagggctggcagggcctctgggcaccgtgggcctgtttacgcagggcggtgtgggggtgcctgaggcagggcttagcagtggcggggtgtggctgggaggggtgtgggcaggggtgggtcatctggaccttggccctgccctggtgctgcagggcgctgtgtgaggcccgaggttcgtgtgcacccacgcctaaggggcattcacaggaggaagcactgtggacctggaagggatggctttgatgactggatcagtgggtttggtttctgtctccaaatgcacaaatgcagacactccagtaagagaagcaccattcatggaggacccgctaggtgccaggctctgtgttcaatgccttttctgctcttagaccctggcaagaggggcccctgctctgggtttggcactttggaggactgtggtccaggctttctttctctagcaggacccgtactccacagggtgagttcacagggccaaggcattctgactacccagaggggtgcttccacccccaccccaaccatgtgctggacacctgggatcccagaagctcctgaagggcccagccttgcttccaatacccgtcttcctaagggcagactgccactctgctgttcctgccacaggcccatgaggtggccagggctggctgttgccttggttgtgctggctagggcatccacgcagtgagggatggagcctgggatgaggcaggaaggagccaagggccagagactgccttattccagctcagaactctaaggagtcctggggttctcaattcacagtcatcctttcagaccagcacagtgcattgctggaacattctgtctgtccaacacagtagctactaactacgagttgttattgtacacttgaaatgtggctggtgcagctaaggaattgaatttttaattttacttaagcttattttaaaattaaatttaaggccaggcatggtggctcacgcgtgtaaacccagcactttgggaggccaagccaggcagatcacttgaggtcaggagttcaagaccagcttggccaacatgatgaaaccccatctctactaaaaatacaaaacttagccaggcatggtggctcatgcctgtaacctcagctactcaggaagctgaggcaggggaactgctcgaacccgggaggcggaggttgcagtgagctgagatcgtgccaccgtattccgcctggatgacagagtgagactcggtctcaaaaaaaaaaaaaaaaaaagtaaaataaaataaaattaaatttaaatcgcaacatatggctagcgattgccgtttgggacagcctgttccacgccatcatgaagggctgcgtgtcaaggcagggagagagatggtgttggacttaatttgcttggtgtatttagacagaaggttggtgggcctccacttgtactctcctcctggctcctgtgaattttaggggctgtgaagtgctttgctaatcttcatcacaatgttctaagttatttatgatcccccacgtctacagatgagaaagtaacttgcccaactttttagaatcatccccaggacttgagctggaactggaatgtacgcctgtctgcctgcacgatgtgtgtggccctggaccagcctatttttctcaaccattatttaatttaatcctaacataatgctcagatgcaggtggaaaccgcctcacttatacccagcaccacactaaaagttatgaatcaccaccccgattttacacagtggaggaaactagctctgagaaaaagaggtctgctcgaatctgcatggaaaaccacagcgttgaatttcatatggcaggcagcattctaggggatgacagtgatgactgcttcttatgagagttcccttaagtgtcgggatttcaatgtaagcttgcaagatggtgctggattctggctggaaagtgatgtcttcctaaaactgagcatgctggccactgaaagcagccaagtcatgtttgttattgctgtgtgtggaaaaattcacagtttattcctcaaccagtccgaccagtttggggctggagttataagatgtctgtgcagaccaactccctaagaatcaaggctggaatgtgcccagaggtctcttgctgtcacatgcttagcaaggtaccaggaagggcctcccaccagcttgcagagccatggaggtggaggcattgaaagtttctgtttattttattttatttttttttgagacagagtctcgctctgtcgcccaggctggagtgcagtgacgcgatctcggctcattgcaacctccgcctcccaggttcaagcgattctcctgcctcagtctcctgagcagctgggactacaggcatgtgctaccacgcagggctaatttttacattttgagtagagatggggtttcaccatgttagccaggctggtctcgaactcctgacctcagatgatccacccacctcggcctcccaaagtgctgggattacaggcatgagcccccgcactcagctaaatgtttctaagaagccaccgatgtgccaggtgctgggctcctttgtctctgcatttcctctcatttgattcttacagccaccgtgcaaaacaagtcttgccccttgacagcccaaagaaaagcttattgagttgtgcattcactcattaattcagcgattacttcctgggcactaggtgccaggcactgagcaaaatctggtccctggcttcatgcggcagacaagctaaaataaggaaaagagcttcataaaggagataattacagctcagggccagtgccttggagacactgcagattccaatggagttgttagggaaggggtgtttcttctgagacctcagggtttggggaagaaccagcctcagggcctttgcactgccttcaccctctaccagcaatgctcttgcttctgggccaaagaatcaatgcaaaggccccaggcacagggtctgcttctctccatgtgactttggaccagtccctttccttctctaggcctcagttacttctacaaatcgagactgaattaaacaaatttccgaggacccttgcggttcagctgctaagttgcagtaaacttttcatgctctccaacaaaaatgctgctatccctaaaataggttggttttaattataaaagccattttgagccaggtgtactggctcatgcttgtaatcccagcactttgggaggtcaagagaggaggatcacttgagcccaggagttcgagaccaagctgggcaacatagtgagaccctgtctctacaaaaaatacaaaaattaaccaaggatggtgacgcatgcccgtagtcccccagctactcaggaggctgaggtggaaggatcacttgagcctgggagtttaaggctacagtgagctgtcatcacactactgtactccagcctgggcgacagagcaagaccctgtcccaaaataaaatagaagctatcttagaaaatgtagaaagtagagaaaagtttaaatgagaagtcagccataacaataatgttccatcctcttgttcctcaatatcttccagagcctaacccgtagtcacctccagtagtggtggcagcaatataataataataagtgatagtagtagtagtatggtaataatagtaataataatataacaacgtcatcaatagaagcagctgacattcatctagcacttattgtgaagcaggcattcttgtgaatcatttgtgcagatgatgtcattcagtctgcacaataactcaaagatgcatatgctattaatatacacataaggaaacggaactatagagaggccaactgacttgctcaaggccccacggttagtacatgagggaaacagggagtagtagatgctcaataaatatttaatcatgctaaatccctccccttgcttatactgatgacagtaagatactgaacacagcaaaatctgactgtaaattgagaccaagaaatgtccttgaaggctgttttgccaccaaataatttttattgcatgtttgttttcatttctgcagtgataacttttcctagaagaaaatactgaaaatacagagaggcatacaaaaaagaaattaaagtccccccaatcccatcatctgttgtatttttaatatttagtatatttctggctgggcgtggtggctcacgcctgtaatcccagcactttgggaggccgaggcgggtggatcacttgaggtcaggagttcaagaccaccctggccaacatgatgaaaccccatctccactaaaaatataaaaattagccaggcatggtggaatgaacctgtaatcccagctactctggaggctgaggcaggagaatcgattgaacctgggaggcagaggttgcggtaagccaagatcacaccactgcactccggactccagtctgggcaacagagtgagactccatctcaaaaaaaaaaaaaaaaaaaaaaaaaaaaaaaaaaaaaaattacacacacacacagacacacacacacacacacacacacacatttagtatatttctctgtctcttctccgtgtaacttttttaatgtggttgagctcagactgcatacgcaatttgtcctgttgctgcttttactcagtgttatgtgataagcatttcccatgttgttgtaaactctttagaagcatccttttaacgactgatgcagctttttataggtgaatcatctagtactttaaaagtgagaacttactctcagaagcacattaattttccctgtgagggataaggcaggctcagagtaagagaaaagagtcctatcacctaccaggtatgtgaccttggaggagtcaccttaaatggccaatcctcattttttaaactgagactaaggataacaacaggaaacgagctgcttcctatgattaatgtgaggctaagccaagatgacatgtattcaagcattttaaaaaatatatacactaaagcaaatgtttgctctggattacacgtttttattttactttttgaaaactgaattttttcagaatgcagaagtgggcacaaatttaatcaaagtggcatctacaacagccacggccctgaaggaagaagatggccaagtctactgccagccggaatttctttatgaaggtaaaatgcatcctcttgtcctgagtttaggaaaggggcagattttcacagggagcccagaggcctctttacataataattccctcctgtgcatggacaagggccaaaaaggaaagggtcttgggatgccctggtgaaaagcatctggggacatttctcttttctctatcttcaaatgcttcctaggaaggcaatgggtgaggccaggcacggtggctcccacctgtagtctcagcactttgggaagctgagggaggcagatcacttgaggccaggagttcaagaccagcctgagcaacatggcgaaaccccatctctactaaaaatacaaaaattagccgggtgtggtggcgcatgcctgtggtcccagctactcaggaggctgaggcatgagaatcacttgagcccaggaggtggagattgcagtgagttgagattgtgctattgtactccagcctgggcaacagagcaagacactgtctcacaaaaataaaaataaaaataggaaggcagtgggtggttgttgggccagatgacttctgcaaatgctgtcccttactgaacatgggcttactgaacaggcacaatacatttccatttcttcctctcaacatccacaatatcctgcaaaaataggtgttatcggccccgtaatatagcgaagaaaactaggcctgggagtccttgaggtacacacagaaagcagaccctctagaacaggagtcacacccgtggagcagggctcctcaatctgggcaccatcgccatctggggctgggtcattctttgcagtgggtgctgtccagggaattgtaagatgtttagccacatccctggcctctacccactggaagccaggaagacccccatcctgaattggagcagccaaatatgtctccagacattgccagcatctcatgggagcaccattgccatgatggagaacttctgccccagaatataagcccgtgaggcgagaattgtgttgctgtgctcacagcgtatcagcagcacatgacacaaaggctggcatagagaggtctgtgttccatacgccaaagtgcagaatgaatggacttgtccaaggagactcagctagagagtgggacagagtgcatttcaactgagcgcattggctgggcacggtggctcacgcctgtaatcccagcactttgggatgctgaggtgggcagatcacttgaggccaggagtttgagaccagcctggccaacatggcgaaaacacatctctaccgaaaatacaaaaattagccggcatggtggtgcacgcttgtaatccataatcccagctactcaggaggttgtggcaggagaattgcttgaaccccgaaggcagagcagagagctgagattgcgccactgcactccagcctgggcaacagagactttgcctcaaaacaaaaaacaaaaaacaaaaacaaaaacaaaaaaccctgagagccttgttccatcagctgccccatgccaggaggtttgggcatctggaagagcacatagacttggggactcttttaggatgacccttggatttgacctaagaatccacttctgtaaaaggcatcccatgcatcccataaccggttctgtgatgcaactcattcccctggagtctttagaaatgaatcaatagatgatgccaggtctgaaggcatcaacccccaacccccatccctgctcacccaccacatcccttttttttttttcctgagaagaccacgcttgtttattgttgcaatattgtccacactaaaaagtgtaacaataaagaaaccacccgtaatccctgcccccgtgacagcgctttgggctacccatccaatcctcccatcatgcatggattgtgtgacataggccgggtcccttctggcgagttctcagactctctcatttcatcccggcagtgtcattcttttattgttgacattagatttgttcacgtacatcaagggcttagtgtggggtctggcctatagggagagtccagccattggcagcaatattagaacagtcctaagaagcaggctcagacaatctcaaaacttgccaaaaggcaggcagcagagccaggttctgaccccagcagtctcttatcccagagcccattgcctctgcatttgtacttttgcaaaatgcattccatatcatctagaatgttccgaagctgcctcttgcacttaatgtatgtaacctgagtattttcccacatcctgaagattcttcaagaacatggctgttaaggaccgggcatggtgattcacacctataatcccagcactttgggaggccaagccttaatttcatgtaactactggccaggcgcaatggcaattacaggcattactcatgcctgtaatcccagcactttgggaagctgagacaggtggggcatctgaggtcaagagtttgagaccagcctggacaacatggcaaaaccccatctctatttaaaaaaaaaaatacaaaaattagccgggggtagtggtgcacacctgtagtcccagctacttgggaggcttaggcaggagaatcgctggtctgagaggggcccaggaacatcttggaagtctcaggcctactttgaggtcaagggcaggcaccttcttcttatctaagtatgggagtgttccctctgcctcaccttcatctgggcctgtcccttggaagtttcatgctttctcatttgtgggattggacatctgcttcccatctcaatacttcattccccttcccgccccactgagcctaatcagcatttatccatggatgtatctctgcttcctcttttcttggacattatatcttcaccagcagttggcggcaaccacctagaatatttcctaagagttgaacatccatttcagtattcagacttagaaattcaatttgatgcaataggcatatatacatatatacacatttacggccaagcacggtggctcacacctgtaatcccagcactttgggaagctgagacgggcggatcatgaggtcaggagatcgagaccatcctggctaacatggtgaaaccctgtctctactgaaaatacaaaaaaaaaaaaaagtagccggatgtggtggcacgcacctgtagtcctagctacttgggaggctgaagcaggagaattgcttgaacctgggaggcggtggttgcagtgagttgagattgagccactgcactccagcccaggcgacagagctagactccatctcaaaacaacaacaacaaacaaactatatatatatatatttttatatatttatatatttatatataaatatatatttatatatttatatataaatatatatttatatatacacacacatttacagagaaaaaataatatttttgattatgtaaaaataataagcatgatgaaaatttcacataatgagaaacttagattctatcatagaaaatgtaaactgtaaggcagttagaaccccagcaatgcttccaaattttttctcttcatttgtaacctagcggagatacaataattctataaccagcattttacacttaaccttatggtatggacacttgcccatgttattaaaatcatttgtaaatgttgtttttccataatgttattatagaattcaccagatttaattaactgttctccattgacacccttttccacagcttcccattctgttttattttttagtttttattttagagatggggttcttgccatgttgagcaggttggtctcaaactcctggcctcaagcgatcctcccatctcagcttcccaaagtgctgggattacaggcatgagccaccatgcctagcacagcttcctatttcttttctttttgttttgttttgttttcttttcttttcttttcttttttttttttttcgagacagagtctcactctgtggcccaggctggagtgaagtggcacgatctcggctcactgcaacctctgcctcctgggttcaagtgattctcctgcctcagcctcctgagtagctggaattacaggcatgcggcaccatgcctggctaattttctttgtatttttagtagagggagggttttgccatgttggccaggctggtctcaaactcccgaactcaagtgatctgcccgcctcggcctcccaaagtgctgagattacaggcatgagccactgcgcccagccagcttcccatttctcatcacatatgtgcacatgcacgcacacatatatacacatcagcacttttttgaaaaaaagctttaagaaattgcagtagcctctgattttaatcatgcaattctctttgatttctatgttggataattaaagatgtttatacacttaaaacctaggtctggagtaccttgctcctggactctctaatagagctggggtaattaaattaccagaggctccctcccctgcctttgaccacctttgatccaatgcaggctctaaatcaagctcaaggatcttggtgtggaaacggattctgaggaaaggctacccaatctgacaggaagggtggatgctcccagcccccaatgataggggcttcatccacctcctcatttccttgtaggcttagagcttccacgggtcaattatgctcacaatggaaagcaataccgatatgtctttgctacaggagttcagtggagtccaatcccaaccaaggtactggtctctgtgtattcacaagcctttcctacagtgattgtgtctatatgcaaagctgaattctaaggttctgagacgttgattagaaaagaggaggtcagaaggagtaagcctaggataaaataaatttgaagtaaggatgttcagctgggagagggagtggtacctaatgggctaaggttcaggtaagaggttgtggctggagtttattcactgatttctttattcaatacatatttaatgagcaccaattatgggctacaatgtggtaggcactgagggtaaggaagtcagcagggagattcccaatccctgacctaaggaactcaccctctccagcagagagggtgtagctgaaacttagaggatttattttgcttctttttttgttttgttttgttttttcctttttatttaaaaaaaaaatacagaaagagacagagtctcattgtgttgtccatgcctgtcttgaattcctaggttcaggggatcctcctgcctcagccaccaaaagtgctggattacagcctcgagccaccatgcctggcccattttgcttcttaagctaccatttgtcaaacacttactgtgttctgggcactgtgctaagtgctgtgcaggtgtcacttctttttaatgtcttcatttttcataataaaatggaaaatcttttttttaaaatgcaaacagagcaggaatgtacacagccaaaaattaagcctccacccctccataccccaagccactctccactaatcccaaaccccagagggaaataggcctattgggagattaagagagattcagggaattgcacccttaaagcaacaaaggggttgtattgtactttaaatgtttgcattgaatatattcatttatttaactcatataaaattgcagtgcaatttcaaatacaagatatgttcgatatttttaggcagggtgtggtggctcacgcctgtaatcctagcactttgggaggctgaggattgcttgagaccaggagttcgagaccagcttggtcaacaatagcaagaccctgtctctatattaaaaaataataataaattttaaaagattttaatttttaaaagaattccttctacagtatcagctacgtggtggccagaggacccatgtttaaaactgggggaggaggccgggcgcggtggctcacacctgtaatcccagcattctgggaggctgaggtgggcggatcacctgaggtcaggagttcaagaccaacctggctatggtgaaaccccgtctctactaaaaatacaaaaaatcagccaggtgtggtggcacacgcctgtaattccagctactcaggaggctgaggcaggagaatcacttgaacccgggaggccgaggttgcagtgagccaagatcacgccattgcactccagcctgggcaacagcctggaaactccgtctcaaaaaacaaacaaacaaacaaaaaactgggggaggagagttagctcctgtcctttcttggctgtgctcaccagaggtagctgtcattgggagactacgtcaaaagtctacatccgatgggcttcatctcctctgtgtggatcttcatgcactcctatttgcagagaatagtattctctcaaacaagtcatttatgtgtttttcctcgttggatgtacagataataaaatatgacattctcacaaagtcatccttaaaatggagagaggacgactgctggccagcggaacccctgtttgtgcccgcgccaggtgccaaggatgaggatgacggtaagactctaagaagccacgcctagttgctgcacgttactgcagatcgccctccaacagagacaccatctgggggcagctgacccccccaggtcataaagggggtggattggtgctttgaagtgtacatctgtctgggtcaaagctaaagggtgagggagtccccaagaccacctttacttctgataccaattgcaaagtttgagggtccccaagatagccttcagcttcaataattcattaaatcaccaacctcactgcaagtgcttatgttcacagttctggtttgtggcaatgaaaagatacagactaaaattagcacagggaagagatgcacaagacagagcccagcagggaccaggcaggagcttccaggtgcctctccaagtagagtcacagatagcactgacttctcccgacaatgacgtatgacaatactcaccgagtattactgccagccaggaagctcccctgagactcagtatggagagtttttattgggactcagtcatgtaaacatggttgactgcctgtgtgtctgacctttatttagtcttcagtcctcctggagatcaagttcataccacacggcacaaggccccaccataaatcccactgtaagggtagactgcctgatgtggcccaaggcccccaggtatacaaagatacttgtatcaagcaggacattcgacgggtatagaggtgacctcccagaagctgaggacaaaagccagccccctctttagacaagtttaagttttttaccgcacaaagtccatctcctttccactcagtgacattaaactctctcagaatgcagaatcttggttttaaaattgattgcagtggctggatcccaaacaaatgtttttaagaaatggagtcttgctctgttgcccaggctggagtgtagtggcatgatcatagctcactgcagcctcaaactcctgggctcaagtgatcctcctgcctcagcccaccaagtagctggagctacaggggcacaccaccatgcctagctcattctttttatttttttgtaaagaaagggtctcactatgtttcccaggctggtctcaaactcttgggctcaagcgatcctcccatcttggcctcccaaagtgctgggattacaggtgtgagccagtgcacctggcctggatcccggatccaaatttttaacaatgtataagcatgtaaatgtttcacagagccgctggaaatgtgtatttgtggcccacctctattttctaggtttccacttgactgaatgatgctttccctcttccattctcagaaatgcttcagaaatgccctgcccacagccctgaggaggctaaggagggtaactagaaccataggtggggatgccacctggccacaccagcaatggggctgccacacctgcaaggagggcaggctgccccacttgagcctgccagcttcttccctcaggtcacaagggagtggttttccacctgggccttgtcttcctactgatcatggcatggcacgccaggccagcaaccctgtgtcactgtcatctccaaggcgggggaccacaggccttgcctcctgttcaggtcgttctcccactcagtgggacacttcctttacattctctgtgaggagggagtatcgttgtcttcattttaccaatgggatgctcagagagtgacctttttgcccaaggtcacacaccccttacattcagaggtaagatttaaatccaggccaatctgacctcaacgatgctcaactgctcttccacctgggaccctctggaggcattgagagtatttgcaggaagttgatatgcattatttcatttaactctctatcccttcagagtgagtattgagagtatttccattttacagaggggaaggatgagtttagtagcactgctacatgtgcaagagatgaattgggcccattgaaatgccattcttcaagccaggtgcggtggttcatgcctgtaatcccagcacttgggaggtcaaggtaggcagatcgcttgagcccaggagtccaagaccagcatgggcgatatagggagaccccatctgacaaaaaatacaaaaattagccagacgtggtgtcatgtgcctgtagtcccagctacttggagggctgaagtgggaggatagcttgagcccaagagatcgagattgcagtgagctgtgatcacaccactgcactctagcctgggcaacagagtaagaccctgtctcaaaaaagcaaaacaaacaaacaaaaaaccgaataccactcttcgatgcctgcaataatttacagagtgctttcaaaatccatcattcaggagatactctcggcaaccctgtggagtgtaggtgagattatcgcatctctacagatgaagagactgaggctccgagaggtcaagggactggcccagccaagggtagaaccaggttttctggtttgttcattcgtttgtttgttcgtttgttttgaggccgtgtttcactccgtcacccaggctggaatgcaatggcacgatctcggctcaccgcaacctccactcccaggttcaagtaattctctggcttcagtctactgagtagctgagattacaagcacccaccaccacacccagctaatttttgtatttttagtagagatggggtttcaccacgttggccagactggtctcaaactcctgatctgaagtgatccgcccacctctgctcccaaagtggcgggattacaggcgtgagccaccgcgcccggcctagaaccaggttttctgatgcctagttgccaggcctttcccttctgttacagtgtctcaaattcactccctcctgttttggttagatacatatgtttaaagagggcagagagacatgctgagaaattcatccctccgactgaagcctgcacttttacgaagtgttttttttctgtttccctaaaggagtaatcttatcagccattgtctctactgatccccaaaagctgccttttctgctcattctggatgccaaaagctttacggaattggcccgtgcctctgttgatgtcgatatgcacatggatctccatggattattcattacagacatggactgggacacaaaaaagcaggccgcttctgaggaacagcgggacagggcttccgactgccacggggctcctctgacctgatggtgttggggtttgggtaggggaggggagctcggctgtcagaactccatggatatgtttctttggatggaggggagggcctttgttaccttttgcacttattctttctgtgggtgctttgacaagggcatggcaagagagcttgtcagtatcatttctttcattttattttggctgtaaaaattttgtttgaaagtcaaacatttgaacatcaaatatgtattgattagatccagtccttctaagaaacctcctttcctttaacaaaaagaccttgaccatgaatcagagattgtattcaatgacattatcatcatttttagaacgagccactaacctattagagaagaggcagataattatttatcattgtgccttcctctgtctctttctctttcctttgctccctcccatgtttctggtggactaaattgtgtatctgggagttctcactttctagccaggcctgatgagttaagttacatgaccaggaaggttatgccactttgtggtcattccatgcaagtcatggcgtaatataaaataataaaaactttaaagtctgctcagactttatttttacatggcttctccctctgaaggtcttctaaggcaataaaatagttgcagagcttgatggttcacagccagcacgatgcttcattgtacaatcgacgggactaacagattgctgtgggactcctctttgcaagaggggattaataggtactggacattgacctggctagccacggccgaggggctcaaacccaggattgagtcccagggcctgggctggcatgaggagttcttccctgctgctgagaactagagcagtgggctgtgcccatgtgcgtagataaaaggagtttctccaagcttgtacgtgctgccgagataaaccaggcattttgggcagcgtggaaggaggttgaaggcccctgagccaggtagtgatggggatggagaaagttgggaacaaggcaaatgggatgctacaccactaccaggagccccataggcatctgagtctacagtcaagtgggtgcctgatgcatggtttaaagaaacaaaggcaggctggataattcccaggtcatgggatcgggggagctgggtttcacagccttattctgcacttacttcctctcctgaatctggatttcattcagtcaccaatggggattccatgacgtgtctggaggatgggaaggactctctagtggcaccgcatggaatcccccagaggggcagctccctccaggatggtcttagcttttgccctgcacccaccatgaagccatacttagcctctaccaaaatgtaggctccatgaggccagggagttaggttttttttcttttctttctctttgacagggtcttgctctgtcaccccagctagaatgcagtggtgcaatcttggctcactgcagcctcaacctcccaggcttaagcgaccctcccacctcagcctccggagtagtggggagtacagccatgcgccaccacacccagctaagttttgtattttttgtagagacagggtttcgtcatgttgcccaggctggtcacaaactcctgggctcaagtgatcctcccgccttggcctttcaaagtgctaggattacaggcacgacccaccttgcccagtctttttttttcttttcttttcttttcttttttttttttttttgagacagagtctcactctgtcgcccaggctggagtacagaggtgcgatctcggctcactacaacctccgtctcccgggttcaagctattctcctgcttcagcctccccagtagctgggactacaaacacgtgccaccatgcctggcaatctttgtgctgttgttttcttttttgtttgttttttgtttttttaagtaaagatggggtttcaccatgttggccagcctggtcttgaactcctgaccttaggtgatctgccacctcagcctcccaaagtgccgggattacaggcgtgagccaccatgtccagccaagcctttttttttttcttagttgaagtttttattgagataattgtacatgcacatgcagtgttgagaaattatacagaaagatctcatgcagactttacccagtttcccccccatttgtaacattttgcagaatgatatagtataatatcacaaccaggatattgatattatccaccaatcttatttagatttcccagttttacttgtactcatttgtgtgtatgtgtgtatagttctagacaaattctagactgcatccaccatcacaggcaagataccaaatagcacgtcagcacgaggatccctcatgtcactttttttatcaccaaacctacctcctgccctcctcacctccgatccctaacccttggcaaccaccataaaatggtgtcatttcaaaaatgttatgtaaatgggatgatgcggtattaaccttttgggattggcctttctcacacagcagaattccttgaagattcatccagtcatggtgggtattcattcaagtcattaggcattgggtgtgtctgactcactactttatcctcaacacttgtaacactgcctcgtgtaatgtaggcactcaatacatacttgttgaatgaacgaatgcaccagttctcccaacagattcaactggtcaatgcatcaacaagaaatggatgtcttactggagagctcctgggagatggggaagcgagtcccacatggagcccaatgacaacacacacaattccctgctaagtttcctcactcctgctacccctgatcaccccctctctcttctcctccctgttggtccctcaatacccctcctatcgttctcagcattttcatttttgccctaagcttacataccctgttcaacaaaaatgcaagccatggaaatggcaggacaaagaccatctgctcttcctcagaatcgtctttgggaacctcagtacctccagccttgataaaatggacgaagggggaccgggcgtggtggcccacctctgtaatcccagcactttgggaggccaaggcaggcagatcacgaggtcaggagctccagaccagtctggccaacatggtgaaacctcgtctctactaaaaatacaaaaattagccgggcttggtggtgggtgcctgtaatcccagctacttaggaggctgaggcaggagaatcacgtgaacccagggggcggaggttgcagtgagctgagatcgcgccactgcactccagcctgggtgacagagtgagactctgtctcaaaacaaaacaaaataaaataaagcagaatagacaaaagggaaatgccaactctagtggcctgaaaaaagcacgattaagggctgcgtttgggtggcaggaatggaaaagaattgaaaaatgtgacaggccctcaaccactcattcttctactttaaatatttgagaagagggtagaattaaaaaatgcttccccacctccattctactagattcctattgcctaacagtacccagaactagtcatgaaaaagggtgcagttctgcggggaagaaaaatatgtccgtggtttgtttatcttgttgaagatgacaggtagaataccagactgatgagggaggctggcacaccaaatctttctttctcagtttcaaaaacaccaaaagttgatgccaagatattcaatttatctgggtccttaattctgacacatttcatacataagccagggtaattagctcaaaactccacaagagctatgatgcgtgctccgttcttgaaggacccaagagacgctccatcttaccctctgagccttccttgttatgtttcatgtgggtggaatatatgaccaggaagttctgcaggatttgtttattgctttgataaagccacagcatttctcaagtgctctatgctgcaagcgtcaggaacacgctaggaaacccaaatgtttgctgacccactaactttttccaccaaagctttctctaatttaatcccaattcaggaataagctggatagacacttgggcaatcaactcacgaaaaatctaagtgtgttggcgtgacatctacaatatttgcacaaacacttcctcctgaccaaagttcagcctgactcctttaagaaggttgctggtccaggttaagtataaacacctttgatggcttcttaaaaactgtttaaagactgtttgggtggtttttaaatggccaggagatgtctttctcatgacaaatcagtacatgcagaccaaaaagtcatcaccaccgttctcaacatccaacagtgatgagatgtatggcctcaacacttgaacttcttcctgggagtttagactcagagaccctgcacagaaaaacacagcgccaactgccccagctcctgtgccacatcaaaaagcatcctttgaggtccagccccagctaagaggcagattttcttggacacaaccagcaaacagagatgtggcggcactgtattcagccagggtggggaagagaacagtttctttctcataactaagaaaggctttcccaaggccaggcgcagtggctcatgcctgtaatcccagcactttgggaggccgcggtgggaggatcacttgaggtcaggagatggagaacatcctggctaacacggtgaaacccagtctccactaaaaatacaaaaaattagccgggcttggtggcgggcacctgtaatcccagctacttgggaggctgaggcaggagaatggcgtgaacctgggaggcggagcctgcagtgagctgagatcgtgccactgcactccaggctgggcgacagagtgagacaacgtctcaaaccaaaaaaaaaaaaaaaaaagaaagaaagaaagaaaaagaaaggcttcctggagggctgggacttgaggacctgcctcagtggccagagggaactggcaaagggctggtcctgccaggttgggagtgcagggctaggatttggagacagatgtggttgcctgaacaaagcaggtgcagagggaatttcccaagaaagagcagtggacagagtcaggcttagggctttttgttatttgctttttgttttttttcctgtgttaaatcttatctgttcattgtagaacacgtggataagttaaagaaataaatgagaaagataccacagttacattaccaaaaggaaaccactgaaatcattttgatatgtttttctccaggtgtttttgagtgcgtgtgtgtgggcagcgtttacatattagtgatcaccagtttataacctactctttttcacttaacatatgatgcaagcattttcccaggtcattaaattcttttaatgggtgcatattattccttcttgggggcatggtgtaatgtagactaccctactgttggacatttaggttatttccaatttttggctattatacataaggccctgataagtaacgtcctgcataaaattctagagttcatcccctaccctgtatttgggtggctgttactgttattatcttcagctagattccccactgaaaatttctgagccaaagagtaggaaaacaaggtaatgggtgttttcttgaaaggccaaaggtttggcttgattcataagactgaaaccaagaagacaatcttggatatttgaggctcaaatggtcaaaatggtgatagggctgagaaaacacatttgtgaggaaactgaaaaaacatgggtatatggtaatatcattttagttcaaattctcccttcttccttttccctagtctttccacttctccatattcttccactccatacaaatgcatggtttttgtttggttggttggtttttgagacggagtctcgctttgtcacccaggctggagtgcagtggcacgatctcagctcactgcaacctctgcctcctgggtttaagcgattctcctgcctcagcctcccaagtagctggtactacaggcatgcgccaccacacccggctaatttttttgtattttcagtagagacggagtttcaccatgttggccaggctggtcccgaactcctgacctcaggtgatccacctgcctcggcctcccaaagtcctgggattacaggcgtgagccaccgtgcctggccacaaatacatattctttttcaggcatacattcacacattcattcactcattcagtgataatcaagactgtgcttgcatatagtgctggaaaaaaccagtgcttcactgtcctcagggagtatatggctttgtgaaaagccaacacaatacaatggaatggaggtgaaaagtgggcgtaccctctgcaaccttagccagggacggccgcaaggggaaggatggtagcagttggcaaggtgaacaggtgatccagatttaaaaaggggcgtgtgcctggccctggagtcagggaagcatatgggaatctggaaaacctgaactgctgggcagaaggcgggggccacagcaaaagacagcttcaagcagacccccactttatctgcactcaggtcagaaatgaaactggcattaactaaagagaattctccaaaggtagcttcaaggacaatcaaggactgacattcattaaaatatacacatatatttttaatatatatgtaaaatacatatttttaaatatatataatctattttaaatatatataatacatattttaaaatagattatatatatgtgtggcttttttgagatctaagtcacataccaaaaaactcacccacttaaaatgtacaactcagctgggcatggtggcccatatctgtaatcccagcactttgggaggccaagctgggaatattgcttgagcccaggagttcaagaccagccgggcatatatatataatgattttagtatagtatattgagagttgtgtaaccatcgctactgcctaattttagaacattttatcactccaaaaaaacccctgtactcattagaattactcctcattctgcaccccccagtcccaggcaaccacaaatctaccttctgtctttgtggatttgcttattccggacatttcatataaatggaattatgtaatatatggggtttttgtgaccctcctttcactaattctgtttgaagtttcatctatgttgttgcacaaattgcgacttctttactttgtactgctgaataacattcattgcacaaatataccacagtttgcttatccatttatcagttggtaagcatttaggttgtttcttaatttctttctttctttcttttttttgagacagggtctcactctgtcacccaggctggagtgcggaggcacaatcttggctcactgcaacctcctctccccgggctgttgggatactcctgcctcaacctccaaagtagttgggactacaggcacccaccatgttcggccaattttttttttattttggtagagacagggtctcactatgttgcccagggtggtctcaaacacctgggctcaagtgatcctcccatctcagcctcccaaagtgctgggaatacaggtatgagccactatgcccggctgtttcttctttttggctgtcatgaatagtgctgctatgaacatttatgtagaagttgttgtgtggacatgttttcattctcctaagtgtatgcctaggagtggaattgctgggtcacatgatgactctatgtttaacattttgaggaactgcctaactgttttacaaagtggttgtggcatttttacaatcccaccagcaatgtatgagagttcagtatgtccacattctccctaacatttggcattgtctgcttttcctagcttagccagcgtagtgggactgaagcggcatctcactgtggttttgatttgctcttccctcatgactaatgacgttgagcctctttgcatgtgtttattggccatttgtatatcttctttggagaaatgtctattcaaatccttttttttttttttttttttttgagatggagtctccctttgtccctcaggctttagtgcagtggcgcaatctcagctcactgcaacctccacctcctgggttcaagtgattctcctccctcagcctcctgagtagctgggactacaggtatgcgccaccatgcccggctaatttttatattttagtagagatttcaccatgttgcccaggctggtcttgaactcctgacctcaagtgatccatctgcctcaccctcccaaagtgttgggattacaggcatgagccactgcgcccagcctcaaatccttttttaattggggtacttgtcattttattgttgagttgcaagagttctttatatctgatagatgtaaaccttctatcaaacatatgattttcaaatatcttctcccattctgtagctagtcttttcactttcttgatgatgttccctgaagtacaaaagtttttaagttttttttttttttgagacagagttttgctcttgttgcccaggctggagtgcaatggcgcaatgatctcagctcactgcaacctccacctcccaggttcaagcgattctcctgcctcagcctcccaagtagctaggattacaggcatgtaccaccacgcccagctaattttgtatttttagtagagatggggtttctccatgttggtcaggctggtcttgaactcctgacctcaggtgatctgcccgcctcggcctcccaaagtgctgggattacaggcgtgagccactgtgcccggccagtttttaagctttgatgaagtgcaatttatctaatttttctttgatcacttgcacttctggtgtcgcatctaggaaatggtcataaagaattactcctatgttttcttcaaataattttaccattttggcacttacatttatgtctacgatccattttgagttaatctttgtatgcagtgtgaggcaggggtccaactttgttcttttatacatggatatctagttgtgccaacaaaaaagtcaccatttggggttgatatgccgtccagatagggcaaaaaaaaaagttgcccctttccctccaacttttcctagatttttccttcattccaagagaagcagttgtagggcagctctctgctggccccagcaaggctcacttagttcaagaccaggaaacccagatggatgcctgtcagtggtgggtcccaggctctttctgcagtggagatttaaacgacttcctctgtcttcatcgcagggtcctggtgaggttcatgttagtccagcatacctgtgctccattcagagtcacacgtcctggtgggattcaccagtattttctttaggtgagtacatcaactgtgtcccaggaggactgaaggggattgatatcctggagttggtgggaaagttggggggtggctttgggactggtggaaggcctggattgcctgaaggtcatcttggcgttgtgactttgtcttcagtctgccatttggttggggaaagcaagaagccgtggtctagttcagggttatttgcattaccattggaattagtataagagggacagtgatgtacatgttgtttgtgcatcctctctaggtaagggcaggaattgagcttgtttattataataattacaacaccaataaccgctaaagtctattgacaactcatgctggcctgagcactacgcttcagcacttcacacatgaacacaagtttcctgctgatgcaaaaaaattactgccaacttggtaatgccttaaaacatcaattgattttcttacacttctgggggtcagaaatccaaaatgagtctcacaaggatgaaaacccaggtcttagcagggctgtttcttctggagcctctataggtgaatccacttccttgacttttccagctgcctcagtttttagcttgtggccccattccttcaccctctctccccctgcttccatggccacacccagataatccaggagactcttcccatatcaagatccttaccttgactacatctgcaaagtcccttttgccacataaagcaacattcacagattccagggattaggacctgggtatctttgggggccactacttcgatgaccacaagcacccagctcttaatgcactcaataaatatttgttgagtgcatgaatcaattttaactgtttagcatccttgttggcagcctcttggctcagtcctttcaggaatgtgtgttttctcttccatcaagtttgttcgaatctcctgttcagtaaggatttcctgaccctaatttaacatcacagcttgcccctccatcacacacactccccattgccttaccctacttaagtttacttcttccccatagctttttgtcacttaatatattgtataatttacttactatgtttgttggtatttgtccacctttctcactaggatgtaagtttcgtggggcaaggagtttccatgttttagtctcagatgtcttctaggcatctggaacagtatctggcacatggcaggtactcagtacatgtgttgtggaattaacgtgtaaactgaatggcctccccaaccctcattcagctgcaaatctggttatctacggtggccaatcttggctttcatggtgatgaagccatggcctgttgtgaagccaatcgattgttgagtaacccatggattatcctgttcactgggctccaccccattccattaccacactggcaattttgatctctaaaacacagataacctcaattctcatctccaccaagacttgtgaaagtctgggagggaaatgaatgctttggctttgaatagttactgaaggataaacattttagaattaaaatgatcacagagttgagatagtgatttgtccctggctgaagttgccagagtctgtgatgttgggtgttactgtttccaccaatgtgcctggaggtaatgagtttgtggtttctggggttggttagtctcggtttgttcactgtagagtggtcatgagtacctgaggaggtgtgatggaggggcttcagggtgccccattggcttcctgaaactgcatgtgactttctgtgtgcatgcgtgttctcaaggacagtagaatccacagcttgcttcagattctcaatagggaagtgaagcacttctgcactgccccagctctgaggattcggtgattctgtgactggtgatatatggctgaaattcacaggccgcacacagctcagaaaggaaaggcggtcgtgtgacaggtgtgtaccttctccttgttcctacccccagactaaccaattgtgttaaagatcccaaaccaggtgctggtccaaatctcaagtggactaatctcaatttttataagattgtgggcatttcttgaggcctctatttttctcataggtgaaatagggatacttctaatttctttattttttgtactttgagggtacaaaatactatagaattgcaaagaattaatgataaagggaatatatgcctttttttgttatgtggcaacagactgtcttgttcccagctccatccatccatccatccatccatccatccatccatccatccactctgtaaacattcatttcctcacagtaagtatgaaagctaccatgtgtgtgaacaaagctttatatgagacgcttatcctggcggggcacggtggcatgcccctgtaatcccagcattttgggaggcttaggtaggagaattgcttaaggacagcagttcaagatcagtgtgggcaacacagtgagaccccatctctaaaattaaaattaaaaaagaaaaaacttattctcccaaaaaccatgaataaactgaggttcagagaacgttctccaggtcacttgctcaaagtcacacaacacagctcggaagtgacagtgcagactttgaattgaaaatctaattctatctgatgccaatggcaatgtctgttaatatcacctaccaaaatactcctaagggaagtcacctatgagggagatggagggaagagtctatctaatatagcatcttcaaatctgtgttttacctccatattagacccacacttgttttcatatcaaagaatttcccaccaatctttaagtacaagtgatgcttttgagaatggttgcagcctagcatagctctcagccacactccccaccacacacaccatttttccacgttagacttttgtgtttcagtcttatgtcctgttggattgtaggctcctagaggacaagatctcaatctgattcctcctttctccttcccaaaacctagcccagtgtccagcaagtaacaagtacacagataatgaatgtggcaaagacttattgcattgctgcctgagtctggtgccatgagagatatagatggttacaatgtggcccctgctctcaagacatttacaattgagctagagaggccaagcttccagaagtgaaaagggtcttcccaagactcttggcacacaatttagaagcttagaactgtcataaagcaagagaagaaacagtaggtaattagacaccagacaaagttccattaaataggacaaattttgtgaaaagtgacaacctgttcctctggaaaggcaacattgtgtcaattaaagagcacaccttgaagtcgcaaagtacaaattaatgatgttgaaaccactgtttcccaagagggaaaagtagaagacacagtcagctgtgctagatgctatcttctttgccagaggttctcagtcttggattgattaggctttgagggccacattgagaccattagcagctcaaatgaacccatgatacatttggaaacactgggtgggctctgggcttaacaaattcaattccattcatcaaatatttcccgagttcactgtgtaggtgctggggatgcacagagaggaagcgatgtatgatgaatggctcatacactttgcaatgaagcaaagattcaaaaccctggctataccatgaattagttgatattagcataggacaggggttcacctctctgagcctccatctttttgtttttgagacagaatctcactctgtcactcaggctgcagtgcagtggtgtgatctcggctcactgcaacctctgcctcctgggttcaagcatttctgcctcagcctcccaagtagctgggattataggcgtgtgccaccaaacctggctaattttcgtattttagtagagatggggcttcaccgtgttagccaggctggtctcgaactcctgacctcaggtgatctgctcgcctcagcctcccaaagtgctgggattacaggtgtgaaccaccatacccagcaagcctccatcttttaaaccataacatggagaccctaattcttatcttgtaggcggttgcaaggattcattgagggtaataaacataaagctccctgcacagggaattgcactgaataagaacttcacagaggggcactagaatcacagaagaattaagaaaaagagctctgatttcaggaaactcccaggctgaggtgggaggattgtttgagcccaggagtccagcctgggcaaaatggtgagatcccatcttgaatttaaaaaacaaacaaataataagtaaatgttaaaaaaaaaaaaaagaaaagaaacttccagtctggtgtaaggaccaaaatgttaacaaataaatgtcattagtgtgatgggtgtgactatgtttttttagactaacagttactgagaatttactatgtgccagacactgcgctacccaactgtatctggataaacttgttcatttttttttgttgttgacagcatctcgctctgtcatccaggctggagtgcagtggcacaatcttggctcactgcaacctctgcctcctgggttcaagcgattctcctgcctcagcctcccgagtagctgtgattacaggcacctgccaccatgcccagctaatttgtgtatttttagtagagacggggtttcaccacattggccaggccagtctcaatctcctgacctcaggtgatctgcctgcctcagcctcccaaagtgcagggactacaggcgtgagccaccacacctggccacacttgttcattctgtgcaaaaccatatagagcaggaattgcaattattcccaatgaggaacctgaggcttgggcagcttaagtaacatgtccagggttgcagagctggaaagtgatagaagctggatttgcaccttgcaatctgcctcctgaggtagatttcaacgcgcaagcaagccggaagaggcttcacagaggtaatgcagtagaggcaagaggtttttcaggcatcaaagtcacaggagagaagttcaggcaggagggaaaagcagagacaaagaactggcaggatgaatcagctgactctgttcaggaattcaggtgagtccgtgtggagggtttggatgaaggataatgagcattcagaaaatgaggttgaggaaggagggaggggcccgatggtggacacctcaagcaccaggcacaaagacctggacttttaccggagtaaaggggtactagtaaagggtgttgaagacacgatcactggcatttagggaatagaatccacctgcctatgttataaaggaggtgactccacgcagcatgtttgaatgatcagggcacatcaggttttccaactaaatgattactttttagatattgttcacgtgcaagtctcactccctcccctgctagccaatatgtttcttaaattaaatgttgattcttattgcttttggtttcccctaagcgcctggcatatggtagtgcttaaatttttttttttttaatgaatgagtgattaaaagcatgcgtgaatttacatttaggtctatgagtctctgaaaagagatagattttgagctggattcaagaaaatgcatgtatttgaggtggatcatagacctaattgtgaaaaggaaaacaaaaaaagcttctagaagaaagcacaggagaatctcatgattgctgagatttcttaaacagattatgaaaagcaccagccataaaagaaaatattgatacattgaacttcatgaaaactaagaatatctgttcatcaaagataccatttacagggtagaaaggcaagccacagactaggagaagaaatctgtctttatttatatattattatatatataaaataaagaacacctaaatgttaatttaaaaatccaactgttggctgggcgcggtggcttatgcctgtaatcccagcactttgggaggctgaggcgggcagatcacctgaggttgggagttcgagaccaggctgaccaacatggcgaaaccctgtctctactaaaaatacaaaattagctgggcgtggtggtgcatgcctgtaatcccagctactcgggaggctgaggcaggagaatcgcttgaaccccggaggtggaggttgcagtgagccaaggttgtgttgggctgaaattgcaccattgcactctagcccagaaaacaagagtgaaactccatctcaaaaaaaaaaaaaaaaaaatccaagttaaaaatgagagaaaacttcagtaatcacctaaccccaaaaaatcaccaagtgatcaaaatgcctacagaaaggtgttcaacatcattattcattagagaaatacgaatgaaaataagacacctaccaggacaccaacacacccaccaggacaggcataattaaaagactgataccaccaattactggagcatgtgaagctactggaactctcagacattactgtgggagtataatttggtacaaccactttggaaaactggcagctcaagctgaacatatgtgccaaccctgcaacccagcagctgaactcttggccatatcctcctgtggaaaaaagtgcataaattcaaccatgtatttttattttatttatttattggagatttatttatttatttatttgagatggagtctcactctgttgcccaggctggagtgcagtggtgcgatctcggctcattgcaacctccgcctcccgggctcaagggattttcctgcctcagccttccaagtagctgagattacaggtgcccgccaccacatatggctaatttttgtatttttaggagagatgctatgtgggccagcctggtctcaaactcctggcctcaagtgatctgcccacctcagcctcccaaagtgccaaccatatattttaaatgttcataacagttttattagaatagccctgaaatggaaaaattatctatccatcgataggaaaatggataaatatattgtggagtagtcacacaatggtatactcacagcaataaagaaccaactattgctacaagcaacaaaacgaaagaattttgaagatatcacattgagtgaaagaaaccaaatgcaaaagttcaagaacaggaaaaacaaatcaatagtgatagaagccataacagtggtttcttttctttctttttttttttttcttttgagacaagagtttcactcttgttgcccaggctggagtgcagtggtgtgatctcggctcactgcaacctctgccttccggcttctgctttcaagtgattctcctgcctcagcctcccgagttgctgggattacaggcaccctccaccagcctggctaatttttttttttttttttgtattttagtagagacggggtttcaccacgttgtccaggctggtcttgaactcctgaccttgtgatccgcccgcctcagcctcccaaagtgctgggattacagacgtgagccacggcgcccggccagtttcttttgggtagcaccgattggaaacgggccttagggagcctctgggttgctggaaatgttctatattttgacgtggctggggatttcacacgtgtgaaatgtttccatttcacatggaaacattcattcagccgtgcacttaagattagtgcactttactgtgtattatacctcaataaagacatttttaaaagctaaatgtattaaagtattaattagtttcaaaacttactggttaaagaagaggtctgacatatttcagaaaacacaaggatggatttaaacattaaaaaaaaataaaggcaaggaacatgcaataaaaggtgtagaatgggatgtttaaagccctggagtagaaaatgaagatgtcaggtggagttagaaaatagatgaaattcaccaaaaacccagcactaatattagagaaaaacaagcaatgagactgtcaaccagaactggaggaggtatcactggtgggccctgactggggggtgaagagactaattgacttgaaagtcaactagaagctaatcatttctgagctgggcaaggatgccattgaaaacaagaatgatggtggtgatagtaatgatacatgtaacagctcttagcattcactgaacacctgctacgggccggatcttcttgtcagcacttcatcactgctgtctcatttaatcctcataaccactctgtaagaactgctacgattgccccagttttacagagggagaaattgaagaagcaacttctaagtctgggagaacagaccaagagggaggttgttaggaaatcccttgagttaaatgaatttaaatgacttcacagatatttaaacagatctaaggcacaggcaaattacttatgtgatgtaaattctgcagaataatccagctcattgtacacccagcagtatcctggctagaattctagggagaagacaagcaccttttatatgctttcaggtgtataaacaacataaaatatacaaactaaatttaaagggtgaaaagtgcaaagtggtgtgtcttgacaggggagaataaggttcttgcactggacctagcttgaaagaagttattggggcaacctatgcccagagctactatattgtgaccttctaaggtttggaacgtttatttcaggtcctttgaatcagttttgataactcatcttcctccaagttggcaatgttaggttaggcagcaagagatgaaaaggtccaggaaaatattcattcattcattcaataagtaaacatttattgagcacatactatatgccaggcattgctttagaggctaggaatacagtgataaaataagaatctttgccaggcctcatgaagccttataatcagaagagacacataatacactaataaacatatataattttaggtagtgattacatgcagtgaagaaagatgaagccagttaaggggaggcatttatgcaggagtgtgagccaaggcctttctgaggagctgacattgcagctctgatttaagaatgaaagagcaagctatgagaatgtgaggaaagagagttccaggctgagcaattagccagtgcaaaagccctgaggtgggaatatactaggcttgttcaagaaagagcaagaaggccagtttggttggtgcacactgaggggagaatggcaggaaatgaggccatggaggaagccagatcacgcagggctttttagaccatggtaagggctttgggttttttccctaagtttgaaggaaagccatggaagagctttgaactgggaagtgacttgatctgattaccttaggaggagaaacaattcataagggggcaagagagaaagcagggggagcagttaggaggctgttgcaggagagctgaatggtacctggatcagcgtggtcttggtggaggtggggaggagtggctggattcagaagttagcctgcagggccgggcatggtggctcacacctgtaatcccagcactttgggaggctgaggtgagcggatcacctgaggtcaggagttcgagaccagcctgaccaacatggtgaaatgctgtctctactaaaaatacaaaaattagctgggtgtggtggtgggcacctgtaatcccagctacttggggagcctgaggaaggacaatcacttgaatctcagaggtggaggctgcagtgagccactacactccagcctgggtgacagagcaagactctgtctcaaaaaaagaaaaaagaaaagaaaagaaaagaaaaaaaaaagtagtctgcaggaagagctgcaggattcactagagaattggatgaagggtatgagagacagaggtcaagaatgaccctaagtttctgtctctaggtaaatgaatgctgctgccatttacttggaaaatgagtaggtttaggggtaaaatcaggactttttgttttttttttttgaaatggggccttactgtgtctcccaggctggagtgcagtggcatgatcacggctccctgcagcctcgacctcttgggctcaagtgatcctcccacctcagcctcccgagtagctgggactaaaggtaggtgtcaccacacccagctaatttttttttttaagtagaagcttactttctgaggtgttaaattctaggtttctattattcaaatggcaatgttaagcaggctggtgaatatttccgttttgagttcattggggaaatatgaaaaataacatgtgaagtaatcccttgtaaacagaaaaatctcaattctattagaatttattccttcagcaaatatttattgggcacctactgtgtgtcaggcactgtactgggtgctggggtagaatacatgatgaatttggataggaacagttacgaccttcatggagtttcattacaatttaattagttcaccggtttctgagacacttctctgagtactgtgtaaatatatagaaccaactctgaagcgttataaatactgagatgttctctgactcagcaatttgaaagagcctagacttttttttggaaagaaaacagctatatatagatttggacaaatgaaagatttacccaataaaatatctgaagactaccttaaaatgaatcagaagagactgtctcaaacaaatgaatgtttatgacaagtcgacttggtgtaatggaaaagcttacagggctggaaagcagaagatctagaccttagtctgttctgccctgactgggtcacacctataaccttgactgagtcatttgctcatctgtactttggttttctcttcaataagataaatccgttggacttgatatttgctaaagaattttcaaactgttaatattttctttgcattatttctcttactggactctctaagtagtttttaggaaataaaagcccaaccccccaagtggattcctctcttgagggcacatttttcaaagcaaaagaaagcttttttttccctttttgcaaaaagacattgctttcttgtttttttaatgattgtaaaaaattatgcatgatcagtacagaaaatagaaatcgaggaaaatacagagtaaaagcttctataataacactgagacaactatactttcaccatcactgtatctgtagcaggtatcgtacagcaggtgctttaaaaacagttgttgaatgaatgattactgttaatatcttgcaaacatcctttttggtcttcagaccaaaaacgaatacataaataaatcctttctctgggttgtttcacctctaaaccagaagagctcagtaaagccaccagagactaaagctgttaggacaatatcaaatctcttacattgtaatatgtttcacaatgacagttgatatctgatgcctatggaatataaggaaacaataacatttaatccatcattctgataggcacaatatcaagggtggctcagtttgagcaatatcaagaaggctgcaaaacagtccacagtacttcagctcaagcaagagtggctccggcagcactgggagagttggctctgcctcctgaatccttcttcccacacttgggccctcttccttgcccacagcaccaggaggagctttctggggcatgtgaattccactcaacacattttattggcaacctagcagccatttgattgtcgactacattttcagtaaactaatcgtttcctgattacctctgaacatgaattacagccagatcttgtctgtagacccatgctacattttttcctccaaatggaattagttgctaatgttgaaaatccggaatattcaacatgtaaagtctgaattgtcagaatctcttaaaaagttgttagatccaccaccactgggcccctatcgcacagagcaatcaatcagagctgaggagcatgtgctcttcagctcccataagcccacctactcctattgtctgacatcccacatcccacagtttgctttgctaatttacctgatacgctcctgctaattatgtaaaacattcatggggtacctactacacatcaggcactgtgtaagtcctgggaacataggcagataaggcaaagcccctgccttggaggagctcacaacccagcagtggaaatgacttacaaaccagtaaattacagtacagtatggtgagtacagcacagcagcaggagcatgcagaggactgacccactctgtcctgggaagccagctcaagatttcctgaaggccatggttaagctgggttttgaaggatgaataagagttcaccaggccaatggagtggtggggaatactagcaacagtgtgggtggtattaaaaatatatataaagtcttcttctgcttagctgcctgttgcacagatgatcctctcaagccagcaactacctttctcttgatggtcattccatttcctccttctatcaaaacaacagggaaggttcacctttatctggaagagcctgcctgacaaatccccattcacctccagttacttcaactaaggcaaccttcctactcggataattggttacctgactgtgatcctactattggagctctttgttttggaacctctgatatttaaagaatagactagcacaataagcaattaataagtacttatcaaatatttacattgtgtagagaactctccctggtttttgactttaaaaatggcaaacacaaattaactaagaacagatagagaatacagttcagaaaacatttatttattttattttttattttttttgagacagagtcttgctctgtcacccaggctggagtgcaatggcgtgatctcggctcactgcaacctctgcctcccgggctcaagtgattctcctgcctcagcctcctgagcagtggggattacaggtgcctgccaccacacctagctaatttttgtatttttagtagagacggcgttttaccatgttggccaggctggtctcgaacttctgacctcgtgatccgcccatctcggcctcccaagaaacatttattaagtgtctgatattcaggtgtttttcttttttttaatccctccatccatccaacattcagttagcactattacgcaccaagtactgtgcttggtacctggaaatcatgctgagctacaataaacatagtata

SEQ ID NO: 124 - DNA, 193759 bp, Homo sapiens
tttatttaagcctccttattatcccctttcagtgtaaaaatttctccagccttagtcaggatttgaaaagcttaaaactagaaggcaacctctgaaaccacggtgaattttcacgtcagtttgtccagtacgtctgggttgatagagccaccttttagacaccctctagcccaaatctgatcatagtcatgtgtccccacctcttagggcctccgtggcggaaggtgttggttacctgaagggagatggtgatgggatgggaaatcaacaggagggaatcctgtgttggcagagttagagttccaacttcgtccagccagcacagttcatttataaattactttgtttctctctctctctctccctctctttccacccctgactcttgctctcatcttttactctttgtgtctgagagaagagtgatgtgaaaatgatcaggaattcactttttcttatgaggtcctggtcacagtgatacttagaaaacacttaagaacttaggcctgtggtgttttctccatctgcttccaggtcatttcttcctcatttctctcagaactttggtgttaacagcctgtttcccttctttaggggatgactttgatttcacagatgtttcttcatggtgaacgaaacagtgagtaactctttaaagtctcctctgttgccgaattgcttatagtttgtttgtgtttttggagtgctgtaggaagagcagtgatgaaggtttgaggcttctagatgcttccatattagttgcctggggctcaggcaggggcacacatgtggacccctggggggacatgacagttgagctaacagctgaggaatgaggatgacttatatcccaaggagtgggtcaaagggtgttttgtgtagcaagtgtggcatgtgcaaagggcctgtggtcagtggaactgagggtgcctgtggggctcagtgagggggaaaagaggaagtcaggcatggcatgggatggaggggaacagagtgaggctacagtcagtgcccagtcttgaaaatgtcccttcgagtgtccctaggggccatccttgttttcagtgcttattacccctgctcccctctgcttgctcccagagagctgtctcctgcctcccagctctgcgtctcagatcctggctctgatcccacgctgctgttgcttacactcatgtacccattgctaatgtcatcattcccttcggcagctaagtgcaaagttaatttcccatttgaaaagcagtctgtactaataacaatcaactgggagacccaaaagagtgcagttaaagagaaaaaaaaaaatcaaactttccctcaaaagaaaccagtgataccatttgggtccacctccctgaggtttgaaagcctctccgttagtgttagttgcttttaggcctcttcttgctgcattagcaaggtgtatctttctctttatatgcagacagtgccctcttctggtgggaggctctcagtgtctgtctacaaatccatgacccaagaggtagaggggtcccaacggtcccacttaacttctgccaaagtggtgcccttgggaatccccaacttcctgtgcccacctgttctagctacttggttcactttgacccagctcttcaggggtgataccctccctcatcaggctcccagatcccatcaggtgttgaaaccccatgtgataggtgaaatactggtccccagagatgcccacatcctaaccccttgatcatgtaaatgtgtgaccttatgcaacacatgggactttgcaaatgggattacattaaggatcttgacatgggacgattatttaggatgagctgtgtaattacagtggaatcacaggttccttagagaggcctgcatcagaggatgaaggagttgttcacatgtggaaagagacagaaataaaagtggagaggaccattgaaaaaaaaagtcattgaaagactttggcacccaggttgccatggctgcccccagcccttcaaattctcctaaagccccaaatgatctttccctggaagatgcaccagcccattggatagcttagatgcagctgttggagggtggatctagcctgtgaggacccagtaacctggacccaatacatgacaacaaggattgaatgagtggtcgtttactgctgagtaattgctggttttcctggctacctgggccctgggtcacatggatgagagggctggaaaaaatgattatcagcacagagtcccagaatctctgtgacttctggtcacagatattttgagtgtatgtatagaaaaaagcagttgttcctacacattcagtgtcagaagtgaaggatgagaggggagaggggtgtgcatgtcaaaggaaaaaacagcttttcccccctgtacgtgaggtcacagcaaatttgcaagattcagtgcatggtgagagaagcaggcagccgctgacatccaggggctggcctggctcccgctacctggcttggggtttcctgttggacctaagaaatgtcacagacaggacatttttaaagtcaataagaaatgtcagacaagagcactgtgatgaagtcaagagaccgtgggttgtgctttggctggttcttgatttatttctgctcaaggcaatcagtatgccaaggtggcatatttcagagtgtcacgtaatgatctacattcttattcagggtggggtgtcctgtaccccatcaactggaaggttgtagcacttcctgctttctagacatggtaaatgaactccctgggtcactgggaaagttgtagcacttcctgcttcctggagatggtaaataaactttctgtgtcacatgggaggttgtagcacttcctgctgcccagagatggtcaatgaacttcctgagtcactgggaaggttgtagtacttcctgcttcctggagatggtaaataaacgtcctgggtcactgaggaggttgtagcacttcctgctttcctagagatggtcagtgaacatcctgggtcactggggaggttgtagcacttcctgcttcctagagatggtcaatgaacttcctggagatgttaaataaacttcctgggtcactagcgaagtttgtagcacttcctgtttcctggggatggtaagagaacttcctgggtcactggggaggttgtagcacttcctgcttcctagacatgataaatgaacttcctgggtcattggaaggttgcagcactttctagtttagagggacattataacacttcctggtttatctggagattgtaatgctttctgattcatagggacattgtaaaactttctggctcacattgttacatttcctggttcaaatggataatagtagcacttcctggttcacagggacattgtgacacttcctggttcttatgggtaattgtagcatttcctggttcacagggacattgcaacgctttttggttcatacacataattgttagcacttcctgattcccagggacattgcaacacttcctggttcatagggataattgtagcacttcctgtttcatagggacattgtaatactttctggttcatacgaataactctagtacttcctggttcatatagataatagtagcaattcctggttcacatggacattgcaacacttcctgtttcacagagacattgcaacacttcctggttcattctgataattgtataacttcctggtttgcagggacattgtaacactttctggttcatatggataatagcacttcctggttcatagggacatagtaacatttccgggttcatacatacggataattgtagcacttcctggttcatacggataattgtagcacttcctggtttgcagggacattgcaatacttcctggttcatatggataattgtagcacttcttagtttttaggatcattgtgacacttcctggttcatagtgacactgccacactttctggttcatatggataattgtagaacttcctggttcataaagacatttggaaccgtctggttcatagggataattgtagcacttcctggttcatagggacattgccacacttcctggttcatctggataattgtagcacttcctggttcatagggaaattgtgacactttctggttcatagtgacattgccacacttcctggtccatgtggataatagtagcacttcctggttcgtagggaccttaccacacttcctggttcatccagataattgtagcacttcctggttcatagggatattgccacactttctggttcatatggataattgtagcacttcctggttcatatggataatagtagcacttcctggttcacaggtacattacaacacttcctggttcattcagataattgtaaaacttcctagtttgcagggacattgtaacactttctggttcatatggataattgtagcacttcctggttcatagggaaattgtgacactttctggtttatagtgacattgccacacttcccggtccgtgtggataatagcacttcctggttcgtagggacattgccacacttcctggttcatccagataattgtagcacttcctggttcatcggtaaattgtgacactttctggttcatagtgatattgccacacttcctggttcatagtgacattgccacacttcctggtccatgtggataatagtagcacttcctggttcatagggacattgccacacttcctggttcatccagataattgtagcacttcctggttcatagggatagtgccacacttcctggttcataaggataatagtagcacttcctggttcacaggtacattacaacacttcctggttcattcagataattgtagaacttcctagtttgcagggacattgtaacactttctggttcatatggataattgtagcacttcctggttcatagggaaattgtgacactttctggttcatagtgacattgccacacttcctggtccgtgtggataatagcacttcctggttcatagggacattgccacacttcctggttcatccagataattgtagcacttcctggttcatagggatattgccacactttctgggtcatatggataattgtagcacttcctggttcatatggaaaatagcacttcctggttcacagggacattacaacacttcctggttcattcagataattgtagaacttcctaatttgcagggacattgtaacactttctggttcatgtggagaattgtagcacttcctggttcatagggaaattgtgacactttctggttcatagtgacattgccacacttcccggtccatgtggataatagtagcacttcctggttcatagggacattgccacacttcctggttcatccagataattgtagcacttcctggttcatagggatattgccacgctttctggttcatatcgataattgtagcacttcctggttcatatggataatagtagcacttcctggttcacaggtacattacaacacttcctggttcattcagataattgtagaacttcctagtttgcagggacattgtaacactttctggttcatatggataattgtagcacttcctggttcatagggaaattttgacactttctggttcatagtgacattgccacacttcccggtccgtgtggataatagtagcacttcctggttcatagggacattgccacacttcctggttcatccagataattgtagcacttcctggttcatagggatattgccacactttctggttcatatggataattgtagcacttcctggttcacagggacattacacacttcctggttcattcaaataattgtagaacttcctagtttgcagggacattgtaacactttctggttcatatggagaattgtagcacttcctggttcatagggacattgtaacacttcctggttcatagggacattgtaacatttccaggttcatatggataattgtagcacttcttagtttttaggatcattgtgacacttcctggttcatctggattattgtagcacttcccggtttatagggaaattgtgacactttctggttcatagtgacattgccacacttcctgattgatatggataatagcacttcctggttcatagggacattgccacacttgctggttcatccagataattgtagcacttcctggttcatatggataatagcacttcctggttcacagggacattgtaacacttcctctttcattccgataattgtagaacttcctaatttgcagggacattgtaacactttctggttcatacggataattgtagcacttcctggttcatagggacattgtaacatttccaggttcatacagataattgtagcacttcctggttcatagggacattgtgacacttcctggttcatatggataattgtagcacttcctggtttgcagggacattgcaatacttcctggttcatagggataattgtagcacttcttagtttgagggacattgtgacacttcctggttcatagtgacactgcaacactttttggttcatatggaaaattgtagtatttcctggttcataacgacatttggaaccgtctagttcatagggataattgtagcacttcctggttcgtagggacattgccacacttcctggttcatctggataattgtagcacttcctggttcataaggatagttgcaacactccctgggtcatcacccccatcctgccatctgctccagccctatgcagccactcagaaatctacttcctatcccatggatttgcctatcaggggcatttcaaacggcctcccatgtggttttgtgcctggcttctttcactcagcataatattttcgaggtccatcgattttgtaccatgcatcagaatttcattccttttgatggcagaatgacattccattgtatgggtagaccacattttgtttatccatacacttgttgttgggcattgggttatttccactgtgtaactaccatgaataatgcttagcacttagcatacggttaagacttctatgtacatacttgtctgagtaactgtcttcaattttttgggtaaatacccaggaggggaatggctgggtcatatgataactctatgtttaaccattgaaggatccgccaggctgcttttcaaagcaaccgcaccattgcaccatcccacaaacaatataagagtgctccagtttctgcacatctgagccaacacttgtcactgtccatatttgtcattagagccatcctagtgtgtatgatgggctatctcattgtggttttgatttgcatttccctgatgaccagataggttggctttcaagttttcatgttctttcttcttctctgtcaagtagatgagtaatacttaaataaatatttcttactcagcattttgatgtatttattcatagccttattaatgcttgactttatttgtttatctctcagatatgggtctctaaatgtcagtttcaagaaggaactgtgttttgttcaactccaaaatccccagatctatctaggacactgcctgaaacacagaaggggttaaaaaaatatggatgaaatataatagcaaatgcatgtcctattttaaaatatcgacagttattctatttgcagaacaataaattcaatgtgaagactaagatactgttgattatttatgtgtgtatgctcgtatatgtatatatacatacatatgtgtgtatacctctacatgtatgtataggtatgtataggtatacatatgtatatgtacagacatatgtataggtatacatatgtatatgtacagacatatgtataggtatatacacatatacaagcatatatatatacatatgcaagcatacccacattatgtacatatatgtaatatatatatatatacacactcacatatacatacacacacacatatatttacacatatctttataaaacacagacctaggatattttccctagaatcaggtccaaggcagatagttgaaaaatgtctgatttctaatttgtggttgaaataaaactaagaacatttcattattttcatcatgatttattttgctgacttgttgaacatatgcaggcttgttacctgggtggactgtgtgatgctgaggtttggggtatgaccgatcccatcacccgggtagtgagcatggcacccaataggtagttcttcagttcttaccctatccctccctccaccctctaggagcccccagtgtctgttcctctctttgtgtccatgagtacccaatatgtagatccacttataaatgagaatgtgcaatatttggttttctgtttctggattagtttgattacaataagaacctccagctccatccacgttactgtaaaggacgtggttttgttcttttctgtggctgtgtagtatcccacagcgtctatggaccacattttctttatccagttcacccttgatgggcatttaggttgattccatgtctttgctatggggaatagtactgtgatcaacatgcttgtgcaggagtctttttggtaggataatttattttccattatgtatgtatccaggaatgggattgctgaactaaatggtagttctctttttagttctttgagaaatctgggagatatgtcttggaatgaacttcatatagctttttactgcctcccttttaaaatgcttccagaaggctgtcccttatttggtgcacagaaactggctaaaaaataaatgtgaccagctgggagtggtggctcacgtctgtaatctcagcactttgggagactgaggcaggtggatcacctgaggtcaggagatcaagaccatcctggccaacatggtgaaaccccgtctctagtaaaaatacaaaaaattaactgggcgtggtggcgggcgcctgtaatcccagctactcaggaggccaaggcaggagaattgctcgaacttgggagccagaggttgcagtgagctgagatggctccactgcactccagcctgggcgacagaacgagattccgtctcaaaaacaaacaaacaaacaaaaattagccaggcatggtggcacacacctatagtcccagctactcaggaggctgaggcaggggaatcacttgaacccgggaggcggaggttgcagtgagctgagatctcaccattgcactccagcctgggcgacagagcaagactcggtctcaaaaaaataaataaatataaatacaattaaaacaaataatataaaaacgtgacctgcagccacctctccaaggggcctggataccaatggaaggaagtgaaaaggaggagatgaaaaatttacaccttgaaagctgaaagtgttctaatattaccaatgctgtggagtcagacacatcgaaagtgactctaatacctcctgacatccttatgttatgaatatgtagacaatagcaaattattctccgcttttttccagctcattgaaacatgttagggaggaacatttctgcattgacaacagctttaaatatttcattagtgcttggaagaaacacaagaatctgtgacgcagaagggaaatgaaaaggaaagcttagtctccatttagttatgttcctcataaatatttcccagaggcaaagatgttctctttcatattaaaaatacaaataaacacttctcattagcccaagaaaatattgtagagattttcattatccaaaaaaggcacactttcaagacacacggaacagagacggcacattgccttagcttgcttctggctagcatgtctggctattgaccggattttatttttaaatgactaaaataatatattaactaaatggtaaaattcatattcagcattggcttgagggcatcggagggttttggctggcccagtcatctctaccagtgaagaaagcaaggaaataggtcatttcactcagggacagcttgaaaacagagatttcatggagcttcctcattccgtcagcctagagtgggattttggctgtcacccttcaaggatgaaaaggtgcagaggacattgggctgcagacagggcgctcgtttaaatgatttaaaagttttggtcagtcgtggtggctcatgcctgtaatcccagcactttggggcgccgaggcgggtggatcacctgaggccaggagttcgagaccagcctgactaacatggagaaaccccatctctactaaaaatacaaaattagtcgggcgtgatgccacatgcctgtaatcccaactactctggaggctgaggcaggagaattgcttgagcctgggaggcggaggttgcggtgagccgagatcgtgctattgcactccagcctgggccacaagagcaaaactccatctcaaaaaaaaaaaaaaaagtttccatctggctggacacggtggcttacgcctgcagtcccagcactttgggaggctgaagcaggtcaatcacttgaggtcaggagttcaagaccagcctggccaacatggagaaaccccatctgtactaaaaatacaaaaattagccaggcgtggtggcgggtacctgtaatcccagctactctgtaggctgaggcaggaaaatcacttgaaccctggaggcagaggttgcagtgagctgagattgcaccactgcactccagcctgggcgacagagcaagactccgtctcaaaaaaaaaaaaaaaaaaaaagtttccatctaagcgagctctgttggttctcccacctctgaccttatgagttttcttctttaacctgcaccttgttctctgagtcactttgcacttgaaggtacagctacagcttccccatcagacttgttggtcgtttatcaaaggatgaaaaagttcttcctcctttgggtctttaaccctgtttcctggtgtaagacagcttttatgtttgctacctgctggaatcaacttgaaattttctcccagaaaatttgtgaatttatcttgttcaagttacttgtggtcaataagttaataaagataggtagacagacagacaaatacattgatacagatagatagattcatgatagatgattgatagatagatattacacagatacatagatacatatcttagacctgatatatacagggtgggtggatagataaatgaataaatagatagatagatattacatagatagatagatacatagattagacctgatatatacagggtgggtggatagataaatgaataaatggcttgattgatggattgatgattgatggattgatggattggtagataaatgaataaatggctagatacatgattgattgattggtaggtaaatgaataaatggctagatacatgattgattgatagatgatagagattagatagatatatagatacatagattagacctgatagatatatggatatatatacaggatgggtggataaatgaataaatggctagatacatgatatagatagagccaatacatacataggtacatagacagggtaggtgggtagatagatgaagacatggatagataaatatacacagagatagatcaatgatagaaatgggtatatagatatatgaatgatagaagatattttgagagagagatgattaataggcaattgattgacatattagatgacagataaaaagtgggtaaaatgcaagtaaactgtaagccaaacgtccacgtggaatagcgtgggaagcattgagaagacgctttttggtgctacctgtttaaacattgaaaaactgagctaataccctccacagtacgatagaggggagggcactgggaatttatacctcccaggaaaaataaatcatggtaaacaggcagagatctttccagattccagttcttgggggtaaaaggtccccaagatgcccagtttgtgacaacctgttttgaactattcagctcaaggtttccattttttctcccaggggagttgcctcgattctgatgtgtttgcttcggtgctctgtgtattgtattcatcccactcttcaattcataaactctggagattcttcaattcactgggcaaaccatatgcctaagtctatcctctgatggaggctcgtacatgcaaaatccaatagcaacctgggaagatttcagtcaagacccaagaggaggctggcatcaggctctcggtcaccgatcttcacattcaggtttcctgatgcactttgcgactctttgggcaacctctggactccttgttcccagggtccacatttagttttatctttactgcattgcttttatgaaaaagaataaaattggatgaaacagatacagagtattggtgtcaacctaagtattggtgtcaacaaagagatggtttggatctggttccccaccacatcttaggttgagttggaatccccggtttggaggtggcgcctggtgggaggtgactgcattatgcgggtggtttccattgaatggtttaccactgtcccccatggtgctgttgtggcggaagtgagttatcatccaatctggttgtttaaagggtgcaacaacttccccaccccgtcctgctcctgctgtggccatgtaagatgtgcctgtttcccctctgccttccgccatgattgtaaatttcctgaggcctccccagccgtgcttcctgtactgcctgtggaaccgtgagccaatttaaacctctttttctttataaaattaccctgtctcaggtatttctttatagcagcgtaaggactgactaatacactctgtaatagaaaagatgtttatttgggagtatagtagtgcgctgagaatagatgtgccatattaaactgtgttcatattcagggaggtaaaggggaaaaaaggattttaaaggaaataatgaagaggattccataattcttttcaaatgattatccttggctaaaaagatcaataacatggtgacaccagtctgagtttggacagccagtttttgggcagatgtcctcgtggaagtatttttctttgcaagggtgagatttttgcagtctcttacgatagtttttgttatcaggcatataagcataaaaaccattaatatacactagagatgcattgaagagcttataaaattgttaaggttttcttctttggtcagtgtctaaaatatgagtcagatatttccttggttatctttgagatttatgtggtcccaggtttctcctgggtgggtagaaattactgcagcatgtacaaaactgtccttcatgccatatttcttcctaccattatacgatgaaaactaacaaaagagagttttataaaatgttcttcctctttctctctggtaccaataggaagcacaattgtttccccatggttcttcacaaaggttctattgcactaagttttaaagccttgtgtatacacaatcacattcacatataccacacatacacgtgcatatacacagttacatccgtacagatacatacatgcacatgtatacacagataaacacatacatgcacaaatatagacacatacacagacacacattcacatgtatgcggacacacacacatagacacatatacctatgcacagaaaccatacagatatacacatacataacatacatgcacaggtatacatacaaacatacacagatatgtgcatacacatatacacacataacacatgcatgcacacatatccacaagcctgcagatatacacacgtacacacagatatgcatattcatacataccaaacatacattcatacttacacctatacacacacatacacaaacacatacagagatatacacacatgcacacaaatacatacacacatacatacacagatacacatgtacatacataccaaacatacatgcatacttacacctacacacatacacaaacacatatacacaaacacacatacacagggatatgcacatgcacacagatacccacatacacacgtacatactcacatagagttacacacacacacgtgcacacgcaactttggcataatggaaatttgatgattggtcattggagtcaaccatacagcccctgtcagaaacaaaggaccaaagtcgaaggggacatggatgcacaaacatctcaacatctacggaaccacgtaacttggagaaacatgcaaccaactaaggacagaagattcgagtgactgcaactctgttttttttttttttttgagatggagtttcgctcttgtcacccaggctggagtgcaatggtgtgatctcggctcaccgcaacccccgcctcctgggttcaagcgattctcccacttcagcctcctgaatagctgggattacaggcatgcaccaccatgcccagctaatttcatatttttagtagagatggggtttctccgtgttggtcaggctggtctcgaactcccaacctcaggtgatccgcctccctcggcctcccaaagtgctgcgattacatgcgtgagccaccgtgcccgtcctaactgcagctcttactttggaattcaggcagctacggagccaagattcctggagcccacaggcgtgtggctaatacatttcccttcctttccatagaattgggttggttttgttgcactgggtgtctggtagctccggagagaacaaatataaatgtgaaaatgcataccttggtcatcagtgtttctcaacaattctccatcccacttaacaaggcctctgctagaactctggggtccgttccaagaggaaaaacatccctgcctagaagaagcaaatggaagaatgtactctatgctgccatgtgtgttctcatcaggccttatctaagtttctcaccaggagatgttgaaaaatattgcttgatggacgaagggtaacgtactgcagttgtttattgagaaatgccagccgtcatctcttgctcgttagctgctctgaatgctcttagaaggcaccattcatgccgctgtattcgggactgctgaattgtgccacattccttggtgttacgcgtgtctcttgttgatgaagttctaaccacagtgccattgtgaggctggaaatgtccttgggtgaaaaagcggcccctgggtcacctttcccatgattcaggtgcatgtgaacccctctagtgctttactgccagggtccaggagagagggaaagaatgtcactgtcccagcatcctctaatttacttgacaacacaattgttctagtgtcaagagttttgttttgttttgtttttgagatagagactcgctctgtccctcagactggagtgcagtggcacgatctcggctcactgtaacctctgcctcccgggttcaagtgattctcctgcctcagcctcctgaatagctgagattacaggcacctgccatcatgcctgactaattatatttttgtagagacggggcttcaccgtgtcggccaggctggtcttgaaccactgacctcaggtgatccgcctgcctcagcctccaaaagtgctgggattacaggcctgagccaccatgcccagccaggtatttttttttttttcttcagctcaagaatgaagtttttcttagtatcctgtagctaaaatgatgcttctccaattttatttattaaaaacgcctaacgctggccgggtgcagtagctcacgcctgtaatcctagcactttgggaggccaaggcaggtggatcacggggtcaggagattgagaccatcctggccaacatggcaaaatcccgtctctactaaaaaaaaatagaaaaaattagccgagtgtggtggcgggcgcctgtagtcccagctactcaggaggttgaagcagaagaagcgcttgaacctaggaggtggaggttgcagtgaaccgagctcgcgccgctgtactccagcatggcaacagagtgagactgtttcagaaaaacaaacaacaaaaaaaaacaactaatagtaatgatcacatttttgggctcaaacatcttaattctggaaagaggagatgccacaatggataccacactaaagagatgctctggagaattttgcaagggaagaaattgtcatcttagggagggcacactggggaagcttttcagacactggtcattcaccggtatgattagaagaaatgccacacagacctcaggataccttgacccagacggggtcactctgatgccttctgaagtgagaaattgatcacgttaccacagctagtcaccactcactgggtgacttcagacaaagaaaattgacgttgtcaccgttccaaagaccagaagtctgagatctaggcgtgagcagggctgcgctaccctggaggctctaggggaggatccttcctgcctctcccagctcctgggggttccaggtgttcctgggcttgtggccacatcactccaatccctgcctccatctccacgtggccgcctcctctgtgtctccaaatctctatctccttgtaaggacactagtaattggatttagggcccaccctaaatctgggatgatctcatctcaagatccttcacttaagtatgtctgcaaggaacctatttctaaataagatcctgtttctacattttgagggtgaggacatgcacatcttttttttctttttttgagacagactctcactctgtcacccaggctggagtgcaatggcacgatttcagctcactgaaacctccacctcctgggttcaagcgattctcttgcctcagcctcctgagtagttgggattacaggcgtccaccaccacacctggctaatttttgtatttttagcagagacagggttttgccatgttgctcaggctggtctcgaactcctgaccttgtgatccgcccgcctcagcctcgcaaagtggtgggattacagacgtgagccactgtgcctgccgcacatatctttttatgactcacaacaatatgcaactctggcatgcaatcatgctagtggtttacttgggcagaccctccaggcctgcgtggcaagggagtgggggttcacgccacagcaaagaggaggaaggaaaacccctgtgcttcagctttttcggatcacaggaaagagcaaacccagcaattcaagggcagcggtcaaagactgcaggtatagagcatgagaagcagtgagcacagggctggaggggggcacagaaatggtagcaaaggtcagggatatgaggggatagcttgaggtggggccgaccttcatgggagggatggcagaaggcgaagatgattcaaagggaggatggggcaccggtaacatcagctccaggagctcaggaaagtgtagaagggagctccttctccatccaagactgaccccgtgtctctcacgctttggtgcaaggatgcatggatgctgagactcataggaagggtgtgtgaggcatgaagcatgtgggaagtggaaaaagggaaagaggaggagaagggctgtggggaaataagtgagtagaattgaggaaacagaccattgacttaattcttgaaaggattcaaaggccaggtgcagtggcttatgtcagcaaccccagttactcaagaggctgagagaggaggatcacctgagaccaggagtttgagatcagcctgggcaacatggtgaaactccgtctctactaaaaatacaaaaattggctgggcaggctggtgggcacctgtaatcctagctacttgggaggctgaagcaggaaaattgcttgaaccaggaggcataggttgcagtgagctgaggtcgtgccattgcactccagcctgggcgatagaatgagactctgtctcaaaaacaaaaaaacaaaacaaaaaagatacgggttgagcacagttgctcatccctgtaatcctagcactttgggaggttaatgcaggaggattgcttgagaccaggaattcaagtccagcctgggcaacatagtgagaccccatctctaaaaaaacaacaagaaaaacacaaaaatatacatcatgacacctgtattcacactcctcatatactgcagacaaatgccattttgaagagagggagctttattcctgagtgggcggaggaagaaggatgaattgaggaagtgtgttcattacttgtcagctgccaacactgaaaacaacacatgtttattttcttacatttctgtaggtcaggagtctgaaatggatttcactattttaaaatcaaggtgttgggaggcttgcagtctctccagaatctctaggagagaattcatttcttactttttctagtttttacaagccacctgccatccttggctcattagccgttaccccatcttcaaagcacatgactccgacctctgcttccatcctcacatcccttttttctgcggttaaatatctcccttcctctccttataaaagccctgggaccccactgtgattccatagatcattcaaaaaatgtccccatcttaagaaccttacctgaatcctatctgcaaattcctctttgtcctaaaagttcacaagttctaagaattaggatgtgggcatctctggggaccaggattgtacctgccacatagggtttgaacacctgatgggatctgggagcctgatgagggagggtgtcacccctgaggggctgggtcaaagtgaaccaagtagctagaacaggtggtcacaagaagttggtgattcccaagggcaccagcttgggagaagtaagtggggcagctggggacccctccacctctagggtcatggatttggagccaggcactgagagcctcccaccaggagagggcaccgtctacatataaagagaaagataggccgggcacagtggctcctgcctgtaatcccagcactttgggaggccgaggtgggtggatcatctgaggtcaggagttcgagaccagcctggccaacatagtgaaaccccgtctctaccaaaaatacaaaaattagccgggtgtggtggcgggtgcctgtaatcccagttactcgggaagctgagacaggagaattgcttgaacccagaaggtggaggttacagtgagccaagatcacaccactgcactccagcccgggctggagtgagactcagtcttaaaacaacaactagctgggcgtggtggcacacacctgtaatcccagctacttgggaggctgaggcacgagaatcgcttaaacttgggaggcggaagttgcagtgagccgagatcacgccactgcactccagcctggctgacagagcgagactccatctcaaaaaagaaaaaaaaaaaaaaaaagagagagagaaagatacacattgtatatgcagcaggaccaggcctaaaagcaactaacactaacagagaagttttcaaacctcaggaagatggacccaagccatatcactggcttcttttcaagggaaaatttgatttttttttcccttaactgaactcttttgggccaccctgttgactgtaatgagcacagactgcgtttatcgtgggaaatgaactttgcaatgaattactccaagaaatgatgccgttagcaatgggtacatgagtggaagcaacagcagcgtgggatcagagccaggatctgagagatgcagagctgggaggcaggagaaagctgtctgggagcaagcagagggtgctagacccaatgaacatggcaagcaaggctagaccctgaggacagtcaaagggccattttcaaggttgaggactgactgtggcctcactgtgttcccctccatggcacgccatacctgagctcctctttccctcctcactgagccccacaggatcctcggttccatcgaccacaggccctttgcacgtaccacacttgctacacaaaactttctgcctctaccttgtgctgtcttcatacttcaattgtcagctccactgttagctccatggtcacttgcccttaaaagttcacatctgtggccgggtgcagtggctcactcctgtaatcccagcactttgcgaggccgaggcgggcggatcacggggtcaggagattgagaccatcctggctagcacggtgaaaccccatctctactaaaaatacaaaaaaaatagctgaatgtggtggcatgtgcctgtggtcccagctactcaggaggctgaggcaggagaatcacttgaacctgggaggcggaggttgcagtgaatggagattgcgccactgcactccagcctaggcgacagagcgagactctgtctcaaaaaaatttaaaaaaaaataaaaaagttcatatatctgtgtccctgcctgacccaagctgaccatgttataagcatctagaagcctcacctccttactgcggctctgaccacggcactacttttatatcctgtgggcaattttgtttaaatatccgctttcctcgttagacgctaagcaacatgggagtgagtgtctggccatggtttgctcatctgtgcatctccaggactggctgggttcctgggtatgaagaagcagcggtccacacacatgggtgaacctgtgcttcttctcaccactacactgcttggcttccttatttccttcctgtcacctggaatgcctaccctgtacttctctccagctccaacaccatcatttaccacctcgttcagctcccaggcatcctagaagcctttcctgaccacaggggtgcatcgtggtgcacaattccttcagctgccactatggtgcaagatgagtctagaagaacagttttgctgtgcggtcacccttactcactattgtgattttgcctttaacatattgaaaaagacacagaaaacacacaccatccgatcagttagttgcagacacatcgcccgatgctaagaatgtgctgtgttttaaattgacgtctgttggctcttcagcttctgctctgggcttcttatgtccccactcggccctgaatcccattcccccaaatctcagtaactttggtggcttttgcaccagccaaaatcagatcctaggtcttgagcaaaaccaagagcaaggaaaaaaatcccacatgggaatctgagacctcactctaatgacttcagttgctgttgacttgatttccttcaactgccgaaggaggttagaacagtttcctcttgcttctaggacaaagcatcacagactttgcagcttaaaacaatgcacatttctttgcttacagttctggaggtaagaagtctgaaattagtttcctggggctcccatcaaggtgtcagcagggctggcttccttctggaggctctaggagagaaacggtttgcttgacatttccagcttctagaggctgcctacacgccttattatgtagctgctccctccatcttcaaagccagcagtgtagcatcttccaatctctctctaactctgaccctcttgcttccctctttccatgataaagacccatgtgataacattggtcctacctgggtaatccagtaatgtcttctcatctcaagctcagctgatcagcaactttcattccatctgcaaccttcatttcccttgcacaggttctgggaatcaggacatggatatctttggagcctgctattgcttctacctacaactggtgttacaagacttggcccacttaatcttgcaaattctttctgcccctctcctgtgcttaatgagatctgttctctatgaatgttcaggacctcaggagtagggaccccaaaggctgggggcaaagtagatgtgacaggtgccaagcataggatgtgtgaccagattcggtcatgtgattacattgtgaagtgacccaggcattttcattaagaaggaaagtggttgtaggaggaggaaattgaacacaacccacacatgggtggttggaaaatctgagacctctcgtgggcatgctcatccatttcactcaccggtacaggggaaattcttagacctgtcagtgcaactatttgaaataaacatccaagaaaggcagcaaacttcaggtaggatgaagtcagaagtccaccctgaagcacagtaaaagccacaagacagaagtgactgatcccatcccagggatcctaaagaagattatcatcagacttctcattggaaactttggaagtcggaaggcagtaggctgataaattcaaaatgctaaaaaagaaaaccaatgaaaacatgctaaccaagaaaaaaaaatgctacatggctgaagaaatcatgcagaaatcttagcaacattttaaatgatccaacaaggtctgttgtttctgcgcaaatatgggcaaacatgagctggtatagcttatttttatgggtgcagggagcatgcagttatctccactagcatgtttttgtttgtttgctttgagatggattctcactctgtcgcccaggctggagtgcagtggcacaatcttggctcactgcaacctccgtctcccgggttcaagcagttccctgcctcagcctcctgagtagctaggattacaggtgcccaccaccatgcccagctaatttttgtatttttagtagagatggggtttcagcatcttggccaaggctggtcttgaactcctgaccttgtgatccactcacatcagcctcccaaagtgctgggattacaggtgtgagccaccgcatccagcctgtttttcttttcaactcatgcataggttcagaatttagttccaggtatgtgagagctccttgtagatgtttttcatgatgaggcacctggcttaccagactttatctgacttcttgctttatcttcccaacagttcagcaccgtggtgcggtacagggtcccattagcaggtctcatttcccaccactgactgaacatcagcaggctcaatccacaagtcaggggctggggatgtcttgtcaagaattccctctttaggggcaggaatgaaatttataacaacatccatactgtttgatggagccctctctacatggcaggtgctttgcaagcactttcagaaaatctgcaccaaaccttatagtaagaatgatcgctgtcattctacaagtcagaaacttgaagatcagattggtgacatgttcagctaatgcactgctaataaacagcagaagtgaaattcaaatatcaagacatttgtcctcaaagtctatgcttgtaactagattatggccctgatatcctaggggtgaatcagtttcagtttcccttcctggacccccagcaagtagtacatgggaattattctagtccggtatagcggggagcagtgtaaacagataaacaaggttttccggggccctggtttaggcaaataaatcttacaacttatctggctctttcaagtcgacttcagacttcgccttgctttctagactgttttgcctaatggaaaatagtgtttgtatctttagaaaatgtaatacgtgattttcccctctcaatattttgcaggtcagagatattgctttgatctattttcacataataattattatttgaggtctcaagaccagcatcttcatctgtgtggggctctgagttaagggctttccagagactcactcctgccgtttcttctaactcccttgagcagaggccagcagtagagaaacttgataaataacacaagtgctataatccctgagtcctctaagaaatgagacacaaaggaaagatccagggacattttcacagatgtgcccaattccagtggccccaggtttcccaccctgctgttgatattctgccacccatagtcgtgatcatctggctacaaaacagcaggcaaggctgtgcatgagtgatgttacaggtgggctcatggctacatggatgtctagacatgtctaggtgtccatatgcaggacctgagggaaagtgagaaggagggagggatgggtgaatagatggatagataaatggatggaaaggtggacgaatggatagatgcatgaatggatggtgaattggtgggtaaaatggagggatggatgggtgtttggatggatatttggatggatggatggatggatggatggatggatggatggatgagtgaatggctgagtggatgggtagacaggtggatggatggagagatggataagtgtttgatggatgaatagacacatacatggatggacaggtgtttgggtggatgtgtaggtggaaaggtggatagatagatagatgggtggatggatagagggactgatggatcactgaatacatgtgtcaatgaatgggggatgtatcattggagggatgggtgagtggtatggtggatgagtagatgaatgagtgggtggatagatggatggatggatggatggatggttggatggatggtaaggtggatgagtagatgggtggatgggtggatggatggatggatagatggataggtagataagtagatgattggatggatggatgcatgagtaaacaggttcatggatgggtggatgagtggatagatggatgggtggatgtgggtggctggatagatatgtagatagatgcaaaggtgaatgcaaagagaaggatagatttatgaggatgcaagtgagaatttttctccttaggtcatcaggggaaaattaaatccttacccacggagacatctttcatttgagtcaggcagaggccctctttttctctctcctggtgaccaggacaaagagaaatgcaggtgtagagagctctgatcagggagccctgcctgcctcctgtcctgggtgacctttaccaaatcctctcctgcgttgggtctccctaaccttgattttcaaatggtggcttcagggctttgccttttctgtgtctgtggttctctgtcatctatcaagtctcccagggagccccttcttgcctcccctctgtccctttggcccccactccagaccccagactgggttcagggttcctctctagaagtcactgatgggagcccacaccctgaaaatgcctttagtcttcattccagcctctcctctctgccaagtgagctgcccttgctggcagcagtcacttcctcacacagggggatgcttgttccagcacactgagtaagtgctgtctcctgagtgggaattggcttggcacaggcgaccgtatgactgtttcaaaaagtcattcaaattctttgtcttgtacatcctgtctggaagcacgtatatacattcccgcctccccactgggcacgctcttacccttgcgctgccattctggtgctaggagctgtttgtgctgtccactgggtggacagagacgtcttccccatgaaaagaggaatcagggttttcatgtatctcttagaagccgggcatttggcaccggggctcatgaacagctgatttttgaagtggtcccagggaaagctcagttggtgactgataagaagaaggtctgggctgggtgcaggtctcacgcctgtaatcccagtacttttggaggccgaggcaggcagatcagtcaggagattgagaccatcctggccaacatggtgaaaccccgtctctactaaaaatacaaaaattagctggccatggtggtgcacgcctgtaatcccaggtactcgggaggctgaggcaggagattcgcttgaatcccggaggtggaggttgcagtgagctgagatcatgccactgcactccagcctgggcgacagagcaagactacgtctcaaacaaaaaaaaaaaaaaaaaaaaaaagaagaaaggaagaagaagaagaagaagaagaacatctgaagaattgggatactgaggcatcatcttccttgcccagtggatctgtggtttcataccctgggtctcctgaagctttggggtttttctcattttttttttctttgagatggagtcttttttctttataaattatccagtcttagttatttctttatagcaatgtgagaacaaactaatggtgctggtctcctcaaggaaactcctgccacaccccctccctcatcttctttctctctgtctttttgttttgaggtggagtctaactctctcgcccaggctggagtgcagtggtgcgatcttggctcactgccacctccgcctcccgggttcaggtcattctcctgcctcagcctcccgagtagctgggattacaggcgcccgccaccatgcccggctaatttttgtatttttagtagagatggggtttcaccatgtgggccaggctggtcttgaactcctgacttcaagcgatccacctgcctcagcctcccaaagttctggggtgacaggcgtgagccaccgcacctggctggggatcctttttcatctctggtggacaacaaggtgtattttcctcttgctggtccagggggcagcagagggagaaggagactacagtgtttgggggtccgtgtgtgtgttcttttcccccctggtgcctgctgtgggaggtcacataatgcagatggataatgatggcacagacatatcctcgctgttggcctctcccactttacttcatttgtgatggatgcaccacccattgagttgattataaaaggctgataaggctgggcacggtggctcacacctgtaatcccagcactttgggaggccaaggcaggcggatcacctgaggtcgggagttcgagaccagcctgaccaacatggagaaaccccatctctactaaaaatacaaaattagctgggcgtggtggtacatgcctgtaatcccagctactcaggaggctgagacaggagaatcgcttgaaccagggaggcagaggttgcggtgagcagagatcgtaccattgcactccagcctgggcaacaagagggcaactccatctcaaaaaaataaataaataaaataaatgaatacataaataaaaggcataataagcaaattgctaactgtggggtctgtgactatggactctttcttgtgttcaaaatagcttttctgcagagttaactgtgcaaacccaggacagcagattctgtttgtgcccttcaagtggtttagatttcagattaccaagatagaaaaatatgtttgactacctgtccacagttctgtattttcagttcttataatgggactacaaataagacaacctgagcctttgtttcccatacccctgaatgcacagaaccagagttctgaacgatgtttttgtttgtttgcttttgagatggagtttcactcttgtcgcccaggctgggtgcaatggtgcgatcttggctcattgcaacctccgcctccgaggttcaagtgattctcccacctcagcctcccaagtagctgggattacaggcatgtgacaccacactcgggtaattttttgtgtttttagtagagacggggtttcacatgttggccagggtggtcttgaactcctgacctcaggtgatccacccatgcggcctcccaaagttgttgggattacaggcgtgagccactgtgccaggcctgagcaatgtttaaatcctcaaagcatcactagaattctgataactgtttttacaaagaaggaaaggaatcattattggcaaggatgtggaaacattagaattctcctactttgctggtgggaagttaaagtggtgtagccactatggaaggcagttttatggctcttcagaaaattaaacacagaattaccaagtgatgtagcaatcctacttctacctaatacctaaagatactgaaaacaaatgtgtaaacagaaatttgtacacaaatgtatgtagcaatatccaaaatgccaaaaggtgaaaacagtccgatgtccatctaatactaaatggataaaccccatgtgttccatccatacaatggaatattattcagccacgaaaaggaatgaaacagtcacatgctacaacatgaatgaaccttgaagacgttatgctaagtgcagaaagagagacacaaaaggtcacatattgtaggagtccatttatataaaatgtccagaatagttaaagccatcaagacagaaattgaactcatggttgcttagggctgggggcagggaaaatgaacagtgattacttgataggtacgaagtttcctttggcggtgatggcagggttctggaactagatagcagtgatggtggcataacactgtggatgtagtcaatgcgcctgaattgttcacttaaaaatggtaaaaacgggccgggcgcggcggctcacgcctgtaatcccagcactttgggaggccgaggcaggcggatcatgaggtcaggagttcgagaccagtctggccaacatggtgaaaccccgtctctactaaaaatacaaaaattagttggctctggtggcgcatgcctgtattgctagctactcaggaggctgaggcagaagaatcgcttgaacccgggaggcgaaggttgcagtgagctgagattgcgccactgcactccagcctgggcgacagaatgagactccgtttcaaaaagaaaaaaaaaaaaaaaaaagatgaaaacaggctgggtgcagtggctcacaccttttaatctcaactctttgcgaggccaaggtgggaggattgcttgagcctaggagttgaagaccagagtgggcaacacagatccagtctctaccaaaaaattttaaaaaatcagctgggcacggtggcgtgtgcttgtagtcccgtctcctctggaggctgaggtgggaggatcacttgagcccaggaggtcaaggctgcagtgagaggtgtttctgtcactgcactgcagcctgggtgacagagggagacccccatctctaaaacaaataaatacatatgtacacaaatgaaaaggttaaatgatgaaattaatgttatgggtatttttccacaacaacatgcttccccacagaaatctcagtggagaagacaggagtgtggcagaccaacatgcttctggagctccacaaagctgtccctttaattggcagcacgcctggtgaaggctgtttgctttgtggacgttgacctccacctgctggcccagtgactcctgctatcttcattttgtccagttcacctctcagtccccagagccgtacaaccatctataggttcttgcttctcccttttcccctagaagcatctcctgggaatcacccctgaccaaaagccccaggcacctctccaagaccccctacagaagcctaaacagcccttacattcattgcctttggacctacccgaagtcaacaagttccaaactcgtcagaaactgggagaagtctcagccccaaatcaatagcagccgttgtcagctcctcccagctcaaagtcccccagagatcggttccctggtctgagtcaggaacgagagactgaaaagcatggggatctggtgctttttcttcatagggttagtcgctttccccaccaaaaaacctaccaactgaaagatcactgattggatgggtcaaccagcctcagctaccagatgtctttgagatggggagccagccccctaaagctgagtctctgtgtgtggcttccaaatacctggtcccctgggtgcagacagaagagaggacgcagaggctggacatctcccagaggagggggagactggctggtcaccagataatcttgcttccctctctgatgtcataggaacatgaacagacttggagatgctgattgaaagtacatgtcacctgaaggagacattggttccagagccattaattcctaacctcctaccatactctctgcatggtggaagatgccagaacattctcagagcttgagaaaaaagaggaattgagagaagggacgggggtcaagagatagagaaggtgagaggaatgtgagagaagcaggggacggaggagaagagaggaaggataactcagaagctcaggtctaacttcaccccactccccttaggacccccccactctaactgttgtttctgagagttcctgggggccacccataaacaatgaggttaaatgtaaatggaagggcaggactctgttgaagtctgcagaaggtaccctgttggctgcatagtcaccagctctcatgacccaaagaggagagtgagcaggtgactggatcatcagtgagggtaaatctggaagacagaattggagccaggtgcagtggctcacaactgtaaccccagcacctttggaggccaaggtagaaggagcacttgagcctcaggagtttgagaccagcctgggcaacatagccagaccctgtctctacaaataatttttaaaaattcattgaaggatttctaaagaccacttgagtggtttatgtctcctggagtcagaacccagggaggatttttgctgaaataccaaagccgcagggagcatgaatagagatgttcagacagaaattaagtttgaagaaatagactttggcagagaggcacgtggccacagacaagaactcatcatgcattcattctttcactcactcagcaaacattaaatggactctgtctaactgcatttccctctcttgacaagagggatacatcggagagagacaggctgaaggaatgtagagttgatattggacctgggagctttccaaaggcactgtgctctcctgtgcccttcttcgcatcccagtctctacgatgttgaccgtgttcgtgggtttcacattgctgttgacataccagaaagaatatgcatgaaccacagtgacaaatgtcattcataatcattttcagcacagaataacctacagaaatgtcttctgtgtaccttcccctgcaatattttgtgattctgatgcaactggagacaaaacatctcttatccatggcctctcttgaatcaattttatctccaatctgccttttcatgggtactctaacaagaaagcaaacaaggaaagttcagctggtctagcagttctgagacagcaaattatctcactgttgatgtggacaaagagcctcttgcagaaagactatacttaactctgagaatctgggtcccagcttttttttttttaatccagagagacgtaaatctgaaagaatctgagtcccagccgagctgagagaggagtaaaatcacggaggcatgcctccactcagaacacatcattatcgtgcttttatatggaaggcacagccattcactcattgtccgatagacgtttccattgaacgttggatctcttcaaaccaagtgtctgcaaacatgatgggttttgcactgatgctgaggatgaatccaacaggaaagatacagagaaacatcacattgcaccccagagacatatgcaattattgtttattgattaaaaatataatgaaaattaggaggctgaggcaggtggatcatgaggtcaggagttcgagaccagcctggccaatatggtgaaaccccgtctctactaaaaatacaaaaattagccgggtgtggtggcacgcacctgtagtcccagctactcgggaggctgagacaggagaatcgcttgaacccgagaggtggaggttgcagtgggccgagatggtgccacagcactccagtctgggtgacagagcaagactctgtctcaataataataataatgaaaaataaaagaggaacaagggaaaccaaaagtaagcgtatagaagagcagtttaacatgcaatttcattttatttatttctgctttaagtttattatttaaatggtatctcaaacgaagaaggctggccactcgttccctcttctgttaccctatcattggaggttttgttctttgccttggtatgttgagagaacccagaggtctgtgagtaaaattccggggttttgtcaactcagatgggacaaagtctacatctctgggttcactcacttgtaactgaaattcagcattgcctgtggacataggcaacatcccacaacaatgttagtcttgcctgtagatttctcaccaaccattatcacaaatactttcctatccctgtacaggagttgcagatgaaatatcctttatgctcatgaccacttcagcgttactgtgcatcttggacctgcctcaaattattttaatcttatgaatatctaatgcattactgtgtttccattgcacaaaataaaacaatgacttagcagttgcccaggcgaggggaaccacttccaacaggtgggactaatcattcagggttttcgaaagttctctgtgtagttggattttaagctcctgagttaatctgatagaactttctcatctggttttaagaagtgtggttaatggggatctcttgactgtagaatcagttttaaaacaccacatttacttctgacagtaggtaaattttaccttgggcagaattgtatggccttggtggtagttagtataaattagtatgaattaacttgggcatatgtgaaaattactatagcataaattaatgaaggcctatgtgaaattttgcaattattttctgtattcacctaaaatggcattgcactggaaatatagtatgcttcttttgtgatttctacatatctctgtttttttctcatatcagattctactttacccctcagtgacagtcattttacacccctctctgtctcaatgtcctaggcaccctgggaccatcctggctggaaggcatagtgacattgctggcctgagctgaagtgccgattaaaataaattgaaagctgaattaccttatgaacagctgctttacccaggaacaaatgtggagaggaactccttgaaactgtgttctcaagtagaccacttttgagaaattatacatttatcataacatctcaagtcctgctctacatagaatgaccattattatcaagaaaagttctccattccctgtaattcataaggcaatgcaggcctaaccagaaaacaggaactgcgacaaccttgcatcagacacattcgatctctctattcatagttgcattctctttttttttgtttacaaagccaatcaccaataactcggaaaacaaaaacaaaaaaaaaaaaatgaacacattgttgagctcgcttctgagaaagattctgcattgtgaatgtcaggattccacatttctgaagcacctttgctcctccagaaagcatatctctagtttcatggtgatacgagagagaaatgacaattgtctgtattatcaggatggcccattgtgctctgtggatctcaatcaatgtggacatcagccatgatcaagctctttcttttctctctctctccttccttccttcccccttcccctcccctccccctttccctttcctttaccttgtttcttgcttcccttccccctccccttcccttccctcctctctcctcctccctccccccttccccctccccttcccttccccctccccttcccttccccctccccttcccttccccctccccttccttccccttcccttccccctccccttcccttccccctccccttccttccccttcccttccccctccccttcccttccctcccctctccccttcccttccctcccctctccccttcccttccccctccccttccttccccttcccttccccctccccttcccttccctcctctctcctcctccctcccccctttcccctccccttcccttccccctccccttcccttccccctccccttccttccccttcccttccccctccccttcccttccccctccccttccttccccttcccttccccctccccttcccttccctcccctctccccttcccttccctcccctctccccttcccttccctcccctctccccttcccttccctcccctctccccttcccttccctcccctctccccttccctcccctctccccttccctcccccctccccttccccctccccttccccctccccttccctcccattcctcctctctccccctcccctaccccctccccttccctccacttctgtcccccttcccttttcttttcgcttcttttcttttcttgagacaggatctcactctgttgcccagactggagtacagtgaagtgatcatgggtcactgcagcttcgacctcctgggctcaagccgtgctctctcctcagcctcctgagtagctgggactacacacgcacaccaccatgactgcctaattttttaaatttttatattttttggagacagcgtttcatgcaggttttcatgcccaagctggagtgcagtggtacagtctcttggctcactgcaacgtctgcctcctgggcgaaagcagtattcctaccttggcctcccacgtagctgcagccacaggcactagccaccacgctcggctatttttttttattttttagacacaagacttcaccatgttgtccaggctggtctcgaactcctgagctcaagtgatacacccgccttagcctcccaaagtgctgggatcacaggcatgaaccaccatgcccagcctggttaatgtttaaatgtttcctggagatggggcttcactatgtagtgcaggctggtcttgaactcctgggctcaagtgatccacctcagcctcctaaagtgctgggatgacagatatgcacccccacactcagagatattattttcttttctttttttttttctttttatttttttgagaggggtcttgctcttgtcccccaggcttgagtgcagtggctcgttctcagctcactgcaacctccaccacccgggatcaaacaattctcctgcctctgcctcccaagtagctgggattacaggcacctgccaccacgcctggctgatttttgtattttttagtagagatggtgtttcattatgttacccaggctggtctcaaactcctgacctcaggtgatctgcccgccttggcctcccaaagtgctgggatgacaggcgtgagtcaccgcgcctggctgaccatgctttcacacaaatgtcccagaccctggggacgacagctgaccagagagtgattgaactatgcagagtcccagcctcacctcccacatcccttctctctcatttgcccacctattacccctaccttaaaaaaacaccctgtagaaatacccactagggccagacgcattatgtgaggcttttcattttttattcttttttttttttttgagatggagtctcactgtgttgcccaggctggagcgcagtggcatgatcttggctcactgcaacctctgtccccccggattcaagcaattctcctgcctcagtctcctgagtagctgggattacaggtgtgcaccaccacgcctggctaatttttgtatttctagtagagacggggtttcgccatcttggccaggctggtctcaaactcctgacctcaggtgatccacctggctcggcctcccaaagtgctgggattaacaggcgtgagcctccgcgcctggccaaccatgtttctatacaagcgtcccagaccctggagatgacagcagaccagagagtgattgaactatgcagagtcccagtcccacctcccaaatcccttctcctctctcctttgcccacctactaccccccaccttaaaaaacaccctgtatcaatacccggtagggccagaggcattatttgaggctcttcattattttctgagacatcaatagactacgtgttggcagaataattgactttgcaatttacattggtgatataggagggacagatcctgcttctcggaaacctccatgatttgcacatgtgcctgcctcctcctttgcaggtgcggtgtttgggaaggagcagtgagccacagggggatgggagcccaaggtgtggccctgcagggagggtccaatggcccatgagtgtgggtgattcaagaatgtcagactggctgggcacggtggctcactcctgtaatctcagcactttgggaggccaaggcgggcagattacctgaggtcgggagttggagaccatcctggccaagatggtgaaaccctgtctcgactaaaaatacaaaaattagctaagtgtagtagcaggtgcctgtaatcctagctacttgggaggctgaggcagggaagtgcttgaacccaggaggtggaggttgcagtgagccaagatcatgctactgcactccagcctgggcaacagggtgagactccaactcaaaaaaaaaaaaaaaaaaaaaagagcatctgtcatttgcaacaacacgggtgaatttgaaggatattgtgttcagtgaaataagccaggcacggaaagacaagtaccacatgatctcattcctatgtaaaagtctagaaaccttggtctcacagaagcagagagcacagtggtggttaccaggggatgggcatgggtggggcatgggaagatgttggtcagagtattacaggccactagacaggcatgggcgggcaggagagggctcttccacccaccagcaatgccaggtgctggttcagcgatgatcgcattgcctctctaaaaaatgataaattggcggctgggcacggtggcccacacctgtcatcccagcactttggaaggccgaggcaggtggatcacgaggtcaggagttcaagaccagcctggccaagatggtgaaaccccatctttactaaaaatacaaaattagccagacatgatggtgcatgcctgtaatcccatgcttgaaactgggaggcggaggttgttgcagtgagctgagatcgtgccactgcactccagcctgggcgatagagtgagactcagtgtcaaaaaaaaaaaaaaattggcagcctgtggcagggagagaccatttcctgatgttccacacctgtcacactcaattgttcattgagtgcaagtgccgtggaaacacaacttcctaagcatgcacattaggagaaaacatggcggaatatgaccttctgaggtcactccactggaaacaggaagaaagcctcagatatgggcacgctacaacttcctaaacctcatgctcacctcccaagcataaggagggcactgtgcatgcgggcagctcaccctaggggaagaatcatgggaaagggatacaagatgctagaagtggaccagcctataaggtcctgtaaagttaaacaccacacttgttcttcagggcgcctgcttgggtctctttcaagtgtacttccgttcttttctgttctgaagcttttaaaataaacttccactcggctgggcgcagtggctcatgcctgtaatcccagcactttgggaggctgaggtgggtggatcagaaggtcagaagttcgagaccagcctagccaatacggtgaaaccccgtctctactaaaaatacaaaaattagccctgcatggtggcgcacacctgtaatcccagctactcaggagattgaggcaggagaatcgcttgaacccggaaggtggaggttgcaatgagccgagatcgcactgctgcactccagcctgggtggcaagagcgagactctgtctcaaaacaaaaacaaaaacaaaagccttccactcctgctctgaaacttgcccgggtctctctctctgccttatggccctcagtcaaattctttcttctgaggatgcaagaattccagtggctgcaggcctgtatggattcatcactggtaactcagataccttccaccacattataataaaagggcagaacatttcagttagacctaaggaataagttcaagagatatattgcacaatgtggtgattgtagttaatatcaatgtactgcatacttgaaaaccactaagacagtagattttaactgttttcaccacattaaaaaaataagtatgggctgggaatggtggctcacgcctgtaatcccagcactttgggagggtgaggggggtggatcacgaggacaggagattgaaaccatcctggctaacacagtggaaccccacctctactaaaaatacaaaaatttagccaggcgtggtggcaggcacctatagtcccagctacttgggaggctgaggcaggagaattgcttgaacccaggaggcagaggttgcagtcagccgagattacaccactgcactccagcctgcatgacagagccagactccatctaaaaaaaaaaaaaaagtatttatggtaatatgttaattagttttagttacccatcccataatggatacatatttcagtatatgaatggaatgttatgttgtatatcagaagcatatctaatttttgtttgtcaatgacaaaaagaaaatagtcctcatcattgtgactggctcaggctaaacacatacactatttttatttctgcagttactcttctatttctgtgctacgtcttaaaattatccattgcaaatggcatgtagctttgaaaatataaacttgccacctgatccaaaacttttcagttctgtcatagttttgtgttttttttttttttttgagatggagtctcattctgttgcccaggctggagtgcagtggcatgatttcagctcactgcaacctccacctcctgggttcaagcgattctcctgcctcagcctcccgggtagctgggactacaggcgcatgctgccacgcccggctaattttttgtattttagtagagacagggtttcaccgttgttgcccaggctggtctcgaactcctgagctcaggcaatccgcctgcctcagcctcccaaagtgctaggattacaggcgtgagccacggtgccagcctccgtcatagtttctaaaacacccacaccacaacagtaatcttgactcaacttcagctcctcatcctgtgtctaagccaagtttagccgaagaaaacatctgccgagaaagtaaaaacaaaaacatctgccaaaggcaagaacccggtgggaagccccctgagcccagtggcctgcagagtctgttctagtgacaaagcaggcaactggaagagatcagggctgcgagacagcgtgggtgggtttttatctgctgcttctgtaaattcattgcatgatacgtctgtttttcagaggtcccaaagcaaagaaacaaagccccacagagttcacccagagggaaggccttcactggatcaggctataagagaaggactctcccctgagaaagataaatacttattttggggccgtgtttagagaaaaaggaagaacgatggctttcccatagaaacatttacttattttgtgatttgaaaatggacttttatgttttaggaattatgtggatgggatgttttcttgggtgatcgatttgaaattgcagaggggagcaggtgccatgtgctggcaatggccggccttccttccttccttccttccttccttccttccttccttccttccttccttcctccattcctcctaccccccgtttcttccttctttctctctctttctttccttttctctttttctttctttttctttcttttctttctttctttctctctctctctttctctctctctctctttcattttgtttgttttaatgagtgagagtaaagagaaagaaaagaactgtttttattttttgtctacctttattgtaaggagagagtgaggataccatgccacacatgcagggtcctgagcagagggctgcaccctgcttagttctaaagacacctagactttatcctgaaagccactgagaggcccatattttgaaacactcagcctctcagaagaggatagaatgggttgccagtgtaatagggagagaaatcgaacatagctgactccatgttgcttctgactcctcaagctaactgcttttaggcacttctgcacacgggccaagttaatcatggaaagaacttagattacagtttaactggaaagcaaggatgataagcgttcctttccaaaactaacctctgaggagataagaagggcatgcacacaagtaacaatgttatattgaagacttgtaggagcgctgtgacctgagcaaggacaaagttttgcaatctccttgggcccctgctgatgcccaagtgtctgtggtcaccagccacccccctcacctcagtctcctccttgttccccttcagtgtaccccttcaatgtacaaagaagcttgagattcatgcctttaaagatggttcgttaggacatgggtccagtatcttcctgacttgctggctctccaaataaagatgcttttcttgctctaactttttgtctcgtgaatcattggctgttatgcagtgagcctcaggaactttggactccacagcaccaggacaactctcaggactcccagtctctattgggtgcaggaatcactggggagtctggctgaagtgcagactctgattgaggaggcctgggacacgaggcctgagattctgcatctccagtaagcaccaaggggatgttgatgctgctgatccagggaccacaccttggagagcaatgctgagaagctggtggaagagcccaggctcatgaagatctgaacatggtccatagcagggaggttggggaaatgagataaaaatgttaaaaatggcagttaccttcctggagaagaaatggcttttccattccttattaggctcatgtctttggaactagcccccactggtctccttcctgttatatacctgcagttaccatgttcttgttaaggaagaatggcaaatgcaaaaaaaaaaaaaaaaaaagaggaagttgatcatgtttggttgcttttggtcatcacaataaataaataaaatctgaaatttccccctgactttgcaaatgttttcttccaaggagagcaacagacatgtgtcagccttattggatttctttggttcccgaacagcctgccatgaggtatgaaggacacatgaccttttatgtaattggtgagacccaatgtcttccagatgttgggtgtctcatcccagtgtgaggatttttttttattatttttttgagatggagtcttgctctgttgccctggctagagtgcaatggtgcaatgttggctcactgcaacctccacctctcaggttcaagcgattttcctgtctcagcctcccgagtagctgggattacaggtgcgtgccactacacccagctaattttttgcattttagtagagacgggatttcactgtgttgcccaggctggtcttgaactcctgagctcaggaaatccacgcccctcggcctcccaaagtgctgggattacaggcatgagccaccgcgactggccgaggattaagtttttaaaacttaatttccctttagaaaagagaatttaacctagatgttggttcttaatttatcttgagtaaaagttgtctttgctaatatgaatttttaaagtcatcaattggttcatacagttttgtgtgattcacctccaaatgttttcagcagagggagtaacaagaaagaaaaggtaatttttttttttttttttttttgagatggagtctcgctctgtcgcccaggctggagtgcagtggtgcaacctcgtctcactgcaacctctgcctcccaggttcaggctattcccctgcctcagcctctcgagtagctgggactataggcgcccgccaccacacctggctaattttttgtattgttagtatagatgggatttcacggtgttagccaggatggtctcgatctcctgacctcgtgattcgcccaccttggcctcacaaagtgctgggattataggcgtgagccaccacgcctggcccagaaaaggtgattttaaaggcaaagaagcgagatgacttgagtaacggtgttccccatgcatggttattaacaaatgtttcctgactgcttacctgtcaaaaacattgaacaggtagaatgtgtggtcccaggaggtgacaaacttcctattttaaatgaaatatttcaaaacagattagacctccaagtcaaaggggtgataaggaatttcatgggagttcaatgatcttttaaaaaaaaatgattgtaagcctattaggaattagcatataaagtttgctatggtccgaatgttgatatctccccaaaatttctattttgatgtcctcacctccaagctgatggtgttcggacatggggcctttgggaggtgatgaggtcgtgaaggtggggcctcatggatgggatgagtgcccttataaaaggggccccagagagctccctcgccccttccagcatgtgaggacacagccagaaggcgccatctaggaaccaggaagtgggtccccaccagacactgaatctgccacgtctttgccttggacctccagcctccaggactgtgagcgataaattctccagcgttgttagagggcttgctccttgatcacaataaactgcatgcttgtttttcccctaaatttctgtgccgcaaagtgatggtgctaggaggtggggtctttagaaggtggtgtgatcatgagggtggaacctcatgaaggggatcagtgcccttacaaaagggaccccaggggctgggcacggtggctcacacctgtaatccccagcactttgggaggcccaggccggtggtcacctgagatcaggagttggagaccagcctgaccaacatggcaaaacccagtctctactaaaaatagaaaaattagccgggcatggtggcgggcacttgtaatcccagctactcgggaggctgaagcaggagaatcgcttgaacccgggaggcagatgttgcagtgagctgagatcgcaccattgcactccagcctgggcgataagagtgagactccgtctcaaaaaaaataaaaaagaacatcgactcagacttgctttgctggaaagtatattagaatgtgtctcatcccccttgtatccatttcccagggctgctgtagcaagccatcacacaccaggtggcttacaactgggattcattctgtcgcagttttggaagcagaagtctgaaatcaaggtgtgggcagggtgggttccttctggaggctctagtggtggatccgttccttaccgcagccccgagcctattcccatggcctcaggggcttcccatacagtgcataggatggcctcacctcagaaagtgatccagacccgaatgtccacagtgctgaggctgagaaaccctgtcttagcttcaaacgcacacatacactctctctctgttttgctcgctggctctctttctctctgtctcatatattgatctagctgtctatctatttctccgtaggtatctacctatatccatctgtctatctgtcatctacttctttttctttttcgttagagacaaggtcttgccctttcgccccagccagactgccgtggcgtgatcatagctcactgcagcatcaaattcctgggctcaagcaatcctcctacgtcagcctcccaagtagttgtgactataggggtgcaccaccatttcctgctagtttttaaattttttgtagagatggggtcttgctatgttgtccaggctagtttcaaattcctgggctcaagcaattcattcgccttggcctcccaatatgctgagattacaggtctgagccatagcacttggcctctcatgtatttgtatctctatctgtctctctctctctttctctctctctctgtctctctattatctatgtatccattcatccatctatccatatctatctatatatctatccatatctatctatatgtctatctgcctatgcatttatctatctatatcatctatatatccatttatccatctatattatctatccatatctatcatctatatatctacctattctttctatctatatatctatccattcatccatttatccatatctatcatctatatatctatccataactatgtatctacctatctatccattcatctatctctatccatctatctatctacctacctgtctgcctattcatccatgtatctacctctatccatcatttatccatgaatctacttctttctatcaatatatccatacatgtatctatatctatttagcaatcatctatccatgtatctatttggatctctatcaatccatgtattgatatttacctatctatgcattaatgtatctatatccatttatccatgtatctctatgtatctctacatttcatatacatttgcacttcttatatatgctatgtctcaaacacgtgcccactcacatttgcatgtgtgtctgaatgtatacacacatacacacacatttagtgaaggggcaccctgacttgatttgtacatatctcagtggtgacagtcatcagcaagaagcagccccaggacctgggctgattgcacccttctcaggccccagcctgagtcccaagcatcactgcggaggctcacagaagagtccacccagccaaggccacccctgggacctctcctcactggaggagcctcatgcctttggcttccatttctcttcaaacggcataatgaacacccacactcctggtgtgcccttgggatataaaattagagccagattaagcatgcttgctggccctgtggtgaccactacaaatgaggtgttttccacttcccatcatttccatgcagtggtatttaaaaaggaaatggtttccattgcaaaacattttctgtgacttttggctgcaatattttgctgcttatgctttttttctcatattttccttcccctgcatatattttctttacattaaaatttttctttaaaaatattcctttctttttttttttttttttttttttgagacagtctcgctttgccacccaggctggaatacagtggcgcaatctcagctcactgcaacctccgcctctgggttcaagtgattcttctgcctcagtctcctgagtagctggaattacaggcgtgcaccaccatgcccagataatttttgtatttttagtagagacagggtttcatcatgttggccaggctggtcttgaactcctgacctgaagtgatctgcccgcctcggcctcccaaattgctgggatgacaggcgtgagccaccgtgcccgtccttgccttggcatctaaaaaggaaatggtttccatcgcaaaacattttctgtgacttttggctgcaatattttgcttcttatgctcttttttttcctcatacttttcctcccctgactacattttctttaagttttttctgtacattaaaaatattatttatatgttaagtataaagaatatttcaaccactcttctgtaaattaaacaaaaaagaagctgaattttccaacagtgacatgcagtacaacagcatctccgcaggcagacgagaaaaaaagtgatctctcccaacaaaaaaatgctgacagtaagaaattaagccccatgtttttatgtgaaaactcccggttcaaaaccatacaaacattgaaacctcatgtgaagaaaattgtccgccaaattcatctctatattttatttgctcttcttgaggataatttggaatacaatcagtcctctgccagaataatgtttattactccatttattccaaaaagcatgttaggaggctttcagacaaaatggctttaatttgacttttaaaacagaacggcaacattctaggaatcagagccagaagtcaatgccttttatagttatctattttcaagagttgaattttcctggcacaacagtactagaagatagaaccccagttgaatgggcttttcattcttagtcctatgactttctttttttttttttttgagatggagtcttgctctgtcacccaggctggagtgtagtggcatgatctcggcttactgcaacctccacctcccaggttcaagcggttctcatgcctcagcctcctgagtagctgggattacaggctcatgccaccatgcctggctaatttttgtatttttagtagagacagggtttcaccatattggccaggctggtctcgaactcctgatcttgtgatccacccgcctcggcctcccaaagtgctgggattacaggtgtaagccactgttcccggccctgtcctgtgactttcaaggggggacagcccttgacatgtaatttttgtgcttaatctatatccctggactatagtcctcttttcacccttctatgtccactttctgccctgggagttgatttttagagactgtatcagaaggactcagccctgtgagtttctaaatagtgttggccgatctaggggactgaaatttgacagtaaaacctgtactggggtgaacagtggcccttccaaagtcctgtctcccagggacttcagaatgagaccttatgtggaaatagggcctttgcagatgcatttgttaagatgaatgagagtgagccctaaatccaatgacaggcatccttctaagagacggaagaagagacacagacagagacacagaggagaaggtcacgtggagatgcaggcagagactgagataagatggccacaaggccagggactcctggagccacaaggggctgggagaggcaaaaaggagcctccgctagagcctctggaagcaactggatacaactgtagtggactgtacagtggtcctcctaaaagatatgtccacgtcctcatccccagaatctgcgaatgggaacttatttggaagcggggtctttgcagatgtaattgagttaagaatctcaagatgaaggccgggcccggtggctcacacctgtaatcccagcactttgggaggctgaggagggcagaacacctgaggtcaggagttcgagaccagcctagccaacatggcgaaaccctgtctctactaaaaatacaaaaattagctgggtgtggtggcaggcgcctctagtcccagctgcttgggaggctgaggaaggagaatcgcttgaacccgggagacagaggttgctttgagctgagattacatcgctgcactccagcctcggtgacagagcgagactacatctcaaaacaataacaactgcagcaacaaatcaagatgagatcatcatggcatagggtggaccctccactcaatgacaggtatctttgtaagagacagaagaggagacacagatgcagaggagaagtccacgtggagatggaggcagagactggagtgatctggccacacgcccagggacgcctagagcccccaggagctaggaggggcaggagggattttcctggagggagctcatgtctgtgtcccaatatcttcttcttataaggccactaatcatatcagattaggacccaccgtaatgacctcattttatattaatcacctttttaaagaccatatctccaaacacagtgacaccctgcagtcctgggagttaggacgtcaactgataaatttagaggacagaattcagctcacaacagtctttgcagttgaggtcactagggtgggccctgatttagtgactgctgtatttataacaagaggagatgaagacagacacagaggggaaggccaggtggagacggaggcagagactggagtgatgcggccacaagcccagggatgcctgcagcccccaggagctgggaggggcaggggggatcctcccctagagcctccagaggaagcacagccctgcccaccccttgatctcagactgctgctctccagaactgggagagaataaattcctgttgttttgttttgtgtttgagacagagtcttgctctatcattcaggctgcagtacagtgatgcaatctcggctcacggcaacctctgcctcctgggttcaagtgatcctcctgcctcagcctcccaagtagctgggattacaggtgcgcactaccacacccggctaatttttgtattttcagtagagacgggttttgtcgtgttggccaggctgctctcaaactcctgacctcaggtgatccgcccacctcggtctcccaaagggctgggataacaggcgtgagccaccacgcccgatcagttcctgttgttctataccactgtttgtggtcatttgttatgccactcccaggaatctctttcataccctctagtctcctctgagtccctcaggcagcagcacacccctcccaacggctgcaccacctggttatgagcccaggctccgcatgtcaccccagttcagctctctgtggccgcaaggcccagcacagaagctcctgaccatggcctccccatccctgaatggcccttcccaccattgcctgcttggacactgactgatacgatcctgccctccctgtcatctcggtgatcccttctccttctcagggctctgttccttcctgcctttgctcacacatcccctgttgtgtgacagatttttttttttttaatttcaattgttttgggggtagaagtggtttttggttccacggataaattctttagtggtgatttttgagattttagtgcacctgtcacctgaacaatgtacactgtatccaatatgtggttgttgttgttgttgtttgtttgtctgtttttgaaatggaatctcgctctgtcacccaggctgcagtgctgtgacgtgatctcggcttactgcaacctccacctcccaggttctagcaattctcctggttcagcctcccaagtagctgggactataggcacatgccaccacacccagctaatttttgtatttttagtagagatgaggtttcaccatgttggccaggatggtctcagaaactcctgacctcaggtgatctgcctgtttcggcctcccaaagtgctgggaatacaggcgtgagccaccgcgccaagcccgaatatgtagccttttatcttcacccaccttccacccttaccccgagtccccaagttccataatattatcgtgcatttgcattctcatagcttaactcctacttacagatgagaacatacgatatttggttttccattcctgagttacttcacttagaataatggcctccagggccaagtgcggtggctcacacctgtaatccttgcactttgggaggctgaggcgggcggatcacctgaggtcgggagtgtgagaccagcctgaccaacatggagaaaccccatctctactagaaatacaaaaaaattagctgggcgtcgtggtgcatgcctgtaatcccagctactcgggaggctgaggcaggagaatcgcttgagcctgggaggcagaggttgcagtgagccaagactgcaccattgcactctagcctgggcaacaagagcaaaactccatctcaaaaaaaaaaaaaaaaaaaaaaaaagaaaggataatggcctgtagcttcatccaagttgctgcaaaaggcattatttcattcctttttatgtctgagtagtattccatggtgtatatataccacattttgtttatgcacgcattggttgatgggcacttagatttgcttccctagctttgcggttgtggattgtgctgctataaatgtgtgtgcaagtgccttttgcctataatgactttttcccccactgggtaaatactcagcagtgagacggcttccccaaatggtagttctactgttagttcttcaaggaatctccacactttttcatagtggttgtgctagtttacattcccgccagcagtggaaaactgttccgtaggatggttttgatggggccattttacatctaccctggtttgtttggcccagtaaacaaaccagaactaattcctgaaagtaacccaagggaatctaaattcttcttccttctcatgaattcctggaactatcacacagctttttttttttttttttttttttttttttttttgagatggagtcttgctctgtcgcccaggctggggtgcaatggcgcaatctcggctcactgcaacctctgcctcctgggttcaagcgattctcctgcctcaacctcccaagtagctgggattacaggcacccaccatcacgtctggcaaatttttgtatttttagtagagatggggtttcaccatgttgaccagtctggtcttgaactcatgacctcaggtgatccacccaccttggccacccaaagtgctgggattacaggaatgagccgccgtgcccggccctagcacagctttttattactgtgtgtgcatggagcaacaagacccttcagcattgacctgcaagcactccttcagccctcaagttggaagacgttgcaacatgaccctatgaaacaattgctaggtatttctcccagaatccagcacagagctgaccattccataaatagttctggattggctgataaatattcctctgtaatgctttgtgtatattggagttaatgaagatgtgttgacttaaagctattaaacttgtggcaaccaatcaatgtctgtagtcttgttatcagaagtgcaccagtgttggtgacctggctctgatattgcaccccaatcctaatagaaaatgaagctgggctaagggcaaatgaaactctaggtgggggtcttgtgtacttgcatcttccttagactctttaattatctcaaaaggaaatttaaagaaaaaatataaaattacaatttgtaaacattatgcagaaaactaatttggaaaagtggtacattttaccacgtcttgttatatttcaaaatctaaatttgcttgggcgtcatgaaataatcctgtctggaaccaaaaaccttcccatctttattttttatttatttatttttgagatggagtctctgtcagctgggctggagtgcagtggcgtgatctcggctcactgcaacctccgcctcccaggttcaagcgattctcctgcctcagcttcccaagtagctgggattacaggcatctgccagcacgcccagctaatttttgtatttttagtagagatggggtttcaccatattggccaggctggtctcgaactcctgacctcaaatgacccacctgtcttggcctcccaaagtgctgggattataggcttgagccacagccctcggccccacgtttatctttgaagttgacttaacatcattccctgttaaggagaggtagttttattacattgagtaacaaatctgtctgcttctttgaaatcagggttaagcattaactagaacccatgatggggttaaagtgatggatgcataaacacacacacatacacagacatgcatgcacacctgcacacacatcaattaaaattcggttcattgatttgccggtgacgagaacctgcaaacagaatgtgcaggtgtcctgatctgaccctggaagagagagaaaggttcaaagatgagctcttttagtttcaagatatgagtcaactgccttggattcatttccttgttttctttttttttttaatattagggatgtcaatgactcctcataagatgatgaggagagatagatggtataaagtgtattataaatgtgatggttcttactgcctgcttaaggttctagtgcaatagaatattagggatgtcagtgatttcctcataagatgatgaagagagaaagatggcataaagtgtattataaatggtggttcttactgcctgcttaaggttctagtgcaataaaatatgagaaatacatggcttataattcaggcagctattaatgtgatcctgttggacttttgtctgcccatatatggccaaccaagaccgaacaaagtatattccttaaatgttggaagaatctgcaaaccacagactagccagtttggtgttaatcgccagaagatgattaaccatggaaatcaaagccagataaacagtttctgatcataaactgaacctgtgtgtggacctcccctttctccagccccaaaaaggattgcaaagcccttgaggatgctttatcttgtgtcgctcagggtgcctagaagagcgttgaaaactggcaaattctccataatgtgtgtgttggcatggggaagtggggacgatgggaagctcattaggtacgcagccattagcttttgcagcaaaacaaaccaccccaaaacgtggtgctttaaaacaatacccatttagttcgttcccgattccgtggctcagctgttcaggtttggctcagtgaggcagctctggggtcagctggattcactcatgagtcagtgctcagctgccgggtggccaggagcaggctggtttggatgactcagctggggcagcttggtttagctccaactggtctctcagccttcgctgaggcagctcatgcttatgcatatggcagccgggaaggtttccaagccagggagctaaggcgtgaacagcctctaaaagcccaagtgcagaaatttttaaaaaatgcttatttatttgttttcagagacaagatctcactctgtcaccccggctggagtgcagaggcacaatcatagctcactgtaactttgaactcctgggctcaagtgatcatcccacctcagcctcccaagtagctgagactctaggtgtgcaccactatgtcctgctattttttttttttatagagatggggtgtcattgtgttgcccagtttggtctcaaacttctggccacaagagatcatccccacctgatcccatactgcctacccaccctcacctcccaattctcttcctactcattaaggtcataattttttccctcagtgtctgtgtttttgctcatgtgtgtatgctctctgaaatggagcattttctatccggaagactcctacacgttccgcacaacccagcttaaatgcagtctccttcgtgaaacatttctcaaccagcatggcctccatttttctcctttttcctcgcacagcactctgcgcagcactctgtgtccatcatctgtagactatatcacgttgtgtgagatacattgttatttttggtggtggtcgtggtgtgttttgtttggttttttgctcttcctcaatggaacaattgggctatttgatgaaagaaaaaggacttactcaccttggcatgctttgcatgtaggagacaatctgtaacactctatttgctaagtcaatgtttattggataaatcaacataattttcatgttattacattacagtgcttaaatgtgcttgcgtcagctctgtagctacaatgatgcacatattgttgttggaagagattatatttttcataaatggccacagcaatatttctgtcccacactctcttccagaaccttggtgcttcccatcaagagtgggaatctgattcccttttccttgaaattgggtggatatttgtggctgcttttgtgcagaggggttgccacatgacttcagaaaccaggttgtaaatgtgctgtgactgcacattatttttatttatttttttttttgtgatggagtctcgctctgttgcccaggctggagtacagcggtggaatctcggctcaccacatcctccgcctcccaggttcaagcgattctcctgcctcagcctcccgagtagctgggactacagtcaacacaccaccatgtccggctaatttttgtatttttagtagagatgggtttcactatgttggccaggctggtctcgaactcctgacctcgtgatatgcctgcctcagcctcccaaagtgctgtgattacaggcgtgagccactgtgcccagccacagtggcttttttaaaccagtaaattttggatagctagttatacataataactgaaacaatcaggcattttagaattcatatgtaagctaacttttaccatgtagcattctcacacatatataatgtgtgtgtgcatttatgtgtgtgtgtttgtgtgtgtgtgcacaggcaaaagagatagggagctttattgcctagtgttttgtggtcagctcacttttgccttgcctgcattcagttgagcagttaagcatctaaagtacccagtctgtacactgggctgtctgccaggtaccgtgttaaaaacaaagttgagcctgctcctagcttgttggaaaactcagataaacacaaattaacagctctcctgtcacattctatgttttggaacaccctaggatggctttctcagattcagcactgtgaccatcatagtcagcacttgtcatgatcaagactcaaccttaggtcttggatacagtcctaacgggccactggttctaacccacaaggttgtttacctatctaagcagacttaggggtaaacaggattcctgcttcaaatacagtattctgggaagttgattctttcttgactctgagccaaactaaatgcaagcataagcttcatcaacaaagtagttgttcatatattatgcaacttccgtaatgccttttaatttcttctgaagactcaaccaatgctacaggtaagaaaattaaaaagacacacagacataggatcacacatcaagtttttgccaaattaaattattgttttgaaaataatttgcagcactgatgggcacacaccgtaaaatttccaatgtatgaactctgggctacaagacactctttatctttgcctgctgtgaacgctctgaggaaaattccggtggttttgaggcagtcacaaggcaatgtgctgcatacggcctggactcagaagcaaagggctcttgattttaatcccagcccaccgctgacaagctcaacggccccaggatgtttcctcatcagcagaggtgggctaatgaatccagatcccctgtttcacagttgttcctcaatgaatgaacacctagaaagttatacaacaatacaaaaatatcaggtagaaatttacttgtttgtaagtctgtcaatccatccatccactcacccttccatctattcatccatctatttttctagccacccgtccatccatctatccatgcacctatttatccatccatccagttatccatccatctatccacatatccatccacacacccacccatccatccattcatggatacaaccgttcatctacacatccacccacccacccattcaccaaactattcatctatccatccattcatggatacaaccattcatgtacacatccacccacccacccattcaccaaactattcatctatccatccatccatccctgcatacacccactcgtcgatccatccactcatccattcacccacccatctacccatccatctgtccatccatccatctacccacccacccatctacccattcatccatccatccatttattcatccatccatacattcagccacccatttactgaaaccttatctatcatccatccagccagccagccatttatatacccacccgttcatgcatccattcacccacgcacccatgtgtttatccatccattcattcatccacccacatatccacctacccattcatccaaccctccatctattcacccattcatccatccacccacccatccatccactcacccacccatttgtccatgcattcattcatccacccatttatttattcatctacccatttatctctcagtcaatccatgcatccagatgtctgtccatttatccacacatccacaacccccacccatccacccatgtgtacttccatcctcccactgactcaggaaacttcatttgagcatctgtacagccgacattgcgtgtggctcagacacctcttaactgccttggctgcccacaagtacctcacaggaggtctctgctataaattgggctcagcccctggcagtggagaccagaaataaaaagtgatttaaataacactgaaacaaacctgactttttaaatggtaagattaaaaacgtactcttctgtcctgtaatgaggtcaggagagttggtctgggcctggcacagctgtcttgcagtgtcaccagccaccctggcacctttgctccatatattctgccattcttggaataggacctctaccctctggaggacttcctgctctaagctagctgctggaactccagacatcacgtcattattccaggcaggcccagcatgatgcagagaaagcgaaaagtgggcttgttggccaccagtccccctcttaagggactcctcagaagtttcacccaataactttggtttacattgattttattaaccagaacatagatttttggttacacctaactgcaaaggagaatgaggatatcgtctttcagctgtcacattgccaaaatcagtaaattcaaggtctcttaatataagggaagaaagaaaggatataggataggcaactgtagtctcacacgtgcatgaggaatggatggaaggatggtggacaggagcgcgtatgtaaatactttttagtcttctcaggctgccataataaaatagcatagactgggtacttaaacaaaaggaatttattttctcacagctctggagactgggaagtccaagatcaaggggctggttggttcaattcctggtgagggctctcttcttggtttgctgtgttctcacatggaggagagacagagcaagcatgccctctggtatttcttcttacaaaggcactaactttcctgcatagggtcctaactttacgatttcatttaaccttaattatttccttgctgcaaatacagacacatggggaacagaacttcaacacacgaatttggggagtagatacaactctgctcatggcacatataagcatgcatactaaatgtgtgtgtgcatgtgggtcaatggaaagattggaagtctcattaatagcacatatatgcatgcatactatgtgtgtgtgcacgtgtgtctgtatggaaagataggaagcctcattatctaaatgcctagcctttcgggtgagctaatttttgttgtgtatgcattcaattgagtaattaagcttctcaaaggctgcctctctttgttgggctctctgcctggtgctgaggtacagacaaagatgtgactgctccacagcttatggggaggctcagataaacacgaataaatctaaataaacacacataaattaaggcctatttaaataaacacttgctgctctcagaagcagagccacggctgtttgattttactgctgtatcccacagagcagatactcaaaaagctttgttgaggctgggcatggtggctcctccctgtaatcctaggacttggggagggctgagactgggggatcgcttgaggtcaggagtttgagaccagcctgggcaatatagtgagaccctgtctctaaaataaaataacctgggcatggtggtgcagtcctgtggtcccagctactcaagaggctgaggtcagaggatcacttgagcccaggagtttgagaccagcctgggtaacatagaccccatctctaaaattataaaattagccggacatggtggcacattcctgtggtcccagaggctcgggaagctgagatggtaggatctcttgagtacaggagtttgagaccagcctgggcaacacagagagacctcatctctgcaaaaaataaaaataagcgaaaataaacacaatatttttaaaaacatgaaaaagctttgttgaataaccaggcatgttgagaaatcaccaagaatagagcactgtaggaacctggggagaaaaaagctgagttgttggtgcaggagccaagcagttaggggtacatgaaagaaaatcgctagtgggctgcaccctggcaaatgcagctggacgaaagatctgatgctactcattcccgaaggtcacattcttaagcttgaatgggtggcagagttgacctgactcagggtaatggtacaggaatatacatgtgcatatatatcatactgcaaatgtatccgttttgaatctgactctctaagaataatctacaggccaggtgcggtggctcccgtctgtaatcccagcactctgggaggccgaggagggtggatcacctgaggtcgggggttcgagaccagcctgaccaacatggagaaaccctgtctctactaaaaatacaaaattagctgggcatggtagtgcctgcctataatcccagctactcaggaggctgaggcgggacaatcacctgaacccgggaggtggaggttgtggtgagccaagatcacgccattgcactccagcctgggcaacaagagcaaaactctgtctcaaaaaaaaaaaaaaaaaaaaaaaaaaaagccgggcacggttgctcacacctgtaaccccagcactttgggaggccgaggcaggtggatcatgaggtcaggagatcgagaccatcttggctaacacacggtgaaaacccgtctctattaaaaatacaaaaaaattagccaggtgtggtggcgggcgcctgtagtcccagctacctgggaggctgaggtgggagaatggcataaacccgggggacggaggttgcagtgagctgagatcgcaccactgcactccagcctgggcgacagagtgagactccatctcgaaaaaaagaaaaagaataatctagacatcaggagagcatctgctggtcacaatttgggagaacagggagataagaacatccagcagccacccatccatctattcatctgtctgtctatccatgcacccatccacccatgtatttatccatccatccatacatacatacatccacccacccattcatccaaccctccatctatcaactcattcatccatccatccattcatccacccacaatccaccccatccacccacccgccctcaattcatccacccacacatctacccatctatccatctatccatccatccacctatccatccatccactcatcctatctgaattgtgtctgtgagactcctccatggtgaaattattcttttcctaattttttatgtcatacactttggaagaagtggggatctgtgtccacctccttgatggtgagagcagcagtccccaacctttttggcaccagggactggtttcatggaagacagtttttccacagaaccaagggtgggagggatggttttaggatgattcaagcacattacattgtgcactttatttccattattattattattattattattattatattgtaatgtataatgaaataattctacaactcaccataacgtagaatcagtaggagcctgtattagcccattctcgcactgctatgaagaactacctaatttatgaaggaaagaggtttaattgagggggatggtgcaaaaccattcatgaaggatctgaccccatgatccagtcaccttccaccaggcccccacctccaacactggggatttcagtttgacatgagatttgggcggggacacagagccaaaccatatcaccaccagcacagcaccaagcatcttgccactcagaaagaatgccaaaatttctctctagacatattttatttttattttatttatttatttatcttttgagacagagtctcgctctgtcacccaggccagagtgaagacgcacgatctcggctcactgcaacctccgcctcccaagttcaagggattcttgtgcctagctgagattacaggcacttgccaccatgtcgggccaattttttttgtaattttagtagagaccgtgtttcaccatgttggccaggctggtcttgaacttctgacctcaggtgatccacccaccttggcttcccaaagtgctgtgattacaggtgtgaaccaccgtgcccagtctagacatactgacatatttcctttttctttttctttttttcttttcttttttttttttttgagacagagtctttttctgtcacccaggctggaatgcaatggcgtgatctcggctcactgcaacctccgcctcctgggttcaagcgagtctcctgactcaacctcccaagtagctgagattacaggcgtgcaccaccacaccaggttaatttttgtatttttaataaagacggggtttcaccatgttggccaggctggtctcgaacttctgacctcaggtgatctgcctgcctcagcctcccaaagtgctgggattacaggcgtgagccaccatgcccagtctagatgtattttcttcaaagatgcacttatcattggaagtggttctttctgacagctcccctgccccgatgctttccttcctgttccatggagttccatgttctgtgctgtgtagtttgattttcagtcctcctttgaattctgcagctgtgtatttagacccatttcccaggccagtaaacaaagccccgtgggcaagaaaccacagatccccccatagaaagtgggagaaaatgccagtgtgcaatagtgtgtgcatgtgtgtgtgtgtgtacgtgcatgtatgtgtgtgtgtatgcatgtgtgtgtgtgtgcatgcatgtgtatgtgtgtgcatgcagatggaatataattataacctgcgtgtgtgtgcagtataaaatatataaaactggtttggagagcagggtatgaaaagtccaaagtcagaagaactaatccttggctgtgggtggtggctcatacctgtaataccagcacttcgggaggccgaggccggcagatcagttgaggtcaggagttcgagaccagcctggccaacgtggtgaaactccatctctactaaaaatacaaaaattagccaggcgtggtgatgggtgcctatagccgtagctactcaggagactgaggcacaaggatcgcttgaacctgggaggtggtgagctgagatcgtgccactgcactccagcctggacaacagagtgacactctgtctcaataaataaataaatagaagaagaactaattcttaaaaattaaagacacatggaaggtttccgcaggaggctgggagctaccaagggttaggttgaaatgtgcaacgtggccacgtgggtccctcggaaatggtcagaacatggttatttcttgaggttccactggtgaaataaacgggaaacatggaggctgccccagcagtgagttccccatcccttcttcagcctagtttgtggccttcaaaagatgcttcccgtggcacctggatacaattcagaaggctttttcaattaatttaattttcattctggaggttacggcctcttggtgccagttccagagggtctgcagaatattatggaaattcatatttggagccaaagaatggcagcgttaaaaaaaaataaagaaaaaaggcaaaaggcatctaactaaatgaattagaaacagaagtcttccaaatgcttacctgtgagaacatagataaaaagcctcaaagcctggctttcagaagctgatgttgcatctttattatggctggcgagaatgacctgcgccctccctgaaaggcagccagagtctagactctactggaacataatggacagtcagaggagggaagcttcacctgcagtgccgtccaaatgtcagaggctggagatggtccaggggagggcctttcttttggcggtaatgggggtgaagcaggaagctcacagggagaggggtgtttggagtgtgagacagcaggaagaccctgcgttctttttatctctgcttcatcccaagtcagacttgcctcaggatgccaaaatgcccgggcagctccagcatcctcttgctcctcaaaatgagcccccagggtcctcctacttgccctgacctaggatccacaccctcccttgaccccagcccaggactgtggccagggaaaaagaaagtgctaattgatagagagtcaatgccacgtggggaggtcgggggagaggtgcaggagaaaataccagagaaggagctctggttgggtagttcatccgggttcactccaagaggtaacactttaaaggtggtgttcccatgaagaacgattacattttcctcatacttctaaagtgcaattatgttgctggggttttgctggccgaaaagaaaacgaaaaagaaaagaaaaaaccttccggtgtgcaagctcacactgttactttttaagatgtgcatcactcacaccaccgagctcacattgctgagcaggtctctggggcacaggcccagcccctctagccttgcaggtttctgacctaggggtgcaggtgacctagggaggggtgggtatggccgcaggcaggggatagctcaagaccatttgacccagcaatcccattactaggtatatacccaaacgattataaatcattctactataaagacacatgcacacgtatgtttttgcagcactagtcacaatagcaaagacttggaaccaacccaaatgtccatcaataatagactggataaagaaaatgtggcacatatacaccatggaatatacgcagccataaaaaaggatgagttcatgtcctttgcagggacacggatgaagctggaaaccatcattctcagcaaactatcacaggaacagaaaaccaaacaccgcatgttctcacttataagtgggagttgaacaatgagaacacatggacacagggaggggaacatcacacaccagggcctgttggggggtggggtgcaatgggagagagagcattaggagaaatacctaatgtagatgatgggttgatgggtgcagcaaaccactatggcgtgtgtatacctatgtaacaaaactgcacgttctgcacatgtaccccagaactttttttttttttttttgagacggagtcttgctcagtcgcccaggctggagtgcagtgccacgatctcggctcactgcaagctctgcctcccgggttcacgccattcttctgcctcagtctcctgagtagctgggactacaggcgcccgccaccacgcccggctaatttttttttgtatttttagtagagatggggtttcaccatgttagccaggatggtctcaatctcctgacctcgtgatccacctgcctcggccttccaaagtgctgggattacaggcgtgagccaccgcgcccagcctgtaccccagaacttaaagtataataataacaataataaaaagacaggtgttatctcagagcccctgactcagtcggctgggcagcaagtatgccagcccaggaatgggccaatagatgaggcagggctttgtaaaccaaaaataaaattctttaagaggctggagtgggtggatcacttgaggtcaggagttccagactagcctggccaacatggcgaaaccccatctctactaaaaatataaaaattagccaggcgtggtagcaggtgcctgtaatcccagctactcaggaggctgaggcaggagaatcgtttgaacctgggaggtggaggttgcagttagttgagatggtgccacagcactctagcctggccgagagagtaagactccgtctcaaaaactaaataaattaataaaataaaataaaattctaagcccccaccgccccccaccttcaaaacatctgaatggacttcttcctcagccagagctctttaaaaatttaacctgagagagtgtttcaagccgtgacgggaagcaggggttgaacatgcctcccggtgcctctccggcgttaacatccacacagcctttaagtttgagaagaaacattttacaacctcttctctctgaccctagcaccggaagggttcctgttcaaataagaacttgagtcttcacaattctttatcttaacccagacattcttttctattgatcccaggactttaaagaaacccaagcaattgccaatcagaaaattctaaaatctacctataagctggaagcctcctgctttgggttgtcccgcctttctggacaaaaccaatgtgtctcttaaatttcattgatgtctcatgcctccctaaaacgtataacaccaagctgcaccccgaccaccttgaggacacgttctcgggacctcctgagggctgtgtcatgggccatggtcactcatatttggctcagaataaatctcttcaaatatgttagagttggactcctttctctttttttcttttttctttctttttttttgagacggagtctcgctctgtcacccaggctggagtgcagtggcctgatcttggctcactgcaacctccatctccccggttcaagcgattctcttgcctcggcctcctgagtagctgggactacaggtgcacaccaccacacgcgtctaattttgtattttagaagagacagggtttcaccttgttggtcaggctggtctccaattcctgacctcaggtgatccacccgcctcggtctcccaaagcgctgggattccaggcgtgagccaccgcgcccggcctagtttgactcttttcgtggacagtttgaagtgtggaatgcaagaatattcagggttatttgtcaggctgcaaagttgttccactaccctgcgggaaaatggatacaattttaggcttaggtgttaacagataacattgttaagtgtgggaagggcgacaactgcactgcagctgtggccagtggcgcgggagggtgtctaaactcaaagcccactggaaggcgagtcgcccatgaccaggactagggcccaggtgccccagatagaaggcacctcgttccctattgcccctcactaactcccgtgaccaggagtccccactcccaaccttgtcctggggattctggggagaaactgccccagcgcagaggctactccaagggttgtccttggtccggcgcaaagggttcgtccgccaccctcccggctgcgcaccccgcgctcggacgctctagaaaggacttgggacgggggttgcctgtggagcgggggcctaggcttcctgagcagggagaggattgcactttgctccccttggggaactccctgaggtgagcagcggggaggggcccccatacttttcccagcaggggagccgggagtttcctctgctcccactgcagagcaggggagggtccctgctaggggcggagaaggggctgcaggggcgagtggggaggggggctacacgtttccaagaagggcggcagtttcgtgtcgctacagttgcaggcgtgcatttaggaggctgtagacagggagggacccgcactttcccgagcaggggagctgctgggaaagtttgtttttttgctcccactggagaccagggggtgaggggcggagaagtggctgcaggggcgagtggggagagggggctctatgtttccaagaagggcggcagttttgtgccactacagttaagggccgccctcgggcgtgcattcagagggctgtaaaccgggagggacccgcactttcccgagaacgttgtagttcactttgcttcgggtcggcgccgccctggctacggccctgtgggtgggtgagggggcgtgggcagtttcctgagaaggggcggggcgtgtaccgtactcccctcggcgctgcctgggccacccccgcccgcctaccccctctgtctcctccccgggcccggcgttcccgccccttctgtgcgcgcgtggaggccggggcggggcgggcgcagccggcgctgagcttgcagggccgctcccctcacccgcccccttcgagtccccgggcttcgccccacccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccgggtgagcgagcggagggatccgggttgggggacgcggagggcgcgggccgggactggggatccgcttgagatgcggcgttgggggcgccccgcggggacacccggagcctcctccctgcccggcaggacgcgctgtgcccacgggggcccaggcccggaggaggcgcccactttctccccaacgcttttcctggagccgttccagagagaaaagtcagcgtttgttgtcggagttgcaaactcttacatgtggggcggccttgggagaggtgcgtccgatttttcccaatctaggggaccttcttacagatctctctccctttgcatgagcccctcaccccaccccgttatctacccccagggtttggggacctgcgtcttcaggccgcgcgcggaggccgccctggagttgcctgtcacagccacgccctgcgtcccgggcctaaatttggaatcgctaggagcctgagacccgggtggtggggggaagggaaggaaaagttagaaaaaaactttgagccctgaaaatgttcaaaaatactctgtggatgcgggctccgggaatttcagcgcgtgctgtgcgccaagcaacacggggcgcagaaagaaacgtgtgcttaccaaattgtccatctgcggcggtggagaattcggaaaacagaaaaagtgggcagggaagaaagagccacggtcaccctcccacgccctaaaccgggcctatttctaattattactttaatcatgtttttctgtttccctccctttgaaacggaaacggagaccctgccggatgtggtatgttataaattcttttttcatgttataaattcttttttcaatggtcagtgcattttttgctcttcgtatgggcaggcttttaagtagaccggcttgcgggcagtgtggacttcaggacgggccttatcagggctggacgtatttaggaaggagacgcgggaacgcccggccctggggaggacggaggaggcccgatttgtgttgataggatctagctcagcctagagctgcggtgactaggccgggtctctatttttagggaggagttgctaatggatttacaccctctttaaaggggtcccgggtatcctagaaattgtgctttcacttggtagagattagagataatgaagcctgctccgtagaggaaaacttggaggactttccagcctgcaggggaggttccaagcagagcttcctgtttctcccttttcttcctaaatgtccttcttgcgggcaacctgtcaccacggacgggatggctctgtagggttttatcagctgcatttgttccccaggcacctgcagatgaacgggtttttcacttgtctctctgcgaatgcattccttcatccttcatgcctgccttccttcttttgcacctactgtgggcttggggtcagggaaatatatccaagggagtgctggtggcctaagaattcagtttcctggagaacagaggcatctgaacaggcagacgggagacagggccacagggacctttatagttccatcacgaaataactcaggggttcccagtggtaaatcttggtgaggggcttggctggattttgaagccctagggacagatttgccggctggtctggcgttccaggtcattggagcagagtgagtggaaagccttatattctctaagccccaaacaagtcgttgcacagtttttttgtttttgttggtggtggtggttttttttttttggacggagtttcactctgtcaccagtctggagtgtagtggcacgatgtcggctcattggcgttgcacagtttttaaacccacagcagtgttcatctggaactcctgattttggaagcagactgggcttaggaactccagctgctgatgctttgagtaaagggaagagtacctgtctatggggtgggtgggtagggaagagcagtgggataggggcataacaggggccaacctatccttccaattgcagaggagggcctggccgtcagcactgatggatctccttgagggacgcttctcaccccttctttgcagtctgaccctgctagagatggagacagaaacagcctgtcccaataatattaatacacgtttcatcgggaaagttgacttttgagttggtgatgctcagaacacactttcttatagcaacgtgcatcaggctgcaaaaccccgttgagcctgaagtaggttctcagactggtgctgatagctctggcctgatctcagagtgttggggaccctgtgttccttggttccttcataaattctcaggggtacaggtgggatgtggtgagggatggatggacagagggaggtgtatagaggaaaagaggaggcttcagctttgtagagagcaggatgtccccacagggcgacgttggccccgaggagacactttgtgatggttgcagacatttttggttgccaccctggggtgggacatcccaccatcctgcaatgggtggggcagcttagggaagctgctcagaatctttcaagggccaggacggcctccagcacaaagaattcatctggtcccaaatgccagtggtgttgagggtggaaaaccctgaggagggcttgggagttgcatgtatgcgctgattcagggctgcccctgcagttaggagcctgccgtcccgacagtagagtcgcacacatccgatgcatccctgctctctggcaaaggctgatttgccccaccccccggggcaacggcacagcggcctgtgcggtttgaaaaactccaaacatctacggaaccgacatctcttgaacaataccaggcctcttcaggattccctcgccccagtagagcaagtgtgggcttcgttgtttttttttttttttaactctctccagagctcttgtctcctgcccctgtgggtgtgtgtggaagttattaggagaatgtttctgggcagaggaagtgggttttatcatccagcgagtttgccttgattttccatcagcgcgtttggctctggtaaaagttgattgctttgcatttaactccctactttaggccgagcacggtgactcaggcctgtaaatcccagcactttgagaggccgagggccggtgggtcacatgaggccaagagttcgagaccagcctggccaacatggcaaaaccccgactctactaaaaatacaaaaattagccgggcgtggtggtgagcgcctataatcccagctactcaggaggctgaggcaggaaaatcacttcagcccgggaagcagaggttgcagtgagctgagatcgtgtcaccgcattatggcctgggtaacagagagagactcagtctcaaagaaaaaaaaaaacttcctgctttagctctttctcctttctctgtgtatgagacagagttttcatgtaaagacaaatacatgtctttacactttggagatactcaagtaaatgattgtttgtctggaaatcatttttcttcctgaaggtcctatggtgggtacatgctgtcatttagaaagaaatgcagctcatacaatacttttcccaattcagcatttaggaatcatggcgggatttcatggatactgtctggaatgttttcggactcagatatcttcccccggggaaatagacttctcagtagccacgtggaccttgtgctggttttcagtcctgctgaaaatgttctgagcactcttgttactttaggggaaaagaattacgtgtcctttgtgatttatagacacagtaagaaataagacctgtgtgtctctcggggtgcgaaggaggaaaagtcttttttttttgagatggaattttcctctgttgtccaggctggagtgaagtggcacgatctcagctcatggcaatctctccatctcaggttcaagcagttctcctgcctcagcctcccaattagctgggactacaggcatgcactgcatatctggctaatttttgtatgtttagtagagaaggggtttcactatgttgaccaggctgaaaaatatttttttgaggtggggtctctgttgcccagactggagtgcaggggtgcaatcagggctcactacagcctccacctcctgggctcaagcaatccttccacctcagcctctgtagtagctgggactacaagcacacaccactgtgcctggccacttttaaatttttttgtagagacagggtcttgctatgttgcccagactgaaaaaaaagtcttttttttttttttgagacagtgtctcactgtgtcacccaggctggagtgcaatggcaggatcttggctcactgcgacctgtgtctcccgggctcaggcaattctcctgcctcagacacctgaatagctgggaatacaggcacatgtcaccacacctggctattttttgtatttttagtagagacggtgtttcaccctgttggacaggctggcctcaaactcctggcctcaagtgatctgcccaccttggcctcccaaagtgctgggattacaggtgtgagccacctgaaaaatcattgtaaaaatcaactgtcctacattcttatttggaagtgactcctctaaccaaagacagggaaaaacaaaccaaactttattaacatgcgtttttcattgatacatgagagatacctagaaatgggtagttttcaaggaagtggcttggattctagctgctctagtaccctcaacaaagaacagtccatttttagagaattggcagagaaagacaaaggactttgagtcttcaggggcagcaacaaaatggcagagaaaggctggttattgaagcttgttcattctgagtcctgtgttccatgtcccaggcccatgtggattttctgctgtcttccgtgcttcacctctgttctcccagttggggaggtggggttcggattgcttgtgaatgtgggctcatcgttgctggtgtagctgcaggctgcaggctgtccagggcttgaggatttgctgatattctttcttttcttttctttttattttgagatgaagtctcgctctttttccccaggctggagtgcgatggtgcgatctcggctcactgcaacctctgcctcccaggttcaagcaattctcctgtctcagcctcctgagtacctgggattacaggtgcccgccaccacacctggctaatttttgtatttttttagtagaggtggagtttcaccatcttggccaggctggtttcgaactcctgacctcaggtgatccgcccgcctcggcctcctaaagtgtattcttttttgatttattcccagtctcttggctgaaacatggtagctcaccagcatttctactcccatttgtccaactgacggtatcttttcacatctctagagaccagaaggacttcctcttcttgaatttcctgttcagtattctttcttggcttggttccttggtgagttttgaggagatggtgcatgggtgtgtttttcggctttgttttagtatgactcagggttgccaccatgccttgtacggtctcctagtcatagtattaaagtttccgcttagcaggaaaccagaaacttcctttcttctcccccagagtcagattcaaaccagtgtttctcaagtgggctgtgaaagtagcttgcagccacccaccttgcaaagaagaaaattcaacagaggagaggagaaaatgcccacagggtacatggaaagccttgctaaagaagccgcatgggcaaagcttttgttccgctccctctgtcccggtgggctgggctgagatataatatatgtttgtcattgtggacggcagctggatgagtctgaaagcggttgcaaacccctttaattcactttgctttctcaactttgaatggtgtcgtgggctggggtgggtcccctgtttttgagaatcacctgaaagagtctgattttctgcatcttttcggggagtaaagctgttgctccaaagcgctgtttaaaagctgataatagtgtatctggttgagctaacagcccttcttgaggaggcagcagactggccagagggttctgcaggcattactcatcagcgacacctgagtttgcccaggtagcctgactcttgtttgtttctgctttgcctgaccctgcaaaattattgtccaaatgcaccctggcaagcattgatccacgaggggatgctgaccagaaggagctttcgtttctgcacgatggactggaacacgatggactggaatgatgacaagaataaacacactgcattgtcttttagggccaatggacttggaggcatagagattttataactactgccagaacccaaatattgccagtcggcctcttctgctgctgttgctagctgtcttcttctgggggaaatgggttgggttctaaatatgaattaacacagggctgtcttcgatgaattcagcacaaaatgttctcagcaattgaacactcggagagaagtgttaggcatttagtgcagactcatagaatagcaggacagggagggatttggatctgggcaagcaggagatggatatgaacatctgtcttttgagaccgtgccgaggtggcaatgaaggtagaggccccctgtgttgaggtctttactcaagaggctgtggtcctttgggactaacatagcatccgatagacagacaagatggacagctacagccacctatgggaagcggtttctactcttaaaccacaagcccctagacactcatcatatcataaacatatcaccgggcagtggcttgcaatctttttttttctttgtttctttttttttttttttttagacttgcccaggccggagtgcagtggcacgattgtagctcactgcagtcttgacctcctgggtgcaggtgaatctctcacctcagccttccaaggagctgggaccacaggcatgtgccaccctcagctaatttttaaaatctttttgtagaatcggagtctgactacattgcccaggctggtcttgaactcctgggctcaagcaaacctctcgcctcagcttcccaaagtgctggggttacaggcgtgagccaccatgctcagcctgcaatcattttttttgagacaggatctcactctgtcgcccaggctgaagtgcagtggtgtgatctcagctcactgcagcctcgaacccccaggctcaggtgacctgcccaccttagccttctgtgtagttgggactatgggcacatgccaccacactcaattaatttttaccttttttgtagatacagagttttgttctgtcgcccaggctggtggacatattttaatcctacagagtccaggctaaaaacacaccagtaactgtgatgcccatccctcctgcattcctgatttctgagtgatggtttcagacacaaacctgcttgaccaccctccagtagctcttgctgacctagatccgaggttctcagctttggccccattgcgggaagcttggaaacgtcactcttgcccagggttacctgggtagtctggtttatagacgtgttaggtgttttaatttttttttttttttgagacaagattttgctctgtcacccaggctggagtgcagtggtacagtcatagctcactgcagcctcaacctcctgggttcaagcagcccacctacctcagcctcgaaagaagctgggaccacaggtgcacctcaccatacccagctaatcttttctttctttttgtttttttcttttctttcctcttcttttcttttcttttgttttctcttctctcttttctttcttcttcttcttttttttagacagagtcttgctgtgttgcccaggctggagtgccttggtgcaatcttggctcactgcaacttccgcctccctggttcaagtgcctctcttgcctcagcctcctgagtagctggaactacaggcacgcaccaccacgcctggctaatttttgtatttttagtagagacgggatttcactatgttggccaggatggtctcgaactcctgacgtcgtgatctgcccacctcggcttcccaaagtgctgggattacaggtgtgagccaccgcgcccagccttttttttttttttttttttaaattacagagtctcactctgtcaccaggctggagtgcagcgatgcaatcttggctcgctgcaacctctgccacccaggttcaagtgattcttctgcctcagcctccctcaggcgtgagctggcacgcccagccaaatttttcattttttgtagagacagggtctccctatgttgcccagtttagtcctgaactcctgagttcaagccatccacctgccttggcctggcaaagtcttgggtttataggcgggagccactgcatcccgctattaggaatttttaaaaagcccctcggagggtcttcatgtgtggctgagttgtcaagaatcattgttattttactagatattctgtttcttccctcctacatgagatttcccatgaccgcctctcggatgtgaatgtctatgccatggattacatttttcaaagagcattcagtttgttatttcatcttcagcgagcccttaagatatttctcatgggccttttgtagataaagacactggggtcagagagttcaggagcttgctggtgatcacatggtcagcatggggaaaaatgcatgtggacatgagttctgttggtggtgagacgtgggcacaggggttgctgggcttgggagttggtggctgcgtgtgtgggctgaacagagctccccaggcacggccttgtggaccttgagggatgcctgccttcaccactagtgtgacttgaaggggaggagaatgtcctgaatcagtgatgggcattttgatatggaagagaactcccttgaatcctggtggtgaacttagaccagtcactgaggcctctccagctcctcagggtctccgtgttctaggtatccatgtgtccttccatccatttatccatccatttatgcatccatgcatccatccagccatgcatcctccttttatccatccatccatcaacccatcctcccattcatttacccatccatccgttcgtccatccatccatccatcaacccatcctcccattcatttacccatccatccattcatccatgcatccatccatccatgcgtgcatccatccatccatttatccatccatccatccatccatccgtcgtcccattcctttatccatccgttaatgcacctgtccatccatccatccattctccattcatctttccatccatgcatcatccatgcatccatccttttagttcatccagccactcatcaattgatacatccatctgtccaccatccactcatctatccatccattcacccatcctttcatcaatttacccatctaccatccatccatttatccgttcacccattcatctatccatctgtccatccatccacctatctgttcatccatccatccattcatctatccatccatccacctactcacccacccacccatccatccacccacccaaccatccatccacccaaccatccatccatacctccatccgtctacccacccactcatccacttaactacccatccatccacttatccatgcattcatccatccatccacctacctactcacccacctaaactcatctatccactcaaccatccatccacctatccacccttacctccatccatccccttactgcccatctttccactcatcccatccaactacccatccatccacccagctgtccacccaaccatccacccactcactaatttatccactcacccacgcatgcatccatccatccatccatccacccacccatttacccacccacccatccatccacttacctgcctgtccatccaccctcccagtccatggctctttcatgtattccttcagccagcataggttgaagttaaatgtactattggtgctatttgctgtggtccctgttttttgttctctgctttggaggtaacaaccagggcatcaatttgggcataaaagcaccattgtggatggaaggcctggatgtctggaggcacagagcagggactacacttgttcagggggtcagagagagttctcccaggaggggccctccctggacactgagcttccaagaatgagcagaggaaaccaggtgtaaggaagaggaagggcctcttctcagcctggtagacaagcagtaagagtgatgatggggcagctgcagttcatctcagactagaggagctgcaggggccagatggtgggcaacctctgttgccactgctgaggagtgcagatttaagctcccctgaagggtttgacgcagacagctgtgcggggacgcttaacctgcctaaggcccgtctttgggtaacagcatgcagaacaggtgggaggggctggggctatttttggcagagcgtggataagtcagtggagatagaagagaaggcacaagctattttaggagatattgaggaagttaaaatctgtaacaggtccctgcctgcagagttgaccacacgtttgcatcacatgggtaggctttaaaatatagatgcctgcatctcaccttggaaagtttctgatttaattagcctgggcatcaggacttaggaaaaccccacagatgtgtgtaatttgctgctggagttgagaactggggtgcggagctgtgctccttaaactgtaatgtgcttacagatcacctctggtaatacttgtgagaaagcgcttcaggtgggctagggagaggatcacggagggcttcctggagaaggtgacattctcccagggccttgaggggtgaatagacattttccaggttcagaaagaaggaatgggctttcatggccaggtagaggatccaatgaggcagacgaggggcccaaattctgtgaccccctacccctaccccacccccaggatgcccctgtatcagtcccatggtgtaacaaccaaattcacaagatgctgcagaggggaagagattttaaattttctgagaaagacaatgatatattttggacaccatgagaaatactgttattaacttgttttaacctaggtacacgcaatcttcatcattcagtgattctgtatttgtgacttgcctgcttactaaaatgtatttgtcatccccacatcaatattcctggcatttaatttttttattttaaactttcattttaggttcggggatacatgtgaaagtttgtgacttaggtaaacatgtgtcatgaggttttgttgtacagattatttcatcactgtggtattaaacccaggacccaatagttaccctttatgttcttctccttaccctcggctattttgttcatgcacagaacggcaaaaaaattgaactttttttttttattttttttggatggagtctccctctttcgccaaggctggagtgcagtggcgtgatcttggctcactgtaacctccgcctcctgtgttcaagtgattctcctgcctcagcctcccgagtagctgggattacaggcatgggattacagccaccacgcctggctaatttttgtatttttagtagagacggggtttcaccgtgttggccaggctgctctcaaactcctggcctcaagtgattcacccgcctgggcttcccaaaatgctgggattacaggcgtgagccaccacacctggccagaattgagcttctcaatagcacatgttctcagctgaggttcaacaaagccagaccctgccttctcgggccagcgcgtactgtcaacagggttctttgcaaggtctatttggtgtcccgtgttttgtgttttcgtgctttttgtcagtgattttgcgctttcaaatatccccaagtcggtgctgacatgctacctagcgtccctaagtacaggaaagctggcatggtctcacggggaaaatacacatttgatgagcgtcatttaggcacgagttatagtgctgttggcttcgagatcaatgtgagtgactccacaatgtctattcactgcggtgtctttaaacagaaacccacataaaacgcgcttaggtagtgattggttcatgacctctgggaacgtagtcctgtatttacgtgggagcaatagttcactattcgctaattcagtgttcgctgagactttataaaacgtaactgctttgaataacaaagctgtaattaacaaaccgagctgttaagtgtgtgtgtgtgtgtgtgtgtgtgtgtgtgtgtgtgtgtgtgtgttggcctcacatcattttacagagacacacagggctctgtgaactgctaatagttgggaccggcggaggggttatttcaagctagtccaaaactgcagggcagagaccactttgaaaggagatcagcagtcggggagtggctgggatgaagttggaaaaagtgctgaggcccctaagtcagtttccggtgtttccacgttagccttggggggtgatcactcagtttcctgtagggatgggatctgggctggcatctgcctgtggaaggggtgacagggacggagagcagggaaccccgagcagccctgccttgctgttgtctgagcctcagaactcctgaaggcggggtccttcagcatcaccctggagtttgttaaaaatgcaggctcatgagcctcaccccagaccacagaacgaaaatgtctgggggtgagacccaggattccacgtctccccaggtccctcgcagggcgattctgagaactgccggtgtgaggcgtgctcagcccagcccaaacattcacaccattctttggcctcttgtaaaacttggcgtagctcaggggacgttcccagagttatggcacacgaacaaaagaaagtttcccacttcttaccaaacatattgtaaaattacaggaaagagcttgttctttcacgtctatacccttgtgccgtcgtcctagttaggatgaagccgagatgttaccttgtaccttaggccaccgcagacaaggaagtatatgcagtttaaccacctgcatataatctttttcttttttcttttctttctttttttttgagacaaagtctcattctatcacccaggctagtgtgcagtggcacagtctcggctcactgcaacctccatctgccaagttcaagagattcttgtgcctcagcctcccaagtagctggaactacaggtacacgccaccatgcccagctaatttagcagagatggggttttgccttgttggccaggctggtctcgaacccctgacctcagtgatctgcctgcctcaacctcccaaagtgttgggattacaggagtgagccaccatgccctgcctattttttggaggcagggtctctctctgttgcccaggctggagtgccgtggtgcagtgtcagctccctgcaatctcaacctccacaagcgcaggccatcctcccgcctcagcctcccaagtagctgggaccatgggagtgcgtcacaacacctgtctaatttttgcattttttgtagagacggggtttcatcatgttgcccaggctgctgttgaactcctgggctcaagcaatcctcccaccttggcctcccaaagtgttgggattataggcgtgagccactgtacccggccacctatgtataattttcaagctaagaagacagagagacgagtttaactattgctacagacatgaagcccttccctttccatagtttgctagcagagagtgtttccagggcccggcggccactatcacccactgcgttcatagctttccatggggtgaacagattgcgctggactcagcggttaaatctaaagtgtaggatgtttggtgaactcggagttccttgcacttgtctgtgatctggcacattgtgttttctgtactcagatatgcagtcactggcacacatcctgttactgacgggaagctggacccagcactggagtatttctgagactatgacactctggtgtattcctgaaactatttatgacactattaagctcttttctgtaattttacaatatgtttggtaagatctcagcgccagatttttttaaatgatgtgtttatttcttttaattgacaaatacacattgtatgtgtttatgcggttgcacatggtgtcttgatgtatgtatccatggtgagatggatttaaatatgcatgacctcacagactttgcagcacttttttgtgtgtggtgagaacacttattcagaatgggctcctttagtcgttttcaaatattcaagccattgttactaattgcagtcgccatggtgtctctgagctttcctgaagttatttgtcctgtctcatggacgctttgtgccctgtgaccgatcgtctgcccggtgttaaatgacacatcttgaaaaagaggacaatacttccagagcgattcggttttatagcaacagaaaagtaagggtgttttgaccatttgaataaaatagtaaaatgaaatgtatcagctgcctcctgctattcccacacaggaggacttccggtgcttgctccaatgtggaggcattttctcttgcagcattctgagctacaattatctctaggctggggacccttcccgaggccccccaaacctggaatgaaagtttttagggtcagaccatgtgactggttccactcgacctccaaaacgttaaaaagaaaaaaaaaaaaagagccgggcgcggtggctcacgcctgtcatcccagcactttgggaggccgaggcgggcggatcacgagttcaggagatcgagaccatcctggctaccacggtgaaacccagtctctactaaaaatacaaaaaaatcagccgggcgtggtggtgggcacctgtagtcccagctactcgggaggctgaggcagcagaatggtgtgaacccgggaggcatagcttgcagtgagccaaaatcgggccaccgcactccagcctgggtgacacagagacactctgtctcaaaaaaaggaaaaaacaaaaaacaaaaaacgctttgcctttgcttggcatcagaggactcagcagcaagtaaagagcacacacgtgccctctgcaccacctcctcctccttttctacaatgtcctgaaagtttcgtgtttagtgggctttggaaaagggtgtggaaaaccagcaggagcagatgagtactggagtggccagcagcaggtgtgaacaccctggggtgatgctggggctgagtgaattggacatttttcagcagggacacccaggccagtggcgggtcttcatcctcccacccttaatggagatgaacggcattattgagaaagctgcaggcacacacagagcactgcttaaatgatgtccctggctgctgctgttactatgtaatgattgtgttattcttatgaaaatctgaaagttacaggaatcttggaactgcctaattttttttaattaattaattaatttatttcgagacagagtctcactctgtcgcccaggctggagtgcagtggtgcgatctcggctcactgcaacctccacctcccgggttcaagcgattctcctgcctcagcctcccaagtaactgggactacgggcgtgcaccaccacgcctggctcatttttaattttatgtgaaacacctgaatgatgtgatgatggggtttaagataacccaagtgttcgggcgcggcggctcacatctgtaatccctgcactttgggaggccaaggcaggcagatcacttgatgcccggagtttgagaccagcctggccaacatggcgaaactccatctctactaaaaacacaagaattagctggatgtggtggcacatgcccatagtcccagctactggggaagctgaggaaggagaatcacttgaacccaggaggtggaggttgcagtgagttgagatcatgctactgtactctagcctgggcaacagagcaaaactctgcctcaaaagaaaagaaaagaaaagaaaaaaacagcaaaaagagaacccaggtactggctctcctcctgcgtttgccccggttgagtgcattcctgcattagtgcaagccttagtcacgttgcagaggaactcacacaccccatgtggcctcggggacttcactctgggttcgtcctgttttttgagttgcctggctgatgagaaaaagtaaacatggtttgaatcagtagaaagtgtcttgtcagactgactcatgccatctgtcgtccgttccgccttgccctgatgagccattaccctgtcccggaaacatctggagctttgagagggccgggtggaaacagcagtggcagttgggggttctgctgagggtctggtctctttgcaaatttgcagagaggctgaatgccgtaaacgtgcaacacaggcacctgagttctccaccaggctccttctctgagggcatggttgcagctcttgctgggtgggttttgttggtgttttcttcacatttgtagccccggaggtcgttttcaggagcaaaaaggcaagtgggggtgtctgctgtgagcccgcaatttcctgcctaccacctgaaagctcagggaatgtgatgaattgggagatgaatcctaggcaataaagagagcagtggactgagttaggagacgatagcttcatttacagagattcctttactgactgatgatcattgattgggtttgcttccccatgaggcttcaagccaatagcacgtgcatttgcatccatttatatacacctgggggactgccttcctcacacacacctgggggactgcctccctcacacacacctggggaactgcatcccttcacatacatagggaactgtgtccctcacacacctggaagattagcctcagaggtgtctgcagtaccagattccaccagggagtgaacgtctgattatgggtgattcagggtgcccacgtctatatgaaatcgagagcgggtcacctccctttcctccctactctctgtggggtggtgtttggggagctgtcttaagtgttagtcacccgaggagaaaatggtgagggtgggactctgtatctgggagaaaggagaccttggaggcaggggacagactgacagagccttgagcgatggaagctgaggtcgagggcccaaggtcgatgatagaatgcttggggttgtctctcctctggtgtccttgtccttcaggcatcctggagtgacattgaaattgtttcaattaaaaactgtagaaacagcacagagataagaatggaagacaagctccaagtgcggggctgaggcgagttctccaaggactagggctaagggcagagggtgggagaaggggagaagggcgtgaggggcatactgtgtcctttgccacccactctcagacttgttgtcttggacctccgtcggctgagcttggggtccggggagcagtgggtttggacactcagtggtgacgtcagccgtagtcctgaagcagaggggaagttggcaatccaggcttgcctgggggtgacactggtggcgggagggcctgtgccctcccctgtaactgggtttgtgtggggtccatgggggcattggggtcagtggaaggaacatgaagtgagccagagcatcgtcactgtggcctctgagggcaggtggagcaagaaaaggaggaagcttctaagtgacacctggtcccagctcagtggctatgaccagggaagtcatgtggaggaaaaggctggtggactctgagggtgatggaggaggatgggaggggcaagctaggctggggaggtggcaggccatggacacacaccagacagacacacatgtgcatgcacacatacacaggcacatacatgcatgcacactcatgccatgcatatatgcatgcatgcacacgtgtgcacccacacagcaagtcacatgtgcacgtgagcacacatgaaaacacacaagcacatgcacatactcctgcagtgcacatgcacacccatatatgcatgcacacaggtgtgtgctcagatagcaccctcacacatatgcacacaagcacacaggcaaacacgcagacacatgaacaaatgcacatatatattcatgcagtgcacttgtgcacatatacacatgcaaacaggtgtgcattcagcacactcacaatgcacatgaaaacacgtgtgcacacacatgcagtgcaatacatatatgcatgcacatgtgtgcccacaccatacacccacacatacgtgcaggagcacacacgtgcacacacagaaaccacatgaatgcatgagcacgcgtatatgaaatacacatgtacacatgagcacatccacacgcgcacatgcatgaacatagacacacacatgcatgtacatagacacgcacatgcatgtacatagacatgcacacgtatacccaggccctgcattggaaaaaatccaaaatgtggcttggttgcaaagagcacatgaagagctgttgaatgcagaggtgcccagcaagaagcatggacctaaacccgaaggtggttgggggaagcttggggacacctgggtgggcaaatggcccccctgaggcccagggacagatgcaaaaacccagcaagccaggagggtctttgaaaaaaaaaatgtgtaccacatgtgacatttcccatgtgagggaagcatcgagatcatactgtgttttccctgtgccctgcgattttgcagctgacatgccctttctgtggaaatatatagcagtcctcatgctaggattgcgtgttctgtgtcaggcagctgggcatgggagtgcagggtgtggggtggaacctgggaggagagttctagttttaccactgtgttccggccgtggggtgtcctggggaatggaggccacctcctgacactggagtttcctgggttctgctgtgagcgaggagtgggagaagacaagactctggtcttagaaaccttccgagtctcgtacgcccttgactgccgtttctgagtatttcctgaagcttgggaaggatgagtcactttaaggggattgtcctatgttgctttgttttgtttctttagtgacggtgtctatgatcatcttctgtttatgagggtgaaattacagaaataagaagggttacacttaaaataatatctgtactttactttcacgtgtggggtttttttttgtcattgctgctgcttttttttctttaacattctgacagttctgtctgcttattattaagtcttcctacctttctaaagagaatgtctttcttgctaaagaatacattatggactcttggaatctctttgttggggtggagggggtggggacttgccctgacttgctgggaatgcccatagggtttagaagtcacgtctaccgctgaggcactaacaaaggtaagccttcaaggaagcactgtcatttccggggaagagagttttgaggaaattgaaacagttacgaattgatctagcagtccctctactaatgtatctacatatgaagatatgtagagatgactttttttttttttttttttttgagatggagtctccctctgtcacccaggctggagtgcagtggcatgatctctgctcactgcaacctctacttcccggattcaagcgattttcctgcctcagcctcctgagtagctgggattacatgcgcatatcaccacgcctggccaatttttttgtatttatagtagagacggggtttcaccatgttggttgggctggtctcgaactcctgacctcgtgatcctctcaccttggcctcccaaagtgctgagattacaggtgtgagccaccgcacccggccccagagatgacttctaaaccttcagggtattcccagcaagtcagggcaagtctatatatatataatatatatatgtgtatatatatatttgtataaatatataattcgtatatatagtatgtatatatagtatatatagtatgtatgtatatggtgtgtatatatgtagtgtgtgtatacatagtatgtgtatatacagtatgtatgtatatagtatgtgtatatatagtatgtgtgtgtattatatatatatatagtatgtgtatgtgtgtatatatatatatgtttatttgggataaggaaaggaaatcagtatgtcaaagagacactcccctcccatgtttattgcagcaccattcggagtagccaagacatgcagtcaatggaagagcccatcaagggatgaatgcagaaagaaaatgtgctatatcaactctgtacattcactaaaagccattcatttgcacagtgagaataagtgcctttcatgctatgtaaactatgcctcaataaagctattaaatgaacaaagaaaatagggtatattcacaatggaatggtattcagctttaaaaaagaaggaggttggctgggtgcggtggctcatgcctgtcatcctagcactttgggaggctgaggcaggtggatcacctgaggtcaggagttcaagaccagcctggccaacatggtgaaaccccgtctctagtaaaaatacaaaaaattagctgggcatgatgggcgggcgcctatagtcccagctactcaggaggctgaggcaggagaattgcttgaacccaggaggcggaggttgtagtgagccaagatcatcgcactccagcttgggcaacagagtgagactctgtctcaaaaagaaaaaagaaggaagtcctgccatttgcaacaacatggatggaactggaggacatgatgttaagtgcagtaagccgagcacagaaagacaaataccgtctgacccaaacacgcttacgtggaatctaaaaccactgaactcacagaagcagagtggaatggcggtgaccaaggggttgggagtgaggggtgggggaaatggggaaatgatgggtaaagggtacaacatttccatcagataggaagggataagttcaggggtctactgtactcagggtgactgtggttagtaagaatgcgttgcatacttgaaaatgcctaagacagtagctttgaactgtttgcaccacaaataaataggcgaggtaagatgtaaataaagaaaaaaaatacttcaaaaaatacaattacagatttctatggaaacatatgaacatgagtgcatatatatatttatatgtgcgtgtgtctgtacctgccttatggtttattctggatcagtaggatcctcccttgctaccgtctaaagatctgccgcatgctgcaggaggagctgtaattgcatttatgatgtctggcaagtgtcctgttgtggaaacagccatttcagggctctgaggttgtggaaacgactccactctggttgccggcatggggcccacagagctgttccgagcgttttgtctactttctacttattgttgacacacacagaaacacacacgcagccatgagtacacacacacacagacatacaagcagacgtggacacacctacctgtatgtacatactcaaaacacaccttcacactatactcacctacccatacacacacgtgcacacaactacatgtgtgcacacaaacacatgcatacatgcacctatgcatatgcacacgtggaaacacacctgcacactacacacacctacacatacacacacaaacccacaaatgcacacacccacacaggcacaaacacacaaatgcacacacccacacatgcacaaacacacctacacacataaacatattgacacatgcacacatgcacatgaaaaacacatatacacactacatccgcctacacatacacacacaaacccacatatacatgcacctacacacatgcacacataacacctacacacatgcatacagaacccacacatacatgcatccataggcacacagaaacacacctacacactgtgcacacctacatatgcacacacaaacccacatgaacatgcactgacacatatgcacacaaaaaacacactacacacacagaaacccacaaaatacacctccacacttacacaaaacacgcctacacatatgcacatacacaaacccacacatacatgcacctgcctatatgcacccacaacacatacacatatgcacacacagaactcacctacacaccccatacatgcacacaaaacccacaaatacatacatgtgcactgcaaatgcccaaatatacatgcacactcacacacacatacccctgtgacatatgcatgcacgcttcatttatacatgcaggagcatagcctggtcgtttgcacctgttgtggaactggacacacttccggtgttcacagggctcctgcgggttgttcttggacccctcgccacccaccgccaggtgcttcctgacggttgagagatgttgtatgcctttggtgctgaggagtggggacgctggatgttgacgattatcctaactcttcctccagttgaccaaacagtccaagtcgacttttccaaattttcctgaatttggcttttcttcagtgcgccagagatggccagccacgttgaagtagcattgaaattgttgtaattaaagactgtagaaacagggtagcctatcaataattcagcatgccagtttcctcattccgtgggattccatgagatttttttttaatgcataatgcacgtgtctttctgggttgtctagtgtttctactatattttggtttgtaattacaggaaagttgccaataaaaaagggagaattttgttccccatgttgttttcagtacatattcaaaattgttattcatctgtttgaaaggaacgacctgttaagaataatacacaaaatgatcgtgtttttacactattttaatttctactaagcttgaaggtcatcatttatttaaaacctaggctaacatattcttacttttaggcatggaagtgaatatttagaatgagaagagaaatcacgcaccttgtaaatttttttaagttgctgttttaaatatcacaaaaagaaaaatcgcatatcttttttatctctataatattcaaatttatttttatttttcttgtttctaagttgactctttttttctctcttagatggtggtttcgatttatccgatgcccttcctggtgagtatcaacatcattttttaaaatcccgtcaatattttatgttaacatagtatatacaggcatatcccagccatttccagctaggttctagaccaccgcaataacaggagtcatagcaatttttggcttcccagtacatataaatgttatgtttactctcaactgtagtctattaagtatgcaatagcattacctctaaaaacagtatactccaattgaaaataccttattgctaaaaaatgcagatacagagacaggaagtggggcacgtgctgttggaaaaaatgatgccgagagtctggcttgccacagggttgctgcaggccttccgtttgtaaaacacacagtatttgcaaagcaccttaagacaaagtgcagtgaaggaggtccgcctgtatgtgtccacctgccttattataaaaactagactcatagatgacgaggaaaagcaagatgcccttgttaagataaatgaaccaccctggtggaataattcacagtcctgtgatggtcagaggccgagcaaaaacttgccaggtccttggggaggggtctagaggaggtgagcaaatggaggtccccaggagagaggggcatccagtgctggcatcctccctctcgaaatcggcacccgctgtctccatggggccactccttccttcttctgcagctcttcctgtctcccgctcctcacccagagccctcggtgaagggcatgggaaaaggaattgaaggaattccgtcttatcactctatcagcttctgggtcttgtcatccctttgtatttgttttccggggctgccataaaaaggtgccaccaactgggggcttaaaccacagggatttatcatcttccagacctggacaacagaagtctgagatcaaggtgtagacagacccatgctccctctaggggctctaggggagggtccttcctgcctcttgcggcttccgggagctccaggtgtccctggacttgtggccgcatcactccagtctctgcctccttctccgtggggcctcctcctctgtgtctgtgtctccttttctttgtcttacaaggatacttgtcattgggtttagggccactctactccaggattatctaatctcaagatccttctcttaagcacatctgcaaagaccctatttccaaataaagtctcattaccaggttttaggctttaggatgtagatatatcttttgcggggaccactgctcaatccactgcagttatatccagttctttttggtggctctaggggaggatccttcctgcttctcccagcttttgagggcttcacgtgtccctgtgcttgtggctgcatcactgtaggctctgcctttgtgaacgctggtctcttccctgtgtctccatgtatctaaatttccttcctataagggcaccagtcattaggacctatcctaatctattataacctcatcttaactgattacaactgcaaagaccctgtttccaagtaagatcacctattgaggtttggggtgggtgtggatcttggaggaatgcttttcaacccaggacagccctcttcattttttttttttttttttccgagatggagtctctctctgtcacccaggctggagtgcagtggcacgatctcggctcactgcaacctctgcctcccgggttcaagtgattctcctgcctctgcctcccgagtaactgggattacaggcatgcaccaccatgcctagctagtttttgtattttcagtacagacggggtttcataatgttggtcaggctggtttcgaactcctgaccttgtgatctgcccgccttggcctcccaaagtgctgggatgacaggcatgagccactgagcccagccaccctcttcacttttttatgttttacttttttttttctgagacactgtctcgctgtgttgctcaggttggagtgcagtgttgggatcttggctcactgcagccttgaccgtctgggctcaagcagtcctcccacctcagcctgctgagtagctgggactacaggcatgtgccacctcacctggtacagtgagcaacacggggtctcactgtgttgctcagattggagtgccacggtgggatcttgtctcactacagccttgaccatgtgggttcgagcaatcctcccacctcagcctcccaaagtgctgaggcgtgagaggattgcagacacgagccactgcacctcgccagcttttaattttatgtcctgtggtgcagtgcagatggtttgagcggaaacagtgctgatggggatcatctctttcctgaccacctaccccttcttggcccttgggaacaaccattccctgcagtgggaggtgcccttagtcttacagcctccacctgatttgcctgattggcttccattctcagagggggcagcctaggcagaggcctgacggggccaaaagtgtgtttcatatgagaaatgtgaacagcctttcagccatcaatccggtgtctctccttctcatgcatagatctcgggctctgaaaagggcagtttttctcctaactttgccattctcctgccttcctggcttatgtctcagtcatagtcccattcaacgtcaagaagtggagaagggctgggcacggtggctcaagcctgtcatcccagcactttgggaggacgaggtgggtggatcacctgaggtcaggagttcgagaccaacctggccaacgtggtgaaaccccatctctgctaaaaatacaaaaaattagccgggagtgatggcatgcacctgtaagcccagctactcgggaggctgaggcaggagaatcgcttgaacccaggaggcagaggttgtggtgaacggagaccacaccattgcactccagcttgggtaacagagcaagacttggtctcaaaaaaaaaaaaaaaagaagtggagaaggggctcctggtctctgtggaaaccatggccggtagcagcctctgtgtctgtcttctgggctcaagagtcgttgtataaacctcagctcggtgtgggcaggtgagaaaaaacaatgctaaaaacattctccgactgtttccaagaaaatgaaacatccttaaccacaaaagagttgacacttgttttcccagctgcaacttttactaactgaaatatcttatctctttagacaatgaaaacaagaaacccactgcaatccccaagaaacccagtgctggtgagaagggcttcttcctagtatgcaaagaaaaagagcaaatcattttctcggacagcaggacgggacttaggcaactagaaagaagacagaagtgatttgagtgctccggctggagtctggttaatagttaatactggaattgtgttatgatgttacatttcatgtagtgattccagtaaaagaatggttgctgatgtgaaatgtttcggggccatttggacaacatctctgtgtgcttttattctaagggtctgagttactctgtctttagattttcttccctttttttttttttttttttttgagatggcgtttcattcttgtctcccaggctggagtgcagtggtgtgatcttggctcactgcaacctccacctcccgggttcagtgattctcctgcctcagatgcctcagtagctgggactgcaggcaccagccaccacacctggttaattgttgtatttttagtcgagacgaggtttcactatgtcggccaggctggtcttgaactcctgacttcaggcaatctgcctcccaaagtgctgggattacagcggtgagccaccatgcacggcctgtgtctttagatttcaacttcctaggagagagagcatttggtgctgagatctcccccatgatgaccaacaagtgaactcatctctcaacctgtgggcacacacctcatttgttctcagtgcttgctgttctttctttctttttttttttttttttgagacggagtctcgctctgtcgcccaggctggagtgcagtggcgcaatctcggctcactgcaagctccgcttcctgggttcacaccattcttctgcctcagcctcccaagtagctgggactacaggcagcggccaccacgcccagctaatttttttgtatttttagtagagacggggtttcaccatgttagccaggatggtctcgatctcctgaccttgtgatccacgcgccttggcctcccaaagtgctgggattacgggcatgagccaccacacccagccctcaatgctgttctttcaaacaaaagtcagaaacgaggtccacgtgatggaattgcccaagggtcaaccccactggcggataaacagagtaaaaatgatgctaaaacttatggcatcagtgtcttacagctaagacactgtcttgtcttagcacttctgagttttctaatataaaacattaatagctccacttcattattgggcttcctgtctagagtgtcagctcatgagcaaagggaccctgtgtccccagatccttgaactaagcaatcatgcagatagcaccaatgagtaggtgttgagcgtctgaatttatactatcatagtctccttgaggaagggactggaaattcccatatgtcactcaggatggctcagtacatgctgttgggtggatgccagcaaccattcctccatcttagttgggttttcaaaatcattcttcatactagaagacaagatctgaggccatggtgaactgtcacatcagttgcggagcacatatgggttgctagagccatgttttagacaccctctagcctaaatctgatcacagtcatctgtccccttctcttagggtctacctttccaaagttgttagggacctgggaggagaggatgatgggatggggagtcaacaggagaaaatcatgtgcaggcagaattggaatttcaacttggtccaggcaacacaattcatttataaattactttatttctctctctctctccccactgcctctcctctgagagcttctctcctagctttttatctgtctctgtctctctgttttttcctctttttatctgagagaatagtgatgtaaaaatggtcaggaattcactttttctaatgagatcctggtcaagctgatattcagaaaagtatttaggaatgtggggccgtggtgtgtttttgatctgttcacgaggtcattccttcctcgtttctctctggaatttggtattaactgctctttcccctcttttaggggatgactttgacttaggagatgctgttgttgatggagaaaatggtgagtattttcctttaatctcttctgctgctgatctgcttattatcacccaattatgatcatttcagagagaattctcccatttaaattataaagggaaccagttttcacagtggaaacctagggaataggtgtgtcggtttgttcttgctgttgtcgttgggtttttctttacaaccagtacgtgtgcttttattttaaaactcttacagtctttggaaggacatgagacaaatgtgcctaccctggccagggctggcttcaccagcatgtgacctgtgcagtggcacaggaccccatggcatgttggtttggcatgggaaccatactggtttactgctctgttgccgccatcttggaatacttaagaaaatttgaaaaatgggtcccacctttttattttggccctagaaattctgtagctggtgtggacacccgctttaatttttattaaacatagttgacattaagaactgtggctgaaagttgatgggaggaaactggcaggagactgtgtgtgtacaggtatccccaccaggacaaaggccaaggtccaatttctgttcagggaaccatctgtgtgtaaactgatgtttcattttctttactgcaaggcacttaaaattgcaactctcatctttcacaaacagacgacccacgaccaccgaacccacccaaaccgatgccaaatccaaaccccaaccaccctagttcctccggtaagagtctctgaccctgtgggatgtcttcatgttgttcagaattcagcgatatttatgtcagctgagaggaggtgatttcagatgagtgtgtgcttactgttgactgcctgtgcagtgtaatgcccatgttcatgtaatggaaaatgtacatttcaaaaatatatatttagcttggattttatttttagtttgcttttttttttttttttttttttgagacagagtcttgttctgtcacccaggctggagtgcagtggtgccatcttggctcactgcaacctccacctactgggttcaagtgattctcctgcatcagcctcctgagtagctggaattacaggcacacactgccatgcccggctaatttttgtatttttagtagagacagggttttgccatgttggccaggctggtcttgaactcctgacctcaagtgatccacccaccttggcctcccaaaagtgctgggatgacaggtgtgagccactgtgcctggactagtttgctacttttgtttccaagttccatcttatggaacttctaaaaaattgcatacaataatttaaatgtagacttgataaagagaaaagtattggcatacacattccttgtggagaagctagtgtgttttaaatctttctgcccttaaatatttaagtcagtttttctgacatatcacagcattttcagcgtaattcgaatagcaccagttttttttttttagctgaatggttgtcgaaagtttatatgtttaggtttttttgtttacatatttaatttttaacacagaagaatattaatgatgtccatatcttgttgacattttgatggctatttgtgctagtattttatatatcttttttttttcttttttgagacagggtctcactctgttgtccaggctagagtacagtgctgtgatcatattaaacataagagcataccacagcctccaactcctgggctagagagatccccctgcctcagcctttcaagtagctggggctacaggcacacagcatcgtgaccagttagttttttcattttttgtagaggtggggtctcagtatgttgcccaggctggtctgaaactcctggcctcaagcagtcctcttgcctcagcatcccaaatctctgagattacaggcacgagtcacctcacccagcctatatattaatctaaatgaaataaattttaaataaagttccaagtcttttgtttgtactgcattgtaacattactttttgcttactgatagtccatgaacattttttcatgtcatgtaatcatttctatcgtatgagttttactgataatcatgtactattacatactacatatataattatattcttcctgtaactaatccctaattctgaaaatgttatgtttcttctggcattttagaattatgaattaacaaagcaaatctgagtcaactccatgcgctatttttattcctttgaagacatttctagcattcaaatagtttagatcaacgtatatgagtactttcgtagcttttgacctggttgttaatttgctgcagatttttaccaatttattttgatgccaggggtgtgtgcaaatgtccctgtcttcacaccatctccaatattagttatcacctaggaaacctttgcaaatagtgtgaaattttctatcaactttctcctggtttcatgactttacttttaaaattaaaaaaaaaaaacaaacctgcatcaattggccgtggatacttcttattttgtgtattgtatgctttgccttttattcttacattctgatatgacattattgatttataagccttcttcatttatttacagacataaatattgccagcatgcaatattatgctcacgtttttccactttatttatggttttttgttttgttttgttttgagactgagtttagctcttcttgcccaggctggagtgcagtggtgccatcttggctcactgcaacctccacctccagggttcaagtgattctcctgcctcagcctcccgagtagctgggattacatgtgcctgtcaccacatccagctaatttttatattcttagtggagatggggtttcaccatgttgatgaacaggccggttttcatgagtttttcctttattctaagacatgaagacccttggaggagttccaggttgacaggtgatgctgtattttctttcctaggtagcttttcagatgctgaccttgcggatggcgtttcaggtggagaaggtacagttatcttgttttctgtctcttttctctctccatcccatgatgcccacctgctctgtagaatcactacagggtctaaactgtcagctctctgtgaactcacagtgaaatgttcagccatctctgtgggaactccgcctgtttgctgaggcttcaaggatgtgggaagtaaaggctgccccgtagaggttcggtcctcggagaagagttcagggcccaggcagctgccccacttttctgagggacagggcgtgatgaatgggcccttgtcaccacctcctcacccatccgttcacctgtgtgttcttgcaaataactagtgttgtttcagcttcattttattaggctgttttctgtaatttaaggaatgtgaatattaaagccctgagaatagtgataatgcctgggagtatgcgttctcagagtacccctagagtgtaacaggcagcacctcagctctgtagctgtgtaacatgcacccttagagtgtaataggcaggaccccagctctgtagctgggtaacatgtacccccgtagagtgtaagaagcaggaccccagcctcttcacggtcctggctgtgaatttttccttgaccccaaaccttcccattgcagacgttgtttttgtcttgcaggaaaaggaggcagtgatggtggaggcagccacaggaaagaaggggaagagggtaggtgcacctggcttctgtcttcttgtctctcccacgtggtgttgagaaggggaagcagaatgtctgagagctggcggactgcactggcattggcctcctaaagctactggcaggaggcacgggtgttctgtgccaagtgctcccaagtgatgtagctgcagaggtcccccagcaaaccagccctgctccgggtgcccacgtgacgcggattttatgtttggtcacctgcccacgatgccctggctggcgacccgacccctacatcacgcttcgccttgtccttgtgtttacaaaagctcctacactcaccctaacgatcagaggcttgtgacgcagtatcctcggttgcgcttggcccttgagaacgtcagtaaccaggtgggaggtgggaatgtggatcgcttccaccctggctgtaacaggcattgtgttctccatggaagtgccggtgatgtatctcctgtctcctttttcataaccttttcccttagatgggacaagaaaataatgacagacagaattccttttaaaactgtaaagaaaacaaaatgaggtaagaaagagaaacagagaagtagggaggaagaaaaaagggaaggagggaaggaaagaaggaaggagggatggagagaaggaaggaaggagggaagaagggaaggaaggaagggaggaaaagtgggtagtctacccttgttttaggtatttattatttttatgggtacagttcttgaattctaggctttctttgaagaggtagtaatctgtagccctcacctaggactacaaggtcattttttaaaaaatagctaagaaaacacatgtctggcatgtttatctcaggccatcgttcttggccttctagagagttaatgtctactatgtcacttcatcagggaggggtagttaagcttgaaaaatctttctatgacatgactgtgtcctgcacatattaaaaactggccgagtgaacacaccaccgacaggccatgtttggagccagtgtttttgctgaaagtcagacaattctccttccccgtcgtggagggcggagaagattctatctggagaagggtcctctgaagctcacatctggcatttggaatgaataatctcttcaatggccaggcacgctggctcatgcctgtcatcccagaactctgggaggctgaggcgggaggattgcttgaggccaagagttcgaaaccagcctggccaacatggtgaaaccccttttctacaaaaaatacaaaaattaggccaggtgtggtggctcacacctgtaatcctagcacttcgggaggccaaggtgggtggatcacttgaggtcaggagttcgagaccagcctggccaagatggtgaaaccccatctctacaaaaaatacaaaaattagctgggcgtgtgccatgcacctgtagtcctagctactcgggaggcacaagaattgcttgaacccgggaagcagaggctgcagtgagctgaaatcgtgccactgcactccagcctgggtgacaaagtaagactgcatttcaaaaaaaaaaaaaaactagccaggggtggtggcacacacctgtaatcccagctacttgggaggctgaggcaggagaatagcttgaacccgggacgcagaggttgcagtgagccgagatcgcaccactgcactccagcctgggcaacagagcaagactctgtctccccgccaaaaaaaaaagaattattgctggaataacataaaaaaaaaaaaaaaggctgagtgtggtggctcatgcgtgtaatcccagcattttgggaggcctaggcagcaggcaggttgctttaggctgggagttcgagatcagactgggcaacatagcaagaccccaattctataaaaccacagtaattaaccaggcatggtggtgcacacctgtagtcccagctactcggaaggctgaagtgggaggatctcatgagcccaggagtttgagattgcagtgagctgtgattacatcattgcactccagcctgtttgacagagcaagaacccatctcaaaataatacacaataataataattaattaaatagagatagatttaaaatgtctgcattgaaacccaaagctatcttcaaggggtgaaaaaggagcattctaacgatacaaaacgcattggcaaatgccccaagcattgcaggtctttgcttctttatcttctgcccctgcctgggctccttcctccaggtttgatgtccagctctctctttcttttttgttttgttttgttttgagatggtgaattgctctgtcgcccaggctggagtgcagcggcacaatctcggctcactgcaacctctgcctcccaggttcaagcgattctctggactcagcctcctgagtagctgggattaaaggcacccacccttactcccggctaatttttgtatttttcgtagagacgggttttaccatgttgaccaggctggtctcaaactcctgacctcaggcgattcacctgcctcggcctcccaaagtgctgggattacaggcgtgagccaccacgcccagccccagctctctttccatctgtctttgtctttttttgtctctgccttggttctgctgagcttctgcccgtacctcgctggcctctcttcatgtctcttttctcctgctccactccctccatggtctgaccaggtctgcccagcacgtgcgatgggagattgtgccttgctttgccttcctgtgtatcattctcggcatgcttcctttgcaaatcggtcagctcaggcgtctgagatgttctgaggatcttggtgctctcagactgactgtctctgccagccactgccccctgggatcttctctgcaccgtgcgtgtctcaatcacgatgctgtgtgcttcctcctgcagccgacgccccaggcgtgatccccgggattgtgggggctgtcgtggtcgccgtggctggagccatctctagcttcattgcttaccagaaaaagaagctatgcttcaaagaaaatggtaagtctcagtccgccggtgcctctccttcatgccttgctgattggaaaactgtgctttctttaaaaggcagaaaccaaactcgggctggcacgaaacaggtgcacgatggctgatggttcgtgaaactgctaaaattctggaatcgaaccttctggctttgatttcagggctgttctgccttgtgttttgttgtgtgaaagtttacaagttccccactgctgcagtgcttgggttgtttacgtctaccaagtgggaaatggttggtacatatgccgcggaattgttgctggggttagagacagtcctgcaggaaagccgctacaagttaccctgcagagagcaaaggtggaagacacttagctctgatcattcctgccctgttatttacaaccgatgtcatcatcaggaggagagccgtgaccagggggccgccacggtcctttctccactgagagttaagttaaaagccggcacaaggccggacatggtggctcacacctgtaatcccagcactttgggaggccgagacgggcggatcacgaggtcaggaggagatcgagaccatcctgggtaacatggtgaaaccccgtctctactaaaaatacaaaaaattagccgggcatggtggcgggcgtctgtagtcccagctactcggaaggctgaggcaggagaatggtgtgaacctgggaggcagagcttgcagtgagctgagatcatgtgactgcactccagcctgggcgacagagtgagactccgtctcaaaaaacaaaacaaaacaaaaaccagcacagcggattccctttctgttagtaccgaaaacccacaggcacccaggacctgggaagtttcttggatcgggactaaaatttacaggggaattaggaggaggacgtactcaccattgcaatcctcctaggtcagctggcaggctctttgggaccttgtattgggatccgccgtgaagctgggaagtaagccctgctatttggaacacagctaacgtgcatgcatcactgggcacttacatttagctcttgccttccctcttgcatgaccaagcattgtggtttgcaggaatcccatcgaccgggaacagctactcttattttttatttcttgagacagagtttcgctctgttgcccaggctggagtgcagtggcgcaatctcagctcactgcagtctccaccccacaggttcaagtgattctcctgcctcagcctcctgagtagctgggattataggcacccgccaccacgcccggctaatttctgtatttttagtagagatggggtctcaccatgttggccaggctggtctccaactcctcacctcaagtgatccacccgcctcggcctcccaaagtcttgggattacaggcgtgaggcaccacacctggccaacagctactgttttatggaggagcccctggggtccctcacgcctctgggtgtctgaacttctcaccctacttagatcttaagtccttattcattcttggtcactgatgtcattcactcaaagcactgcctcctgaagattttagagggattcctagaacatttgaatagatgctggtgtggacaaagttagactgtaggggtggagtttccccgtaatctcccatcattccagcatttgacatccacaaacattatttagagcgtgaaatggagagtcctaaacagctttcggatctcaagactttaaatgagctgctcgtgtttatttccccgttcttgctgtggggttttgggcagtgcgtggaagacagttgcctcctacctggtgggcagacgagtgggaaatggtgtttggttgtttcttttttttttttttttttttttgagatggagtctcactctgtcacccaggctggaatgcaatggctccatcttggctcactgcaacctccacctcccgggttctcctgcctcagcctcccgagtagctgggattacagatgtgcaccaccacgcacagctaatttttgtttttttagtagagatggagtttcgtcatgttggtcaggctggtctcgaactcctgaccttggatgatccgcctgccttgacctcccaaagtgttgggattgcaggcgtgagccaccgtgcccagctggtgtttggttgattgaatggcagttttgagcgggacccaaatggacagatgaccacattcaaggagatgcctgtaagagacgtacgattagaatcacgttggaaaaaagcaaacagcataacattcttctcccctcttgcttcttctagaagtagcggaggggttaaaacagtagggactcaatggaagggaatttttgtttgcttttcaatgacatttctttttcttttctgaaactgttcaactcacagcataatattcaaccaggaggtaaggaaggcttgtttgccaggacaggatgcgtaatattctagatgttgtatttcaaactctctggcttttttttttttttttttttgagacggagtctcgctctatcgcccagaatggagggcagtggtgcaatcttggctcactgcaacctcgcgggttcaagcaattctcctgcctcagcctccgaagtaactggaattacaggtgtgcatcaccacacccggctaatttttgtatttttagtagagatgggggttcaccatgttggacacactggtctcgaactcgtgacctcaggtggttcccccccgcaatcttggcctcccaaagtgttgggattataggcgtgagtcaaagcacccggcctcttttttagaatcccagacaattgttgaacacttttgcattaaactacaaagtctctgattgatgattctctgaaaatctttaggtcaacccaaattggattcatgagttgcaaaggatgtttattaccttgtgcgtgcagacgtaggaacttttgggatcttgtaagcctatttcatattcacatcctgtattagtccgttttcacactgctatgaagaactgcctaagactggataattcatgaaggaaagaggattcattgattcacagttcagcatggctggggaggcctcaggaaacttaacaatcatggcagaaggggacgcaaggcaccatcccattatcacgagaacagcatgggggaaccttcgctatggttcagtgaccccaacctggtctctccctggacacatggggattatgggaattacaatttaagatgagatttgggtggggacacagaggctcaccatatcacatctgaagacacacaaacttgggaaagcacccaggaggcttaatagacttgattttgtcaaaaattttgaaatagaattgggaaaaggaaaaacaacttttcctctaccttatccgccccgccacccctgggtcttggtcttgggtggaagcattatctttttttattgcaggaggtggggcaggcatgaacaatgaaagctctcactgggtagaaacaattttcctagattcttcaagaacaaaagcaaatatgtcctggcgaggtggccgacacctgtaatcccagtgctttgggagtccaaggaaagaggattgcttgagcccaggagttcaagatcagcctgggcaacatagtgaaacctcatctctacaaaaaatgtaaaaaattagctgggcgtgcttgcgcctgcctgtggtcccaactactctggaggccgaggtgtgaggattgcttgagcccaggaattggaggctgcagtaagccatgattgcaccactgcactccagcctggacgacagacagagaccctgtctctagatataaaaataaaaatacctttttttttttttttgagacggagtctcactctgtcacccaggctggagtgcaatggcgtgatctcggctcactgcagcctctgcctcccgggttcaagcgactctcctgcctcagcttcccgagcagctgggactacaggcgcgtgccaccacgtccagctaatttttcatatttttagtagagacggagttttgccgtgttagccaggatggtcttgatctcctgacctcatgatccacctgccttggcctcccaaagtgctagaattacaggcatgagccaccgtgcccggcccccaaaataattttttttaaaaaagcatcctttctgaagaattggctcaggggagtccaagattcactttatactaatgagatgctaggctaattttcttctaatattttctataagtctcttattctgatgccaaattaacagaaggtccaactttcaattcctggtttgctttctagttatcctgggattgattttcttggccttttgtaaatgcacaaagcaaagggccaaaaagaaaataaaataaagtataacaaagagaagcaagagatggtgaaaccccgtctctactaaaaatacaagaattagctgtgcgtgatggtgggcacctgtaatatcccagctacttgggaggctgaggcagggaattgcttgaacccgggaggcagaggttgcagtgagccaagattgtgccaccacactccagcctggacaacagagtgagactctgtctcaaaaaaaaaaaaaaaaaaagagaaagaaaacaaaaacaaggcactcttctataaataccaagaccctacctcaaaagaggacctttccaactgcatccactcacagcttggtttttatacctgaattataaaatgagtttaatatttatctcagtgacatgattttgttagtagacatggaattgtgatgttggatcgagttatccggaagacgaaagatgtcagagccctcagcctctggggcaggattttgctttatgggttcgatttccgggatggtgattttgagatctggcaaccccataggttcatggggagcttggagatttcataagaaggatgtgagtatagcatgccctggtccttcaagaaaccatgggccaggcgcggtggcttacgcctgtaatcccagcactttgggaggccaaggcgggtggatcacctgaggtcaggagtttgagaccagcctggccaacatggtgaaaccctggctctactaaaaatacaaaaattagccaggcatggtggtgcacacatgtatttccaggtactcgggaggctgaggcaggagaatcgcttgaacccaggaggcagagttgcagtgagccgagatcgagccactgcactccagcctggggacaagagcgagactttgtctcaaaaaagaaaaaagaaaagaaaaaccatgcccagttttggggatactgttattctaccagacaggctcattttccgggactgtgtcattgcattgaaatctgtggtgtttgttaaatttgtattaaaatgagtcccaggcgagtgagtagacataggtgagtcttcggcatctttccaacaaggagatgcctttatcaaatcctgtgacttgatatagatttactgagaagctttgcagtgttatattttggggttcacggattagaaactccttgtggaatcagatggctctgtctgttataggttggtgcaaaaataactgcggtttatgccattaaaagtaatagcaacatagcaagacctcgtgtctacaaaaaacgtaaaaaaaaaaaaattagctgagtgtggtggctcccagctaattttttacctttttttgtagagacagagtcttgctatgttgccattacttttaatggcaaaaaccacaattacttttgcaccagcctccgttcctcccttcctacagatttgagtttgtggtgcttgggcttctcctggtttttgtccatgtgatacgaaggggcctgttgaagctgcttctctcatgcactcggggtctgtgacttcgcatctgggtgtgttggcttcgcgggggacctggctcagaccactaaccacacggagcctgaccacttcccacagagcccagcttccgtggctggcaaggggtgttcaggatgctgtcctttggctgtggtggctggtcctactgctctgtttgccagggtcctgggctcacagtgggtttcttgaggctttggcaagatgggcgattggctctccctgtctccttctttctctttcttcttctctgcctttcttccttccctcctcctttctttccccctccctccttcttttctctcttccttccctgcttttctctttcttcctttgccctcagttctccctctctctctcttttcattctttcttgaactctccctctttcttcctccctccctcccttcttcttttcctccttttcctttttctctcttccttttctctatctcttcctttcttccttctcttttcttcttatgtacctctttcttttttctctcttctttccttccttcctttctttccatccctccctccttctttccttttcccctctccatcccttcctcctttccttccttcctttctttttttcctctctattctttgtctctcttcatccatctctcctgttcttacatgcctcttttcttccttccttctttcttctctccctccttcccttctttccttccttccttcccttcctccttccctctctccttcccttcctccctccctccctcatttccttcctccctgcttcacttcttcctccctcccttcctccatacctccctgcttccttttttccaacctccttccctcctcgttccttccctctttctgccttcctcccttccttcctcccatcccttcttcctgcttccctcctgctctccctgttccctgcctccctccctgccttcctctgtctctcccttcctccactccttaattttggtttccacttcccactctcacactttgagcctctatcccattacttccttgctcagagcagctctttctaacacctccctgctgctgggagccccagcgcacagcaaaagcagacccagcaccagtttactttttgtattattattttttatcgttttcaaccttccatttcagatggctgaagacctaggggtgagcagagaacccagcccaggcctgcggagcgtcctgaccgtaatcgttttatctgctaagacatagccttaaagcaaacccttccatctgccgctcccctcgccctgctggcaaattcccaccacgatgggattctcaatcacatggcggattctctgccttcagttccatatgcttttgcctttctggatgcacagaagctcattatagcaaatcatatttctgcataagagcttcagaaaatgaagagaaatgcagatattttcttttaaacatgaatctaacagaaacagggcagtgacttccatgttttaatgagttttgtccctaagtccatccctgccaagggaacaaactggggcccagggtggccaccctcttccctgcagtgtcctaggttaagctcactcacgtcctaaggatttgaccttccaggtcatgcatggatttttaaatcttcaacgtttttggccgttgacttgcatttctcactgcacttcctatgaagcagttcttaactctttctgtgatcagtgttccaaacaggtacacaccttggttcctagaaaaacaaaattcatacgttgaggaatcacctaaacatctcctgatcttcacactgtaaggcgtgttgggaattggtgggtggtcaggtccctattcacacatttgagcacggagcctctgcggccgtcttccttggattctctcatatccctgaaaaacacaaattgtacctggattttccttctgtttccaaagtccaccaacttgttcttcaatgtaattgattttaacttgttttctttcttttacttttcttatttttttctttcttttcatttttttcttatttcttttccttctatttattttacttttcttatttgttatatgttatttctttttcttttcttacttttcttcttttttcatttttcttttttaaattggagtctcactctgttgcccaggctggagtgcagtggtgcaatcttggctcactgcagcctccacctcctgggttcaagcgattctcctgcctcagcctcccgagtagctgggactacaggcacacaccaccacacccagctaatttttgtatttttagtagagacggggtttctccatgttggccaggctgatctcgaacttctgacttcaggtgatctgcctgcctcaaccttccaaagtgctgggattacaggtgtgagccactgtgcctggccctttttcttttttctttttttttttctcttatttcttttttcttatttgttttcctttttgctttttctttttatcttatttcttttacttatttttcttttttttacttttatttcttctccgtttttcctcattcttttcctcttatttctttgacttttctgatttctttttttttcttattttcctttttttttcatattccttttaattttttcttacttcttttacttttcttatttgccctcttgtggaaatgaggcacagcctcccttatggttgagccgtagttctagctgagcacggatggtttgatcctcctgtgttggggcactgtatggtgtgagggcacaaaaccttgacccacatgggtctggtcaccttctcacagaggtcacctttacagccccccaactctttgaaggatgtgtcccaaggtgtctcaagtctgatgcaatgaaagctgccccccattgaccacaggactgagtccagaatgtcctgcgtgtttcccagagtgtctgtcctaacaccgcttaaagattagccactgctagacagtgatcctcaggtatatggtctcaggattggccccaagcacacggtgtgtgtgtgtgtataaatatatcttcacaaagcataggtacccattaaagccatattgctttgctgaatggttctaatagctacagatgatttctagcctgaaagaaaagcaccacgaattgtttgaagttgacttgtcagatgtggcatgcttggtctaagttttgacaggaagggtatgtgggtaggggtgtacggagcatctcatgagaccagttctcctcctgagaggtccgtgatgttggaactgttgccccagatggactttgcccttgtgagactttatacttttcaatgcagtttttccctctttaaaactcgccagcttttatgtagtgttttataaaattacaggaataaaaagaatatcttttatgctttttaaccaatgaggggagagggagaaattatttgtcctctgaaatgaatgcaggttttcaatttctagccaggacagtttgctgcaaaatgcacccgtgttgacaacttgtgactggcagaacaaatgacatttgtggtgaacattttcggatcatttcgaatgttcttctcttcagggggttttcctctctttttcttaaatcaaagaatttggccctttatgtgggagtcatttagtggttagggagaacagttgaaactgtggagttcacgtagcgtaaactggcgaggctgtctctgctgctgtcattaaaagttacgctgctggcttggcacggtggttcacacctgtaatcccagcattttgggaggccgaggtgggcagatcacgaagtcaggagatcgagaccatcctggctaacatggtgaaaccccgtctctactaaaaatacaaaaaattagctgggcatggtggcgggcgcctgtagtcccagctactcgggaggctgaggcaagagaatggcgtgaaccctggaggcggaggttgcagtgagccgagatcgcgccactgcgttccagcctgggcgacagagcaagactctgtctcaaaaaaaaaaaaaaaagaaaagaaaaagaaaagttacgctgctgcaccatacaaacgtgttcctttatgaaggcatttgaaccacagatggggccgttttacaaatagcacggtctttgtgagggggaaacgcatggccacagattcgatgagcttctgctgcttccctttgtgttgaaaacgtgggtgttccttcacaccaacactggaaataaataaatacctattgatctgtgcatctcttacgcgtttccaattctgttggcttatgctgtgggtcagaaaagaagcgacaccgacaacatttggggacttgaccctgtttgcattgcggcatgtttgaaacattttttaatggaaatttgggaatagagggccgggcgtggtggctcaggcctgtaatcccagtactttgagaggccgaggtgggcggatcacaaggtcaggagatcaagaccatcctggctaacacggtggaaccccatctctactaaaaatacaaaaaattagccaggcgtggtggtgcatgcctgaaatcccagctactcaggaggctgaggcaggagaattgcttgaacccgggaggcggaggttgcagtgagctgatatcgcgccactgcactccagcctgggcgacagagcgagactctgtctcaaagaaataataataataataaataaataaataaataaataaatttgggaatggaaacaagactgggaaaaaatgctggaggaggaagaaaaccgggtacacaagacgccttggctgtcttgtcctttgatggctggggaagctcttagtgctcggagtcctcactcacctctctgcattctgagggaggtagaaggggggacaggagagccaattcaacctgagaaggatgattggtggaggtgggtaaaggaagaaagtcccctttccctaggtactgaaaagatgctaatctgctgagattctctgtatttatttttatttattttaatttttattttgagacagtcttgctctgtcacccacgctggagtgcagtgccacgatctcagctcactgcaacctccacctcttgggttcaaatgattctcctgtctcagcctcccaagtagcggggactacaggtgcacgccaccacgcccagctaatttttgtatttttaatagagacggggtttcaccatgttggccaggatgggctcgatctcttgacctcgtgatccgcccgcctggcctcccaaagtggtgggattacaggtgtgagccaccatgcccagcctctgcatttatttttatttatttatttttatttttattttgagacagtcttgccctgtcacccaggctggagtgcaatagtgtgatctcggctcactgcaacctccacctcctgggttcaaacgatcctcctgcctcagcctcccgagtagctgggagtataggtgcacgccaccacgcccagttaacttttgtattttttagtagagacggggtttcaccatgttggccaggctggtctcgaactcctgacctcaagtgatccacctgcctcagcctcccaaagtgctgggattacaggcgtgagtcaccacgcccagccgtctgcatttgtttgatgagtttgggggcagttataaataagaatcttattttcacagatgcacgtactttttttttttttatagaaagagcttccatgtgcgtgttcctcagtgtttagggagaagaaagcaacccttaaaatagaggaaaatgaagctgcttggattaccctgttgaagttcatctctgcctgtgccatgcatgaaaaaatactggcaaagtcttcacttacatgagtgttagactccatgttcccagtgggtctcggggttcagaactgagtgctctcatccaagcaataggagcgtcgacctcaggaaagcccaagtgttttgtgtgtattttgaggagtgggttatctgttgcactgagcctctctgtgtattttcttcttcttttcagcagaacaaggggaggtggacatggagagccaccggaatgccaacgcagagccagctggtaagaaggacggggaacgatggcttgcacacgtggccagtgttcccattttatcttctccatcctctcccatcttgctgtcctgctcacattctcaaatttggttgcatggctttgaatgtcttcctttatgtctcgttgctttggagggatactttcaaaagacaatgaatgtgtaaacttcctagggcctgggccttcagagaagacctatatgtgcctaagtctctgtttaacaaaatattaaggaagttttcccaggagttcgagaccagcctggccaacatggtgaaaccctgtctgtactaaaaatacaaaattagctgagtgtggtggtgggcgcctgtaatcccagctacttgggaggctgaggcaagagaactgcttgaacctgggaggtagaggttgcagtgagccgagatcgtgccattgcactccagcctgggcgacacagtgagacatgtttcaaaaaaaaaaaaagttccaagtggcacacgattggtgcatagttgggaagtccacagctggctggtgtgcactgggaattaaaagcccatctcctgaaatataactcgttaagttttgctgtcaactttttttttgttgttagagatagggtctcactctgtcgcccaggctggagtgcagtggcacgatcataacttactgcagcctcgatctcctgggctcaagggatcctcccacctcagcctcctgataagctggaaccacaggcgtgcaccaccgtgtccggctgatttgttgttgttttttttttattttgtagagacaaggtctcactaggttgcccagacagggtctcactatgttgcccatcctgagctcaagcaaccctccgacctcagcttcccagagtgctggggttctaggcgtgaactaccgcacccagcctgctatcaccttctaaaaatcctctcaaccaggtggaaaatgtggttaagaagagactttaattcgtgagaaacttctcagggtaaaaggcaggcattttgccatcagaaccacttttgaaaatggcaagaaaaaaatgtgtgtgtgtatatgtgcgtgtatttttttattttgtttgtgcatacattggaaccttctcatttgcctgagagatgcagtgcttatttttaatagcagctgtcaaattgagagggatttttaatgaaatgatttaaaatattttaattttttttctttttgagatggagtgtctctctgtcacccaggctggagtgcagtggtgcgacctctgctcactgcaacccctgcctcccagtgtcaagtgattctccttcctcagccttctgagtagctgagaccacaggcacccgccatcatgccccactaattttctttctgtttttactagagacggggctttcgccatgttggccagagtggtctcgaactcctgacctcaagtgatctgcccaccttggcctcccaaagtgctaggattacaggcatgagccaccgtgcctggcattccattttaaagatagagacttctacaaagttagtgtctcgccagacgcggtggctaatgcctgtagtcccagcactttgggaggctgaggtgggcggatcacctgaggttgggagttcgagaccagcctgaccaacatggagaaaccacgtctctactaaaaattaaaaaaaaaaaaaaaaaaaaaattagccaggcatcgtggcgcatgcctgtaattccagctactcagaaggctgaggcaggagaatcgcttgaacccgggaggcggaggttgtggtgagccaagattgcgccattgcactccagcctgggcaacaagagcaaaactctgtctcaaaaataataataataataataaaagaaagttagtgtcttgttgactgctctttcgagtcagggaaagatgtttagaacaagctatatcttaaagagaaaaggaagattccttctgcccactgcaatgaagttgtctggcttcattagccagtacattggtatatgtgtgtggagccctcgtgacttgaagggcgtggcattccagtgttttctgccaccattgttcttaattccttcttccaaatcccagcttctccctccaaaatagttttaagactgacatgcagaataaagtttccaaaacttaaatgaatggaccagaaaatctcagcccagcatcattgcaaatcaataaaaactgcacactctcatttagaagatttattcttccatttggtaagttataggcatttgttagtgtctctgtgacgtcgttagtggaaattgccttctgctgttttccttctgctttttctgcagcatccattttttttaatgaatggcatcattcaatgaaattgattgaattgattgagatttagggttttgctttctcgtgatgagttttgggcccatttttcttatgcagaaataaaaccactggctcctgaaagttgtaggaactgtgtccacgtgagtgctcagggacctgggaatgactttcttttgtctctgtctcccacagttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaagtacttttttttttttacttaaatattttgccgtgggtggatgttaaagaaggccgtggtaatttacaggatgggttccaagttctcttcttctggggctttaaggcagatttccagcctaaatgctagctctttatttccaaaatgtccttgttgggctcttttcctttcccgtgtcctgccacatcgggatgggtactcttctgcacccagatactcccagccagatactctcctccatccagatactctgtttccagatactctccctgcagctagttatccccttgagtccagatgctgcctgcttccagatactcctctgtatccagatactcctctaaatccaggtactccctacatccagatactgtacttcctaagatgtacaagatgtaccgcattttcccaacactgaagacttgaccacagcttaagtgggttggttaaatacattatggcccagattgcaatggatcttctgccttgttaaaaagaatgaatgagtcaagggtctttttgtttactgacactgcctagcatgtattgaagctcagtaaacacttgcagaataaatcacagaaaagcctctctccttaagaagttaagagattggctctgataccaacaactaccatactattccaaatactattatttcaaaaatttataaagtattttattctatgttctattagccattaagtaacttttttttttttttttttgagacagagtcttgctctgtcacccaggctggagtgcagtggggcaatcttggctcactgcaacctccgcctcctgggttcaagtgattctcctgcctcagcctcccaagtagctgggactacaggcgtgcaccaccacacccggctaatttttctatttttagtagagcctgggtttcaccatgttggccaggctggtctcaaactcctgacctcaagtgatctgcctgccaaggcctccaaaagtgctgggattacaggtgtgagccactgtgcctggcccagcccttaagtaactttttaatcatcattcccaaaatcataggactttctttacatagaagttccaaaataatgaaacaaaagacttgttttacccaggtatttaatgatccaacaagccgtataatttaaactctatttttcaagtaacccactttcaataaaatcatgtttatttttatgtccatgagaaattaaaatcagtcatctacaaagatggacatccaccctccacaaaaaaataagtcttgttgacacatttcttggaagtatagatttatttataagtaagccctaatttgacatatctaaaaaaatacctttttttttttttttttttttttttttttttactattcttctttttactcttctgcttcttgtttaatgagccatttctgtggatagtatgattacaatgagccatttgtgtggatggtatgattataatacttacaaaaatgtcagtgttattcatagaatgacaacagatttaatgcattttttcttttttttattctaaagttagtcaatgtgaagaatctgacctcaaagacaattcttgataattcattggggaggactagaaacaccaccctctaactttataacgtgtcattggtcactcagcaaagcggccaggcatgctggtttatccagctttcagcccttgaagattcaccagactaaggattaagtgaaaaagaatatctgccacctacttcactgaggcgtaaacagtccctatagatcaatgagaaaaggacccaacacccgtataaaaacaaagggcaattcacatgttttccagaaatggaacgcagatgattttatgaagatagcccatttgatgtcgtttttcaactaagagattggcaataatcagaaagtttgtagggctcttaggaaacagatctgagacatcatgtaagtcctgggcatttgcgaaacttctatggggaatggactgacagtgtccttaaacaattaaacatgcacatccgtggtcggccccctcaagggtggagaggatgaggcatttgtgatgtctcaatacatcctggagaatctagaaggtcacctccacacacctgcaccacaggtggcatcctataggtatttgctaaaggaagcaatgaaagggtaagataaataaccaagaggtgcccgccactgtgttcacccaattttacatactccaagttatcactagtgtcaaaatcagaagaaataactccaatgccagaaaaagccagctggctgtgcccttcaatatcctgagaatgatgggatgtgaaaaggtgtcgaatcctcaacagcagggagactgcttggatgactcccacccagaactgaaattgaaggcggagtttctgagcttagaaaggggaaagacccagcatttatgactgactccttcatccaacctctttccccaaatcagacgatttttgacatgggtatggtaacaccatacgtttgcatagagagattcatgggaagcctagctgctgtgacgtgcagcagtcagtttttaacaccatcatcagtggcgaaatgaaacattcccttgaaatcgcctttctctggatgactatttaaacagcttcacgttagcctgcctgtgcgactgaggacgtactgatgatatcctcattttccggtggaggaaagtttatgacgtcaatcccattccgaatatcaggactttaaatctctatgatgttagcacaaaatgcaagtggagccctctccaagctttcatagagccatgtattttggaagccttaatggggagacagttctcaatgtggaaaagttgtcatgtatcgcagagaagagaacagaccaccatgcccagctaatatttgtatttttagtagagacggggtttcaacatgttggccaggatggtctcgatctgttgacctcgtgatctgctcacctcgacctaccaaaatgctgggatttcaggcgtgagccaccgcgctgggcccaatacatctcttttcttagttgacttcttttgtatctcttcatagccttttcatatttttatattgatttgtatctttcattttttatatatttaaactacctacttatgttaattctgtgccatggtaacttccttaattcatgattcatatgggcatacatacagtcatggatacaacaggctttcgtatataaaattatgaaaaagtttattcttttaacattttgtggggatacaacaggttttcatatataaatcatgaaaaaatgcatctattcttctaacactttgtgaggatacaacaggttttcatatataaaattatgaaaaaaaattcttctaacacctttgtggggatacaaaaggttttcatatataaaatcatgaaaaaggccgagtgcggtggctcacgcctgtaatcccagcactttgggaggccgaggcggctggatcaagaggtcaggagatcgagaccatcctggccaacatggtgaaaccctgtctctactaaaaatacaaaaaattagctgggcgtggtggcacgcacttgtaatcccagctactcgggaggctgaggcaggagaattgcttgaacccgggaggtggaggttgcagtgagccaagatcgcgccactgcactccagcctggccacagagcaagagtccatctaaaaaaaaaaaaaaaaatcgtgaaaaaaagtatctattcttctaacacttttgtgagggttacaacaggttttcatctataaaataatgaaaaaatgtattcctttcttaagaacatttgtcaggaatgggtattaaattcaatcaagtgttttcttgggatgcatcatgctgactatggttttctactttgacctgttaatatggtgaattaaatataatgacatatcatcgatcatccttcaatccaatcttatttggtgttacactttagttttgttattttctttaggattattgtgtcaatattcaaaagtcaaattcatgtgtgttatatgtttgcatgtaatatatttcaatattgtgctttcttcatacatacattttggtagattttcttctttctcttgtggaaaatctgattggctaaagttttctgggcatgggctgtgtgtgtgtgtgtgtgtgtgtgttttagagggggcaaagggtttttgtttctttctgttggagagagatttatttatttagagatggagtctcactctgttgcccaggctggagtccagtggtgcaatcttggctcactgcaacctccacctcccaagttcaagcaattctcctgcctcagcctcccgagtagctgggattacaggcatatacaagcacgctcagctaatttttgtatttttagtagagatggggtttcaccatgttggccaggctggctcaaactcctgacttcaagtgatctgccttcctcggcctcccaaagtgctgggatgacaggcatgagtcactgtacccggctgggaaatgaatttttaaaaaaaaaactttatgtatttctacttcttcattggaaagtcattcgtatttacttaagttttcaaatatcacagtgcagattagaacaaagtagttgtttataattcttccgcatcctccaagtgtatggagaagctcgcattcttcttgttttgtgctgtcattattttagtttgttatcttcgtctactttagttttctcagataatgtttaaattatttggcaaatcatttctcaattttcaatgcattaatttcctccacctgcttttctggagtttcatgtgatacccactctccccacacaggatgacttctcgagttgaatgttcattccatttattttcattctttcttgcttaatgttgtaaacaggcgaggttctaacttttcatctgtgtactacaagctctcaagttctttcatggggagtttgtatcatggtcattttctagtatttagcattttcagcttttgtttcctgtcaactcaacattaaaagttttttaaaacgtccgggtgatattgttgctttgtttgctttcctggtttcattatccattttcaattttgctgctgtgaatttgcaccgtctccttggggagtgatttggctgtatattagtcagcgttctctagagggacataactaatggaatatatatatacacacaaaggggagtttattaaatattaactcacacgatcacaaggtcccacaataggccatctgcaggctgaggagcaaggagagccagtcccagtcccaaaactgaagaacttggagtccagtgtttgagggcaggaagcatccagcacgggacagagatgtaggctgggagggtaggccagtctctctttttgcatttttttgcctgctttatattctagccttgatggcagctgattagattatgcccacccagattaagggcggggggcctgcctttcccagcccactgactcacatggtaatctccttcggcaacaccctcacagacacacccaggatcaatactttgtgtcaatcaatccaatcaggttaacagtcagtatgaaccatcacaggcagtgtctacaagcaatgaaacatgcacacacctttctacctaattcctgcccattcctgaccaacgctcctaagaaaggaatagatttgatttttttcttgattttatatcttaaaaacctgttgtatccatgtctgtatgtgtgccagggtgaatcacaaagtcaggaagttagtgtgacgcagaataaggatatctttattcttttattttttattactttttattttgtttttgagacagagtcttactctgtcccccaggctggagtgcggtggcctgatctaagctcactacaacctccacctctccggttcaagtgattctcctgcctcagcctcccaagtagctgggattacaggcacatgccaccacacccggctaatttttgtatttgtagtagaaatgtggtttcaccatgttggccaggctggtctcaaactcctgacctcaggtgatccatccgcctcggcctcctaaagtgctgggatcgcaggtgtgagccatcatgcgtggcctagaatattcttatttccaattttacagcaacagaatgtcttctgtcttgtttctactttaaaaaaacagtttgctaaagctttctttgtagtgcagttgtgaattttcaggagcatcccatgaacattgaaaaggagatgcattcacgctttttaaggttatcgaggatgtgaaaattaaagtcggctttgtaaattctgccatgtctgtgagctcccagcatttgatcagctgaggcttcgagcggtgaagtagagtgcttttcccctaacgtgctctgatctggagcctgcgtgtattaccgctgggcacacggcctgccctgaccatactttagtgaagcagaggtgataaaactgggtttcccaggactcctgcaacacacagctttgatgtcggcaaactagaacccgggagccaaatctgcccacggtgtgtttttgtacagctttcgaggtaagaatttttttgtattattgtcgttatcgttgttttgagatggcgtcttactccgtcgcccaggctggagtccagtggcatgatctcggctcactgcaacctccgcccctgggttcaagcgattctcctgcctcagccacctgagcagctgggactacaggcatgcaccactacgcccggctactttttgtattttcagtagagacagggtttcaccatgttggccaggttggtctcgaactcctggcctcaagtgatctgcctgcctctggctctcaaagtcctgggattacagacatgagccacggtgcccagccaagaatggtttttacatgtctgaataattttcaaaactccaaagaacaataatattttgtgatgcatgaaaattatgtgacactcaagtttttatgttcataaagtccacttggcgcacagacattggttacatattgcagcagaatccatatggtttgcaaagataaatgcctttactatctgaccttctgcagaaaagcttgtctactcttgcctcaagaagcatgtaaaatacttacaacactggcacgttaggcatgctggaaatcgtagcaattattttgcaccttcactacatctgagaggatttcctgaacttaaccatttaacctaactcctcactaccttttgggaaacattttttttattaaggtgaaattcacaaatcatagaattaaccttttttttttttttgacccggagtctctgtcacccaggctggcgtgatctcatctcactgcaacctctgcttaccgggttcaggcaattctcgtgcctcagcctgccaagtagttgggattacaggcagtcaccaccacatctggctaatttttgtatttttagtagagatgggttgcatcatgttggccaggctggtcttgaactcctgaccttaggtgatccacccgcctcagcctcccaaagtgctgggatgacaggagaattcaccattttaaagtgaacaattcaggttgcttgctgctttcacagtgttttgtggccaccacttctacctagttccaagatattttcactgcccccaaaagaaatcccattagcagctgttttttatattggcttcctggggctgtcataaaaacatgcttcaaactaggtagggggcttaaaaaacagacagttaagctgtcacagttctggagcatagaggtctgaaatcaaggagcaaacagggtggattcctccctccgtccctccttccctccctccctccctccctccctccctccctccctccctcccttcctgccttccctccttccttcctttctctttcttcctttccttacctttcccctttccctccctccctccctcccttccttccttccttccctccttccttccttccttccttcctttcctcctcctccttcttctttctttctttcttcctttctttcttctttctctttcttctctctctctcgctctctctctctttctgagtctcactctgtttctgttgcccagtctgtagtgcggtggcacaatcttggctcactgcaacctctgcctcccgggttcaagcaattctcctgcctcagcttcccaagtagctgggattacaggcgcgcaccatcgtgcctagttaatttttgtatttttagtagaaacgggatttcaccatgttggccaggctggtctcgaactactaatctccagtgatccgctcacctcagccacccaaagtgctgggattacagacgtgagccaccgggcccagccagcagggctgatttcttctgatgctgtgaggtagaatggattccatgcccctcccattgcgtccagtggtttgctgccaatatcccttggcttgtaggtgcatcaccccaatctcccacttcatgttcccaaggccttctccctgtgtgcatgtcagtgtccagatttctctcttcttttaaaataccaatcatattgcagtatgacctcatcttaactaatgattaggttggtgcaaaagtaattgcagttttcaccttcaaaagtaatggcgaggagctgggcacgctacctcacgcctgtaatctcagcacttcgagaggccgaggtgggcggatcacaaggtcaggagttcgagaccagcctggccaacatggtgaaaccccgtctctactaaaaatgcaaaaattaaccaggtgtggtggtgcatgcctgtaattccagctactcaggaggctgaggcagaagaatcacttgagctcaggaggcagaagttgcagtgagctgacatcacgccactgcattccagcctgggtgacagagcaagcctgtgtctcaaaaaaaaaaaaaaaattaatggtgaaaactgcaattacttttgcaccaaagtaatacatctgcaaagatcttatctccaaagaaagtcacattctgaagtactgaagggttgggcttcaatatatgaagtttgcgggagaaaaaatgcaactcataatatatccattcccacgtctttccagcccctggcaaccggcaatgtgctttctgtctctgcagatttgcctgttctggacatttcagagaaatggaatcctacacaatgcgttcttctgtgtctgttttctctaactcagcatccagtttttgacgtccatccactttgtagcagatgtcacggtgtcagtcctctttagggtcaggggactttgaaggaaatatctttctaaatgcatcaactgcttcctggactctgccactcagagcttaggactgcacaagctaactgccttagagcatttcccccatatgcacacacacacacacatgaacacacatgcacacgcacacatgcacacgcacacacgcacacacacacagacagacacgtgcacacacacacacacctgtgtgcacaggaacttaatccatccaagtaacttacctttataaagatgttgcagtccaggcgcgatggctcacacctgtaatcccagcactttgggaagccgaggcaggtggatcacttgaggtcaagagttcaagaccagcctggccaatgcagtgaaaccctgtatctactaaaaatacagaaattagccgggtgtggtgtcgggtgcctgtaatcctagctactcgggtggctgaggcaggagaatcacttgaacctgagaggcggaggttgtagtgagttgagatcacaccactgcactccagcctgggcaacagagtgagactctgtctcaaaaaaaaaaaaggaagatatttcatagaagacaactcccaaacaccaggtcaacaacatgaacagacttaacactccagatgctcaaatttgcagagagaaaagtccaaggtttatttctccttttgggtctgtttgccatgaatcctgcttctctgggaatttagaagctgccctcataactaagactgattttcccctttctcctgcagttaatctatttaccagaggacttcaaagctgtttgcaaatggtaactttttaagtgcttgcctactgcttcatggtaggtagagtgtaagggttaacccacgagttgtatatggataaattagacacactcacagatctgcagggaagaatataattaaaaccattgtgaaagcaggagtcatcatcgaactcagctatccagtcatgtttcttctccaaggagatttcaaacagaagatgtaaattttggtagttacataaaatgtctcagatttaaatgaaagacacaaaaagccacatatctccttttcctgaacaaccgtctctgctgaaatattagttctgccacctacaaagacaactgaaggctgaggataaaaaatgcctcttggaagtcactgagtttgttaggtataaaagccaagacttcaactgaggtctttgcactgatgtgtacattaaccccacactgggtatcactgtacaatcatgtcctgcaggaggaagattacaggcggccagtgtcttctctggtttctgggttggtgactttgaacttgctacagctcccacacccgcagcgagcagagttgccaagcaagtgtgccggcttccagaagcctgagatgcccattggtgcttgggaaccaccccagtttccccatcgtctgtgctgctgcagattggttggggcagcccggggaggctggctccgacacacgactgagtgtgcctacactggtcccacaggttttcagctgtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtaagaggcattttgctttgagggagatctgcctgggcatggatttttctattcttgctttaagaaactctttccaaaggagttgctatgaagtgaatggggataatttgcccaatgggattagaaaggagactaagagcgatgggtggctgagaggggagggagaagacgggctgctcccatttggaatctgggaattagatccagaagggcaggatgttagctgataccatctagatattcgccatattttcctgttttgatccatgtgtcccaagcgtttaaaaaatgacctatttaactccatgattcaagcatgactgggtgtgtgtggaatgtcagtcatttctttctgattttaaaaattagttctgaccatttccatacagtaaaagtagagttgaaactacttcatcccgtggggcagattaccagagattcgtttgccggaagggttgcatttattcagatttttaaatcttttcctaaacactgtcattcattcttgcaaattaaaaccacctgaattgttcacatcaaaaacttcgatataaacttgcaggctggctgtcccagatccaagattagatttttcagttccgtacgaggacctctttaagaaactccaatgaactcataaagtacaggatttgaacaacggttgagtaagtttctttggtcattttcatgtggcgatttcagagaagggaacacctgggcgcatcttaagagagagaagtatttctgttaggagttaaaacacatcattcagatgtccctgtggcagcatttcctgtttatcctatttaaagacatggacgtcattaagattggagttggttgtttatgggcggaggcggtgtcgggatggatagatcctggtggacatagtctaggatctgcagtgagaattttttattattctgtgctgtcttcagatctcacctagtaagtggacaatgtggccatgcattcattagcttctgtttacagggagatgttcaacagtaaacccacctccccagaaaagtacttccaggagtttgtatcattcacagtaagagccaaaggttaaccatatccccttgggcaaatcaacttctacaaagtgcggatacagacagttcccaacttaccatggtttgacatgatggttcaatttaagatttttcaactttacaacggtgtaaaattggtatgcattcagtacaaacgaaaactgtactttgagtacccatacaacttttcttttttttttttgagatgtcgtgtcgtttcattctgttgcccaggctggagtgcagtgacacaatctgagctcactgcaacctccacctcctacgttcaagcaattctcctgcctcagcatctcaagtagctgggattataggtgcccaccaccacacccagctaatttttctatttttagtagagactgggtttcaccatgttggccaggctggtcttgaatcttgacctctggtgatccaccggcctcccaaagtgctgggattataaatgtgagccaccatgcccggccccatacagccattctgtttttcactttcagtacaatgttcaataaattatgtgaggtatgcaacacctcattataaagttgactgtgtgctagatgatttgtccatccgttggctgatgaaaagtgttctgagcactctgaaggcaggtaaggctaagctatggcgtttggtagggtagttgtattaaatgcacttacaacataaaatattttcttttttttaatgtgttttaatttttttgagggaggggcccactgtgtcacctagactggagtgcggtggttccatcatagctcactgcagtcttcaccccaggggttcgaacaaacctcccacctcagcctccagagtagctgggactacaggcatttgccgctgtgcctgactagtttttaaaactttttgtagagacgggatctcactatgttgtccaggctggacttgaacatctcagctcaaacgatcctcctgccttggcctccccaaatcttgagattacaggcatcagccaccataccctgtcctgcgctaaattctttgactgacggcagcacttcctatgcactaggcatggattaacttagttgattgtccctcagccctatgacgggagtgtcgtgcctgatgtcattttacagatggtgtattagtcagggttctctagagggacagaactaatgcaatagaaatatatatagagagaggagtttattaagtattaactcatatgatcacaaggtcccacaacaggccgtctgcaggctgaggagcaaggagagccagtccaggttccaaaactgaagaacttggagtctgatgttccagcatccaccatgggagaaagatgtaggccagaagactaggccagtgtctcttttcacatttttctgcctgcttatattctagccacagcggcagctgattagatggtgcccacccaaattgagggtgggtccgccccttccagtccactgactcaaatgttaatctcctttggcaacaccctcacagacacacccaggatcaatactttgtatccttcaatccaatcaagttgacattcagtattaaccgtcacagatatgggtaaactgaggcactgaggatttggacgggggcagccggcagcggaatctgagctgtcctgtagctctgtctgggaagactccagtgagcatcccgctctatcccaagccttgtcttctgaaaatcagaatcatccctcctccaagtgttacaggaaaggggtccggatccagacgccaagacggggttcttggatctcgctccataaagaattcagggctagtctgtaaactgaaaacaagtttattaggaaagtaaaggaataaaagaatggctattccgcagagcagctcttagagctactgcttgcccatttttatggttatttcttagtgatatgctaagcaaggcttggattattcatgcctcccctttttagaccatgcagagttcctgacattgccgtggtatttgtaattgtcatggtgctggtgggagggtaacactgaggacaaccagaggccactctcatcaccatctgggttttggtgggttctggccggcttctttactaccacctgttttatcagctaggtctttatgacctgtatcttgtgcagaccttcagtctcatcctgtgactcagaatgccttaatcatctgggaatgcagcccagtaggtttcagccttctattgcccagcccctattcaagatggagtcgctctggttccagtgcctctgacacaagtagcgccccttagggaggttacaggagggactggaaggaaagtgaggtctggatcagggcccttctgtgtaaataagatgatgtacatgcagcagctgggtatgtcctgggtaaaaattagttaaatgcacagacgaccctgtttcatccccagccatcaccagctggaaatggggcacattcccaagatcccaaaaacattctgcaaggctggtgcgatgattgctatgaagtacttaagaaaacagattattgttcaggatcaatagctaatgcatgtggggcttaatgcctctgtgacgggttgatgggtgcagcaaaccaccatggcacatgtttacctatgtaacaaacctgcacgtcctgcacacgtatcccggaacttaaaataaaataaagaagacagaatattgttaatggttaatatgctgtaaatcattatgatgattactaaattatcaatacaaaagaagataatagcaagacggccatattcctaatagaggttgacattttagcagccctacatttccactgtatttaattagtatttgccgtccaatccagaggggcatgaaggagcacgagacaaaatcaggtcttctaacagctgagaagaagctgagaaccagaagtggaaaccccaaagggcagtgtatgaaatgtcatttattgaggggaaaaaaaagaaaatgacagagttcgatagaagaaataagcactagtgtttacataatcagtagggtgactttagtttacaataatctattgtagacttcaaaatagaagagtcggaatggttctaatatgaaggaaagacaaatatttaaggtggatggatatcccaagtaggctgatttgatctttacaaattatataaatgtattaaattattacatgtaccctgaagctatgtacatctgttatgcatcaattaaaaataaattaaaagaaaaggatatatgtccaggatatacaccagctaagacagtctcttccaagtctattgtacattattcccttatcagatttgaaacctgagagttccctgacgccccctcacaggatgtgcaacaggggtgtgtttgatctgtttgaccgccacacactgaaacctcttatgggaggcagaacttgcagacgggcaggtgcagcagctagtgtgagtgtttttgagctctgggccccacggtagcatctagggatgggtgcctgcgacccccgaagccctagtgggcgttttacggtgctcttttagctctgccatccgcacgtggcttaagtgttagccagctcagtgccgtcttggtacccgggttcttgtccagcatccaggaagaatcaggtcacacgaaccagctgaaggatggtaaatgcagaagagtttgttgccagatggagatgactcttagcgggatggttggggagttggaaaggggatggagtgggcagatgatcttcccctggagtttggttgtcctgcggctaatctcttctccaaccatccccagctgaacacctctcagtgttcagatgttccttctcttctctccttctctgctgtgctgctctttggttcctcaccttttctgctcatctgtctgtctgcacatggggtctggggtttggggttatatgggtacaggacaggcaggcatggtgggtcaaaaggcaacatttgggcacaaaaataggaatgcctgtttccatttaggactacaggtttccaggcttgagggcggggcctttgctggggaactgccctcttgtatctagtatcttcaggcctcctgtccgtatcaacatgacttaaaatgtgtgtgcatttgtatagagctgtgtttctatgtaaagactaaaaaagacttatgaaaaagatcactcagagctctgaacagtagcaaatcatatttctgagtacttcctgttgagtaaaggtaagtgaggattgtgccaagtatttttcattacttgctgcattaggttgtcacaggctgtttagtttacttctaaaaattgggatatggggaagttgtgggccgggcacagtggctcatgtttgtaatcccagcagtttgggaggccgagttgggcagatcacttgaggtcaggagtttgagaccagcctggccaacatggcagaacgctgtttctactaaaaatacaaaaattagccaggcatggtggggggtgtctgtaatcccagctattcaggaggctgagacaggagaatcgcttgaacccaggaggcggaggttgcaatcagctgagatcataccactgcactccagcctgggtgacagagtaagactccatctcaaaaaaaaaaaaaaaaaaaaaaaaaggaaaaaaaagttatgatgatcgcctaaggtgagaagccataccacgccagcgtacagaaccccaaaccacgccagcctcatcctacgtctcagttatatttttcttgacttgcttccattctggtgccccctctctccctgccccctccttccctgcaaaggatctagcaaatttgtaggtgtggaaagggaaccacaaatgggtcatttccctgccattgtcacctggagcgtgtagccatttcgtgcagtgattctctgtctttgatgtgcaggtcatcaccttgaagggaggaggtattaaaagcgccacccagtccccacccactgaggtctttattcagcaggtgtgggtcaggcatttgggagctgggagacctgcattttaagaagcaccccaggtgatgcccaagcggagctatgtgcttcttttaagagatgatgactccgtgtgcaaccgtgtggttacctttgcgtggagtctcatggatcactgccacagtggggaggcagctctgtgctctccaattcggtgatgtgtcattcactctatgcaggcccaaggtgacacccccagatacaggtgctgccatccagccattctcaaccagggatcatgtttatccacagggacacttgtcgatatcttgaggctttgcgttgccacactgatagcagggatgctgctggcatctagtgggtggagcccagggatgctggtcaacaccctgcagtgcacaggacgccccacagaaaagaatgatccaacctcatatgtcagtaggactgaggctgaggaatcttgccttagcatgagagatcctgtctgtctgtctgcctatctctagatctatctatcgtctaccattatccatccacctatctgtctctattatatacacctatcatctacctaatctatctgtcaatgattttctgtcatctattatctatctatttatctatctttctacctacttctctatccaactctcatctctattacctatctatgtatctatgtatctatctatgtatctatctatccatccgtctatcaatctatctatttatctagcagtccatcatctatctgtgacattcttctgctacccagggataattgtgttcctcgagtaacacttggcaatgtctggaaacaattttggtagttgcactgggatgggtgttctcgcattcggtgggtggagacaaggcatgttgttcaacaccttacagtgcacaggacagcacccatgacagagagttacgcagccccaagtgtcattagtgctgtagtggagaacctgctgttagttataacttctaaccctgcgaaaggggacaggttggaaatgtcatgctcctgtacgctgtaggaggtatagttgtctggaggtatagttgtctggaggtatagttgtcctgtacagtataggaggtacggtatagttgtctgggcatttctaaatggatcttactgtcagaatgcacttgtaggatcttttccccatagggcatagagccatggcacatataacccagaagctgagcattccatagtttccttcttggagtaggaaggggctgtgcagaaaaagtctatggctgtttggcacctgagtgtgaagacatctggcaaatattggagccaattagcagacaagcacggagtccaagaaatgtctcccctttcttggataacaactgacccttcctgtgagggcccccctcattccagccattttcctctttctcattggcacacagggggtagaaaagtggggttctgcctgcaggtggggctctgccagacacggcaaagctcctggggattcccccgatggatcaggggccagaggcacctaaacctgtgagcgatgtgtgcagccacggtgctgaggctgggaaactctgctgtagtctgtgaatcccaacctctgggaatgcttcagaatcagattctgggctgatctggaatctgcatgtggctggattctggtctgatccaggcatggaggcgtgtgcctgtaatcccagctactcgggaggctgaggtgagagaactgcttgaacctgggaggcagaggttgcagtgagctgagattgtgccattgcactgcagtgagctgagattgcaccactgcactccagcctgggcaacagagcgagactctgtctcagaaaaaaaaaattaaggaagagtattattgagagcgtaggccaggcgcgtgatgttgctgagatgaaactgtctctctagattcccaaaccctggttatctccactgaaccaggctgtccaatggcatccccattgtaattgaccatgttccatggtttaaatctgttgtgagccaaattgtaccctcctcaattttacaaatggaagtcctaacctgcaggacctccaattgtgactgtgtttggagatggggtctttaaagaggtgattcaggctgggtgcggtggctcatgcctgtaatcccagcactttgggaggctgaggctggcagatcatgaggtcaggagatggagatcatcctggctaacacggtgaaaccccatctctactaaaaatacaaaaaaaaaaaaaaaattagctgggcgtgcctgtagtcccagctacttgggaggctgaggcaggagaatcgcttgaacctgggaggtggaggttgcagtgagccgagatcgcactactgcactccagcctgggcgacagagcgaggctctgtctcaaaaaaaaaaaaaaaaaaaaaagaggtgattcaggcaaaatgaggtcactaggttgggccctgatccaacaggactgcagaccttataaaaagacgagatgaagacacagacatgcacacagggacgatcctgtgaggacttagggaaaagatggcatccacaagccaaggagagaggtctcagtaggaaccagccctgcccacaccttgatctcagacttccagcttccaggcctgtgggagaatcaatgtccactgtttaaacagcctggtctgtgggactttgctatggcagcagccacagtggacaaacacatttgtattccaatgaatgagttacctctgtaagggttgaattgtgcgtctccaaaatttatatattgaaggcctaatccctaggacctcagaacatgactgtgtttggtgatggggtctttaaagaggtgagaagggtacaatgagctcaggaggttgtgccctgatccaataggactggggtccttataaaaagagtagataaggacacagacacacacagagggatgaccctgtaaagacacagggagaagagggtgtctacaagtcaagaagagaggcctcaggaggaaccagctctgcccatgccttgatctcagaattccagcctccaggactgtgggagaataaaagtctgtggtttgtaagccacccagcctatggtattctgtgatagcagcctgcaatggactaagacatctcataagaagagcagatgaggacacagacatgcacatagagggatgaccacgtggggacacagggagaagatggtgtctacaagcccaggacagaggcctcaggaggaaacagccttgcccatatcctgatctcaagacgtccagcctccagggctgtgggagaatcaatgtctgttgcttataagccacccagtctatggtatgctgtgacagcagcctgaaatggactaagacacctcataagaagaggagatgaggacacagacgcacacagagggatgaccacgtggggactcagggagaagacggcatctacaagcccaggagagaggactcaggaggaaccggccctgcccacaccttgatctcagacttccagcttccaggactgtgggagaatcaaggttgttgtttaagctgcccagtctttgggattgcattgtaacaactctgggaagccattaccaagtctctgtcctgcaaagtgagatccatggatctgcagccttgacatcccctgggagctgatgagaaacactgtgtcttgggcccagacagacctgctgaagcatagtctgtgtgtcacccatgtcctgagggatccgtgtgcatgccactctgggaagacgggtttataacacaccgtcaaccagtgcctcattgcatggtctgcggtattttcctcgagttttccttgcaccaaagatgtcttgctttttgtgatgaatgatcattccttcctcttcgacgacaaaatacttcgatctctgcagacaccgtctgttgtgttacagacagacactgaggcctgaattctcattaccaatgtctgctctaatagagcttcaatctgcaactgcataatatggtcactgggaagtcaagaacggggccagttggttgaccttctggggagaggctgggctgcttggatgctgagaccgtggagggttcatgggttccgaggagcagatcatgcaccagggcggcctgctcagctctggtgtctgcagccccggtgagcttgagcattagggagtccctggatattcatgttgaggtgtggaggaggagactccagctgtgtttgatttcctgtcctgctggaaatataaacttcttaaccaattagagaacagaatggatttcatcttatccatggggctaaagtagaattcagcccttggcaaacaagccccccgggaataagattccccattggggcagcagccttccttgtcactttctgttgcaacctacggtcctaacctagtcatatgatttaattttttttactctgtgaatcatgccgtcctgggagagagtgagatggagcaaggacaaccctcttaggggcctgccaggcactctccctagcatggaaataaaggaaaaccttgagttccttcaagggaaattccaggcacctcgctggccttgagaagtacatggagcagcttgataagcaagaaggtgattgtagtgtagaacaatagccaaggaagttagagcctcaatatgtttagtttcctgtaaagactaaagataacatccttttttgagatggagtcttgctctgtcacccaggttgcagtgtagtggtgcaatcttggctcagtgcaacctccagcacctcctgggttcaagtgattctcatgcatcagcctcccaagtagctgggactacaggtgcacaccaccacgcccacatttttgtatttttagtagacacagggcttccccatgttggccagtctggtctggaactcctgacctcaggtaatctgcctgccctggcctcccaaagtgctgggattgcgggtgtgagccaccatgcccagccaagataacatcttactatatggccctgagttgattttcaggaacccagacccccaccaaataaaaaatgccatctgctggctcatagacgttgggtaagagaaactgaggcctgaattctcattacaaatgtttgttctaaattccttccctggggcatgtggcggtgggaggggggtggaaggggggtgaggggacgtgctggaggaagtcacaccaatggccacaactaacattgatttctgctgaccccaaatgctcagacaaacttggcctccttaaccaatgacaaatcagagaaactttgaatccacattaagcccctgcttccaggtatcccgcctttttagatcaaagcaatgtatagcctgcatgtattatggctttgcctgtaacctctgcctccttgccattgaaaaccctcagctactggccacccaggaggttgggtcttgaggcatcaaggaggttgcttgatgccctctaaatagctcggaataaacgcctcacttcctcacgctgcaatcccaatggcggtgttcggctttactgcacagggccggtggacctaagttgagttagtgggaggtgttcgaaccagggcaactccaggttgagtaggggctgtgtaaaatgaggccgagagctgccgggctgcattcccggatggtcaaggcattctaaggcacaggatgagataggaggttgacacaagaaacaagtcataaagaccttgctgatgaaacagcttgccgtaaagaagtcggccaaattttaccaaatccaagatggcgatgagagtgacctcgggtggtcctcacttgtgtcttcccaccagcaccatgacagtttacaaatgccacggcaatgtcaggaagttaccctatatggtctaaaaagaggaggcatgaatgggccactccttgtttagcatatcctcaagaaagaaccatacaaatgggcaaccagtggccctcggggctgctccgtctatggaggagccattctttattcctctgcttttctaataaacttgctttcattttatggactcgccgcaaattctttcttgtgcaaggtccaagaaccctgtcctggggtctgattccagacctctttccggtcacaagttcagtcacaagaaccattatcatatgctttctatatatacacataggtattttttaattgctgaactggagtcaaagagaaaccttaggatttgcctgaaggaagtcaagatttgtccttctcggggtccctgtgccagctttgtaaaacctcggaactttcccctctgtgggcttcctcaagctgaggagggctctatgggcttagtacccactaagtggcttcatctgcagcagctgacccaagaaagttgatttaaatgaacccacacttcagaggaaaccagtacaatccgatgtaaagaaataaaaaataggccgggggcggtggctcatgcctgtaattacagcactttgggaggccgaggcgggtgaatcacttcatgccaggagttcaagaccatcctggccaacatggtgaaaccccgtcattactaaaaacacaaaaattacctgggcgtagtggcatgcacctgtagtcccagctactcaggagactgaggcactagaagcgctcgaaccagggaggcaggggttgtagtgagccgagagtgcgccattgcactgcagcctgggcaacatagtgagattctttatccaaaaaaaaaaaaaaaaaaaaaaaaggctaggcacggcggctcatgcctgtaatctccgcactttgggaggccaaggtgggtggatcacgaggtcaggagtttgagaccagcctggccaacatggtgaaaccccatctctactaaaaataaaaaaaattagttgggcatagtagggggcgcctgtaatcccagctactcaggaggctgaggcaggcgggagaatcaattgaacctggggggcagaggttgcagtgaacagagattgcgccattgcactgcagcctgggcaacatagtgaggttctgtatgagagaaagagagaaagagggagggagggaaggaaggaaggaaggaaggaaggaaggaaggaaggaaacaattgcttgaaagggctttgtttcaccagggcacgcagatcaaaggacattggattgaataatgaaacagaagagcctgtctgaatttactaatgtggttgcacgtcccgtaatgattgcagttggctctaattcagttccgtggtgtataaattctgctggcaatagctgtaattggggtcagggatttagatagtctctgtgtgttccttttcattttctgctcagagcctgctgggagctgattttcttctttaaagcgaggtaaataattcagtggggagcagaggttttgctgtgggtccattgctctcctgtgctgcgtggcagctgtgctggtggcagctaatattcagtgggcagtggcctcgacattgcattattattcgagcaatggtactgttctttgctttgcaaaattgctgtttgttatattgactttctggggtcgtggcccctgaagcattactgaaaatcatggacatgaagcagatttattaactggagaaaagacatacaaatgtatttaatgtgtatacacgggagcattcagaatgaagaccccaagttacaaggggagattgtctatatttatgctttggttcatccaagtctggacagctgtgtagaaatagggttggacaaaaagggcctgatccaatgctaatggcctgagtggggaaacccagccaggcctgtgtgtctagattcttcttggcctctctctctctctttttttttgagacggagtctcactctgttgccaggctggagtgcagtggcacagtcttggctcactgcaatctccacctcccaggttcaagcaattctcctgcctcagcctcctgagtagctgggattacaggcacgcaccaccacgctcagctaagttttgtatttttagtagagacggggtttcaccatgttggccaggatggtctcgatctcttgaccttgtgatctgccctcctcggcctcccaaagtgctgggattacaggcgtgagccaccgcacccggcctcttcttggcctctctgaacagtgctccttccttccgggtatggggctgggagcttctctgggatggggggtcttaggacgcccaaacaaggcaggtcagggaatttccttatggccacttttttttttttttttttttttttcaagacagattcttgctctgtcacccaggctggagtgtactggtgtgaactcggctcactgcaagctccgcctcccgggttcacgccattctcctgcctcagcctcccgagtagctgggactacaggcgcccgccaccacacccggctaatttttttgtatttttactagagacggggtttcaccgtgttagccaggatggtctcgatctcctgacctcgtgatccgcctgcctcggcctcccaaagtgctgggattacaggtgtgagccaccgcgcccagcctgtgccactctttatacagataggatagagggaaagttagattcctgtttttaggttttatggctggcttcggggggaaaggcgttcttgtttctgggacccgtcttggggaagagggattctagttccttcggtgccttaggggagaatgggactcagagacatgggggctggagaagttccgagagaaacttctgcttctgaggctgctgctgaggcctgcacttggcggtattgtttcgtaagcctgaaccacgtgcaggtctgaatcaacataaagaatttgggtgggaggcaggggaactccaataagaagcatctttgaatccggcaggggtggaatttgggtcccagaggggtttggtgactgcaggctacagaagaatgcttcaaagtgctgtatcacatggctttgctccgaagggtcccgagcacagctttaccgggggctcatgtgtaacgctcggcccacccatccaccaacaggagccacttaatcgacatctccaggatgccagcaaccgaggaccgttgtcatagtcccagcacaaaatgaggctgctttcttcttgggggtttagggatcccagaccacaaggatttgattaaaagccgctcagttcactaactataagcaaagcaaatcagaaatagatctcctgttcctgccccgtcttatgttcccagtggaaaataaaccccgtgaaagcaatggcgtcatgtgcaacccgaccttggagacagagaccccagagttagcgttgtctacctgggacatctcccagcccaggggtcttactccagacccgtgaggaccccaggcgtggctttgctgcaacttccctggagaggagagaggacagggggccctgcctgggagatagatttgctgcctggcatgcgggactggagactgtctcagtgcccaggccgtctgatgctggccggagtccgcctggtttatgtaacgaggtctggatgtgaccaacaacggcctcgtgtgtgtgagtcacgcgtgcagcaacttctggctgtagtgcaacccctgaaaccaagcaaagcctaaagcccccaggctccacttcctctgtgaccctccccacccccaattcctgtcatctctcagggtcatccggagcatctcaaagctgaaggagcctccgctgcaacctggcctcctgctgcaggatgagacgagctgtctgcagccctcccgtgccacctgcctgttttatgcaacagcatttcagagaggagggactgggaggggagagacaacaccgaggcctttggttatttagggcaacagcagggagtggccgggtgcacagattggaggagattaagtggttgctgaggggatgcctgggattgctgggatgggcggagacataacacagtgaaagatattggtcaacggcgaacacagattggaatgtaaattctcagggtgtgtgcatagccgggacgcttaactttggcgtcctggacaggtgtctcgactggaactgctggcagccttggaggggagatgttgcacagatccaagaggctgacacggttcctgtcccccagcccagtctgagcagcttggaccatgatgatcaagagcgctggaggaggccaggtgcggtggctcacgcctgtaatcccagcactttgggaggccaaggcaggtgggtcacttgaggtcaggagttcgagaccagcctggccaacatggtgaaaccctgtctctactgaaaatacaaaagttagctgggcgtgatggcatgcacctgtaatcccagttactcagacggctgaggcacaagaatcgtttgaacccaggaggtgggagttgcagtgggctgagattgtgccactgcactccagcctaggcgacagagagagacgccatctaaaaacaaaacaaacaaaaagaaaacaacaataaagaaaaaataagaagagagctggatggagcaaagatttgctgggttgttcttaaaggcgagcctgtagtgatcgctggtaacagagaacgtcatctgagagggacgtgggggctcccagagtttgagagaaacggccgtgtgggatttgacctgtgatggcaccgccagctcccagcctccagtctgggcccaggggcagctgctgtgtgcaccctgggctcagagttccccttccctccaaggtttgtgactttgtcctgacttagggattcctgtctggggatgcgtcttctgctccggagaggccctaattgcctccacaaggagcggcaaagcctgcccgggtggcatctgactggagccatgccacagcctatacgaatctatgttggagcccttgaaccttcccccagagcaagcgtcaccgaggcagaccgatttttgggagggagacagacatcagagcgggggagacccagtacctagggctcacctggttcccccaggcttagcctcctccagggcttagtgtttgagtgagagattgtcccccctggacaattctgtagattctgactctgctcctgccttgccctgaacttcccagaacctcagtttcttcctttgggaaatatgcatgctggtcataccaacatccttgggtgggcagatgagactcttgggtgcctggcattactgcaacagaactcaatgcatagtaagtgctgactcaatgtgctcctggctgcatcctctacttcctgataaattctctggtggtgttttctctacaaggctagtactggcaggggcaagtgaggaacaagatcaaggtgtgcatatatgtcagcaagagggacccttcaccctcacaaattctgcagtgtgtttttaatgatgtgtcccaaagatgtgaatgttctcttctctctgctgcagacacattcattagattaactgcttttggatcaggtaggaacctcagcttgtccacacaggttgcttcctgaccctgtatttgtcagtgtaggctagctgctataacaaacagcccccaaagaattaaaagtttatctcttgtttgtgttgcagccaggtgaggtggcaaaggtgtcctatgctccatatagtctctcaggcatccaggaccctcacattgttgtgcttcaccttcttctagggcagcccctctcaacctagactctgtgcgtgtgtggaggggtggggggggcgttggggggcggggatatgcctgtcctaagctgtgagtgggacagtccaggagagaagtctatgtgcttggagagaggcttccttcaaagtttcctggccatgagcaggaatgaagctctgacacaggttgcaacgtgaacgcaactcaagagcatcatgctcaatgaaagaagccaggcacaaaataccacatattgtagaattctatttataagaaatttgcagaacagacaattcatggagacagaaagtggatagtggttgtcaggggctggggaggcgggaggggaactaactgctgaatggggacaggggtcttcttttgggtgatgagtatgctctgggactaggtggaggtggtggttgcatctcccatgtagctcatggtcaggttagttttagtgctctgggcgaccctaggcttgcaggaggaggggagcagcatgaggtgaggaacaagggggattctggcctttccatcatggggtgacttatgccctgtttgctcccaataggtcaaagagactttgatttggcagatgcccttgatgaccctggtaagtgccgatatttcaaggggagccttcccttttcagcttggatctaacagcatcagctgtatagttactttggggttggattgggccagtgttgggaatttcttggtcttgagatctctgttctttgcaggagattgcagacaccttgagacaaacctttacacactctctaaaagtctcagactcatttcttggtaggtctgtgcttctaaacctgtggtttaggaatatgctagtattttattattttattttactttattttgttgagatgggagtctcgttctgatgcccagactggagtgcagtggtgcaatcatagcttaccacatagcctcgacttcctggctcaagtgatcctcccacctcagcctcccaagtagctggaacaacaggtgtgtgcccccatgccaagctaatttttttcttttttcttttttgtagaaacggattctcactatgttgcccaggctggtcttgaacccctgggctcaagaaatccttctaccttggtttctcaaaacactgggattacagacgtgcctcaacatgcctggcccagtttctgcttttcttacacttcagttcatatccctcattgtcccacaccccgatcccaatccatggcctccaatctccccagtttctgcttttcttacacttcagttcatatccctcattgtcccataccccgatcccaatccatggcctccaatctcccctcccagagcacacttcattccgttctcccctcaacttctctggttaccttcactgacggggctgtgagtttttcttctccagggcactgaggacctggaatcttcccattctgtgttttcatcagtccaagttcagctagaacctttctggctgaccagaatgctgaaaatatgtgtcctgggccctgcagaaagtcctgcttgaggcagatagtctgattgagattcaggtgtattcagaccgcggtgggtgggagaaagggaaagatttggtttctgatgcaggcacaatggaaccaaacatttattttgaaagaaaaataaacttttgtgtacacagaggaagaatccattgggctttagcattgggaacaactggttgaccagtgcagttacataatggtgtttgttggaggaagagagaatgataaccagatctgatcctaaaaagccaacaacaagatgataggaactcatctctctcccagttttctgcacacagtgatgtttttgctaataattatcctaaaaggcagatacaaaattgttgtcagtgcaacaggaaaatgtaatgactcaccccaacatggagatgccatttctcccatgaagttagaaaaggtgaaggttgaatcctaccctgtcaaggcagattgaggggtgggggttagaggcaggtgtgtggttgcaaccactttggaagcattgggggattatctccaaaattcagactgagtgtgttgcaccagcgtttggtctggataaagaatgaggcatatctgcaagagaaccctgtgcaatagtgaaggaggggctggctggtaggctcagatacagaacaagacatgttattgatctgaaagatcactgacatgtgacccaggagttccacttctagacagatacccaagagaattgggagcagggactcaaacagttatttgtgtacccatgtttgcagcagcaatattcacaataagccaaaggtggaaacaacccaactgtccatcaggggatgaatgaatgaacagaatgtggtccctccaggcaacagaatatgatttggctgtaaaaaggaagggggttctgatgcgtgctacatgagccttgaaactgtgctcagtgaaacaagccaggcacaaaaggccacagggtgtaggatcccattaatatgaaatgtccagaataggcaaattcagagagacagaaagtggattagcgattgttgggctggaagaggggacaaaagggagggactgctcgtggctatggggtctccttttggggggatgaaactgttctggaactagatacaggtggtgattgtacaatattgtgaatatatgaaacaccattgaattgcacactttaaaatgtcaaattttatatgtgagtttcacattaattttttaaaaatcacataaataaacttattttccactcacctgctactaccttttcattgctcacctagaaggctgccagtgcctgcaaacacatctttgaatgcatcgttttgctaccaagagccccccatgaatgggcaggcatgtgcctgttcatccacagcccttcctcatgggaaggaagccccagtgcagaggaaccacagtcacctgcatggcgactgtggggaattcacttttcactgtctatactgcctgggctttaagaaactctgtgagtgtatcactattttaaaaaatagttataattttacattttaaaaaggagacagagaaaggaaggatgggagagagggagggagggtgggaggaggaaggaagggaaaaggaagagaagaaagaaaagaaggaaacaatgaaaggacagaggaaaacagggagggagggaggaaaaaggatggaaacaaggagggaagaaaaggaagaagagagggaacgatggagggaaggaaggaagaagaaaggagaggagataagaaaagactgaggggaggaaggaagaaggagaggaatgaaggaggaagggaagaaaggaggggggaaggaaagaaagaaaaataggagaagaaaggaagaaagaaaaagaataagggaaggacggagggaaggaaggagagagggagaggagaaaggttggaggggaggaaggaagaaaggagggtggggaggaaggaaagaagaagggggaaaaggagagagggaaggaaggaaggaaggagagaaggaaggaaggagagaaggaaggaaggagagaaggaaggaaggagagaaggaaggaaggagagaaggaaggaaggagagaaggaaggaaggagagaaggaaggaaggagagaaggaaggaaggagagaaggaaggaaggagcgaaggaaggaaggagagaaggaaggaaggagagaaggaaggaaggagagaaggaaggaaggagagaaggaaggaaggagagaaggaaggaaggagagaaggaaggaaggagcgaaggaaggaaggagcgaaggaaggaaggagagaaggaaggaaggagagaaggaaggaaggagagaaggaaggaaggagagaaggaaggaaggaagaagggagggcaggaagggagagggaggtggcaggaaggagaaaaggtgatgagaaaccttctattaaaatacaggacatgcgaaaccatatgccccgtttggaggttcaagctctccttcttgcagtctctgcatccccagtgaatgtccgcaccacacacaaacccgtgttccagccgcctcctaccaaggcaatgctaggctgttatgtaaaccatgctttcaaatacggtgtttcctctgtttggaagaagtctggccattgcacagccctgaagctccaattttcccagccatggccgactccacctcctttgagccatcttcctcaaacctcctcctgccctcgtctgcccatccacactgcacacccaggttcactaagcagggcagtcacaggctgcaccctgagcactcctgacctgatatccacatccatgcaatacatatttgctgaatgaataaatgaatgaatgaaagaaagtgagataagccatcattctggaagctgcaagtctttctccttcttttcttttgcctccccctgcctcaccctccaccgtccagccctgtggtggctctacgggcaggtggctcacttacttgtcttggatgttctcagctactttggccatcctgtgggcatcctcacagcctcaagggtggattgtttttgaatggattttaagggtgttttcttgtcttttttctcaattcaacatggaatttgtgtctatatcatttactttgtatggctttgtcactcccttttcacctttcatcagggcgttcatggcctttcttcatgcttccaatgaatcttcaatgcatattgcatttattttctctctttgttcacagaacccaccaagaagccaaactcaggtgagtgtctcttcagctgggaaaaactgaggcaacgtccttgaactgatgcttacggaggggatggttgaggatgttttacagaactgtggggtatatgaaagagatgcaacaactgtaccagatagcagatattgaaagcaaaatgtggtgattagggaaatgcaaatcacaaccacagtgaagcaccacttcgtccccactgagatggctaaaatctaaaatggaaaataacaagtgttggcaaggatgtgatgaaactggaatgtttgtacagtgctggtgggagtctaaaatggtacagccactgtgaacaaatgctttggtggatcctccaaaagttaaatacaggattactctatgaaccagcaattccactcctaggtatgtactcaaaataattgaaaacacgggttccaagaaaaatgtgtacacaaatgttcagagcagcactattcattatagctaaaagatagaaataactcacatgttaatcagtggaaggaatggataaacaaaatgtggtccattcacacaatggaatattatttagccttgaagaggaatgaagcactgaaaattgctacaaagtggttgagcctcaaaaacattttgcaaagagaaagaagccagacacaaatgatcacataatgtatatttttatgaagatgaaatttcaagaataggtgaatccctagaaccagaagcaatgtcgtgactgccaggggctggaggggaaagagagagtgactgcttgataaattccaggtttctttttgggggaacgaaagcattctggaagtacacagaggtgatggctgcacaacactgtgaatattctaagtgcccctgaattattcacttttaaatggttaattatatgtaaatttgacttcaatttatttatttattttcaattaaaaaggtaacctttggctgggggcggtggctcacacctgtaatcccagcgctttgaaaggccgaggtgggcagatcatctgaggtcaggggttcgagaccaacctggccaacatggtgaaacctggtctctactaaatataaaaaaattagctgggcatgatggcacatgtctgtaatcccagctactcgggaggctgaggcaagagaatcacttgaacccgggaggtggaggttgcagtgagccgagatcatgccactgcactccaacctgggtgacagagtgagattccgtctcaaaaaaaaaaaaaaaaagaaaagaaaagaaaagaaaaagaaataattcccggggccgggcgcagtggctcacgcctgtaatcccagcactttgggaggccaaggcgggtggatcacaaggtcaggagatcgagaccatcctggctaacacggtatgttgtacctgagcgagttagaaaaacgctttgagacaaattaagagtcctttataagccagcgaccgagagacggctaatgcttaatagtctctcggtcctgaggaaggggcttgattaacttttagatcttggtttaggaaggggagggctgggggtctagtgaaaaccattttacagaagtaaagtaggcaaaaagttaaaaggataaatggttgcaggaaagtaaacagttccaggtgcaggggctttaagactattacaaggtgatagacgcggggctttgggcgttactaatcagacgaattcccgggaactgcggatgtagctcgccacagtatcttatcagttaactgcattcttggatgtgctgggagtcagcctgcacgagttcagtccttgaggaaggggctgccagtgaaagagccaaggtggagtctggctggctctcttagctaagggagagtccattcaggtggaaagaaggctaggtgagtaaaggaaaagggagagtctaaaaacaggttagtaaaaaccaggttgggcattacaggtgaaaccccgtctctactaaaaaatacaaaaaaaatttgccaggcatggtggcgggcgcctgtagtctcagctacttgggaggctgaggcaggagaatggcgtgaacccgggaggcggagcttgcagtgagccgagatctcccactgcactccagcctgggcgacagagcgagactccgtctcaacaacaacaacaacaaaaagaaataactcccagacttccagcagactccttgactgccatgagagatgtcaggaagtcaatggacgggtgtttataggttgttcaggaaatgttcactatcaagcaagaattgaaaatgcagctaaattgctgttggagagtgatgatagcataaagatttccaacaagaagctctgcaaattttgctgaaaaatcttccaaatgatgctctgccataagaagaaattcacaccctgaatagcacagcaggatgcgaatagcaatgccagccaaagacattgcaaacaagccggtaaaactaagtgattgttagctgtttaaaaaaataataataactggtgttaacaacaaagtgaaacttaacttctgaagatgaggctaccttcacagagaggataagaaaggaagaactgagtaaaagtagttagatattgctggattttgacattttaaggttaagtgttcctgctaaaaataaaaattgaacatataactcctgaactagtggatgaaaatgaagaatgaagaataaaattaaatacaaaaaaaatgaagagtaaaattaaataccaaaattagccaagtgttgtggtgaatgcctgtagtcccagctactcaggaggctgaggtgggaggatcacttgagccccagaggtggaggttgcagtgagctgagattgcgccactgcacttccgcctgggtggcagagccaggctttgtctcaaaaataaaaaaaaataataaattaaaaacctgaatactaaatggaagttaagaaggaaggaattaaaaaagaagaaaagtaaaataaaatagtaggaatagtgaatccttagttatgttagatgttcagtgatttaataaatctgtaaaaagacggagatgagatgatgcaatttaaaatgtttcggctgggcgcagtggctcacgcctgtaatcccagcactgtaggaagccgaggcgggtggatcacgaggtcaggagatcgagaccatcctggctaacacggtgaaaccccatctctactaaaaatacaaataaaatgtttcatgctatttacgagagaagcatttgcaacaaaatgccaaagagaaggtgaaaatagctggaaaaaaaatgcgcaaagcaaataaccaatagaaagaaagccaagttgggctagcaaaatcagacaaaataaccttcgaggtgcaaacaactttgaggcccaaatagaggttcttcccactaaaagaatgattccctgaatgataatggaatcttgacccagcctgcacctcaggttaagttaaaagtggaaatttaaagatctaagtgtgagattttaaaaagcatttccccagaaataccaggatctgtagatggaaatgttattaagaataaagatgtggagctgggcgtggtggctcacgcctgtaatcccagaactttgggaggctgagactggctgatttcttgagcccaggagtttgagactagcctggacaacatagtgagaccccatctttacaaaaaaattaaaaaaaattagtggacatggtggcatgcacctctagtcccagttactcaggaggctgaggtgggaggatcacctgtgcccaggctgaggctgcagtgagccatgatcacgccactgcactccagcctgcgtgacagagcaagaccctgtctcaaaagaaaagaaaaaaaaagaagaaagaaatgaaaaccgtagctcagagacagagaaactgagcaatgcataggttcagaagggtttgaaacagactgaattgtgtcttggcatatgagagaggtcgcagctataaaacaatgagagaagaaaccaaattccacataggcaggactgagacaattggctgttcttgtggatgatacgtgatcaaatctcaacctcatgcgatacttttttttttttttttgagatggagtctcgctctgtcacccaggctgcagtgcagtggtgtgatctcacctccccgcaaacttctcctcccgggttcaagtaattctcgtgcctcagctgggactacaggcatgtgccaccacgcctggctaatttttgcatttttttagtagagacggggtttcaccaagttggccaggctggtctcgaactcctgacctcaggtgatctgtccacctcggtgtcccaaagtgctgggattacaggtgtgaaccaccacacccagcctcatgtaatacttaaaaatgaactacaggtggattacaaacctgaatataaaagaaaacttttttttttgaaaaatagagggaaatgtcttataacctcagagttaggaggtttttcttagatacaatacaaaaagcataaccacgcccatagtcccagctactcaggaggctgaggcataagaatcacttgagctcgagaggtggaggttgcagtgagccgagatcctgccattgcactccagctgaggctacagagtgagagtataaaaaaaaaaaaaaaaaagcataacctttaaaaatgggttagcctatgtctacatttaaataataataataataataatgttccaacttcaggctctgaaaaaagtcaaaagatgagctgtcaactagaagaggctccttactgctcataccaccagggaaagtttaatatgcaaaatgcagtcatccttcagaattcatgggggattagttttaagacgccttcttccccgcagacaccaaaatccacagctgctgaagtctctgatataaaacgtgcagtacttgcatataatgcaagtatatgttcctgtatatttttatttatttatttggagacagaatctcactctgttgcccaggctggagtgcagtggcgtgatcttggctcactgtaacctccacctcccgggttcaagagattctcctgactcaacctcccaagtagctgggattacaggtatgcgccaccacccccagctaatttttgtatttttggtagagacgggttttaaccatgttgtccaggctggtttcgaactcctgacctcacataatctgcccaccttggcctcccaaagtgctgggattacagggatgagccaccgtgtccagcctctggtatactttaaattatctctaggttactcataactcctgatacgctgtaaatgctatgcaaatagttgttatactatattattttttatttgtattactttttattggattgctatattttattttttgaaatattttcaatacaagactggttggatctatagatgcagaaattctggttatagagcacaaactgtgtatagatagctcctaccaaaacagacggatggtgaaaaaaagaaaagaaaagaaaagaaaaagaaaatggaggagagagactatgaggcgactaaaagaagagggatatgatcattccattcgctgacaagaaaaattcaaagaagagggaattatgcaattgaccagctgatgtgtgttagaaatgctcagggtcacacatattcattgaaagccaatttaagccactatttaaatttaaaccgatttaaacaattgggcttttttttttttttctaaaaaaaaaaaaaagtcaattaggccaggcgaggtggctcacacctgtcatcccggcactttgggaggccgaggtgggtggatcacaaggtcaggagtttgagaccagcctggccaacatggtgaaaccctgtttctactaaaaatacaaaagttagctgggcatggtggtgtgtgcctgaggctgtgagactgaggcaggagaatcacttgaacccaggaggcggaggttgcagggagcggagatcatgccactgcactccagcttgggcgacagaccaagactctgtctcaaaaaaaaaaaagaagaagtatattggttccgtctggaaaggtggagcacttgaagcaaaggcaggaagactggaagcagggagagggttttcaggtcacaaacaggtgagagacaaaacagttgccttcttttgagtttctgattagcctttccaaaggaggcgatcagatacgaatctgcctcagggagcagaggggggactttgaatagaatgggaggcaggttggccctaagcagttcccagctggacttttccctttagcttagtgacttgggggtcccgagatttatgttcccttcacagtgtatgagtgagagcacttggaaactgagagtggaagtgtcgcaggccaggtctcactaacacaggcccccacaacacctgtttcagtattgactgagtggttaaatattaaaagccagtgctgttatacaaaggctggaatgtaacaaaagcccaccgagagtttttcccaggactttcccgggccttaaagcatgacaaaataatgaatgaattcttaacaggacccatttaggattaaacaagttttactgggggtctgcagaaactccccaggcctccacaaacaagtttattggggctttgaaggaactctgcaaacctcctggatttagcaggagacaacatgagggtaatcaccccggcacctggacccattagattaagtcaatttactgaggctcctgaggaagatcctcaggactcagaccttagttatagattaaaagaagttaatcacttatgtctttagataaatgcacacacatatctccacatagcttggaaggtatataagctctggaaaactataattttgagttagtctggtgataatttccaggccttctccctgtaacaggttgcagaaataaaaactctcttcctccccagttcatcggtgtttcattattgggctgtgagaaatagcaacccagttgggtccgggaacagaaggtttggtgttatcttcatcacaggcactggactgtcggtaaatttattccatgacaattcttcctaggtttcttttttatattacttgcttccatcatggcagacagctacactggcttcttgccatgaaaacgaacttctagtaacaaaacggaaacctttttttttaagtttcaggtttcaaggttttacttctatctgcaaagtgatttttaaccagacaatggcaatctataaacacaccgtgggcagcaaatcagaacaaactgcaaggtcgatagtcacgctgatgagcttgtttctgcagcctgctcctaagggaaggacaattttcttttctaacagtgcaatgttgtttcctccacagatatctacccaaagccaaaaccaccttactacccacagcccgagaatcccgacagcggtggaagtaagaatccgcaggcctgaaactctttctcaatctggtttgatgatgtttgcctttttatttactagcaggtttagcctggttgcatttgaaatatgtgtgtaatagctcccttactgggaatgtagtttctttcctcactggggggagcaagaaagtccaacggacagaaacaatcttattttccctttgctttgacatctagaaaccactaaggtgtacttgtaaccacccaactggttcactttgttggctgcctagacagagctgatttatcaagataggggaactgcaatggagaaagagtaattcacgcagagccggctctaagggaggctagagttttattattaatcattcagtctctggaacatctggggatcagggttgttaaggataagttggcaggtaggggcttgggaagtggggagtgctgaccggtcaggttggaaagggaaccatagggggttgaagtgaggttttcttgctgttttctgttcctgggtggatggcggacctggttgagccagattaccgggctgagtggtgtcagctgatccatccagtgcagaggctgcaaaatatctcaagcaccgatcttaggttttacaatagtgatgttacccccaggagaaacttggggaggttcagactcttgcagccagaggctgcacgagccctaaagtgtaatttctaatcttgtagctaattttttggtcctgcaaaggcagactggttcccaggcaagaagggggtctttttgggaaaggggcattcttaattttgtttcagagtgaaaccacgaactgaattcgttcccaaggctagtttggctcacacccaggaaagaacaaggacagcttaaaggttagaagcaagatggagttggttaggtctgacctctttcactgtcatcatttcctcagtcataatttttgcaaaggccgtttgatactcaaaggacactttgcattatcatcacagaaagctaatcaggctgagagacaagtcctttctctcacttgttttcagtgctccaaatacctttggcttaaccattcccaaacccccacgtgtgctgtgcactttatgtgttttagagttggtttctccattttttctaacatttggcagacagtttttttccacagatttattacactcatcattgaaaaatatgcaattcaaaaaagaaagagagtgaacgagagagagaagagtggggaggggggtgggcatggagagagaaagagaaagagaaaagaaaggggaaagaagaaaggaaaagatagattctggccattaaagttatcagcagttcaacaaccttaaaaacttaaatgtttgccaggcagagcagcgtgaagctggctaaatcaagaggggttctggaagcttcctggtagtttgctctggctttaaactttcacagcttaacagcgtgtccattcattgcagacacgcacatccagatggacagaaattatctcctcttacaaggaatcattaaaaacagagaccaagacccaagggaggtgacacccacttgaaaaactacacctcaggccgggcgtgggggctcacgcctggaatcccagcactttgggaggccgaggcgggcagatcacctgaagtcaggagctcgagaccagcctggccaacatggcgaaaccctgtctctaccaaaaatacaaaaattagctgggcatggtggcatgcgcctataatcccagctacttgggaggctaagacacgagaattacttgaatccaggagaggaaggttacagtgagccaagattgtgccactgcactccagccggggaacagaatgagattctgtctcgaaaaaccaaaccaaaccaaaccaaaccaaacaaaacaaaaccccaaaacaccacctcacccttaactgcattagttaagccagctagtctttcttttttccccctctttcatgatgaaaatcccaaataccacccacctttttctcctgctatttcctcctagtcttttaaaaaccattgtcctgcggatcatggctatgttgcaaggcactcatgggaattccacagggaacgtgtttcttgctgaaacatacttgggaaacgcccagttaaacagactgccgtgggcttccctcccagagaattcatcaggacttaaaatgtgtggctgggcatggtgggtcacgtctgtaatcccagtactttggtagaccgaggctggtggatcacctgaggtcaggagttcaaggccagcctggccaacatggtgaaaccccatctctactaaaaatacaaaaattagtcgtggcctgtagtcccagcaactcgagaggctgaggcataagaatcgcttgaacctgggaggcagaggttgtagcaagctgagatggcgccactgcactccaggctgggcaacagagcgagactccgtctcaaaaaaaaaaaaaaaaagaataagaaaaaaaaaacttaaaatgcgagatcctttaagatgggccatcttcagagtgtgaacactcagcccctcccacagcaaagtgattcatgaaccccaataggaggaggagtgggggaagagaggctcaggctggggaggtgaccccccatgactcaagcctcaatctcctgatgcttgtcccaacaaagaggaggcttcctttccgactttggtttttcatgttgtgcttaaatccagccacactgatgcctttaacatggcagtcctgaattattaatcaatactgtgtgaatccaaaatatctgagacaggtctcaatcagtttacaaagtttattttgccaaggttaaggacgtgcccgtgacacagcctcaggaggtcctgatgacaagtgctcaaagttgtcaggacacagcttggttttacacattttagggagacaggagatatcaatcaatatgtataagaagtacattggtttgatctggaaatgcgggacaactggaagcaggggcttccaggtcacaggaagatacgagacaactagttgcattcttctaagtccttgatcggccttttactgaaaactcaatttacatgtgagacagggcaaaggaatagtacttatgcctcagtctggcccagtgaatctgcatttttcatcaacaatagggcagaggaagcaatcagacatgcatttgtctcaggggagcagaggggatgactttctgtcccacacctgtgaagatgagctgttggtgtacattgccagggtgaaattccacagaactgttttagggtaaacaaaacagtttactttcctcagattgtgaggacagtatgtagcttttaaaaaacttaaaaaaatttttttgtagctatcttatttagaaagaaaatgggaggcagatctgactaactttttttttccagcttgacttttcccttggcttaatgattttggggtcccaagatttattttcctttcacaattgaacatcagaacatggagtatttaacacaggaaatgagcaaatttaacgtacacacccaaggaaaaggaaaaatgaagctggttggaagttaattatggatagtgtggtatatgagcagaaattccccttaaccagtgttcttgcccaggctagcccaaatgagcccaggctagcctagattcccaagtgtgtatcttgagaacgaggaagagccctagaaaacaatgtgtaacgtccctccaagatggggtgttctggaacaatccctcagacaacgaaggcaattgttgatgggcaacattgggaagaccccagagatggaatgtcctaggcctttccatgttctctttctcattctccctccattgacttgataggtggctgggggatttataagtatttaccacacaccagccagctttctccggatggctccaggcatgcttggagcccagtggtctctttcccttagaatttgatctggaggaacccaaaattctctctgtgtcctttgaaattcagcacatttttcttggcttccatgagctcctgtggcatttctcaggccaactgttgactctgcttcctatgtctgtgcttgtccctttgagagatgtcagcgttgctcaccgattcttttctctgaccccagcagctcctatccatgttgtctttttttttttttttttcagacagagtctcactgtattgctcaggctggagtgcaatggcacgatggcatgatcttggctcactgcaacctccgcctcctgggttcaagcaattctcctgccttagcctcccgagtaactgggattacaggcgtgcaacaccacacctggctaatttttgtacttttagcagagacagggtttcaccatgttggccaggctggtctcaaactcctgacctcaggtgatctgcccaccttggcctcccaaaatgctgggattacaggtgtgagccactgtgcctgtcctcatgttgtcttgaaagtaacaagacaggcacggattctttttgatgcaagctgttatgggatgaattatgtctccccgcaaattcataggatgaagtcctaacccccagtttcctcagaatgtgactgtctttggagatggggcctttaagaaggagattaatgtaaaatgaggtcactagggtgggtccggatccaataggactagtatcctaataagaagagatgaggacttagacacacacagaggaaagattatatgaagacacagggagaagacggcatctacaagcccaggagagaggccttaggaggaaccagcccagaccatatcttgatctcacactcccagcctccaggactgtgggagaatcaatgtctgttgtttataagccacccagtctatggtgttctgtgacagcaacctgaaatggactaagacacctcataagaaggggagatgaggacgcagacacacacagagggacaatcctgtgaggacacagggagaagatggcatctgcaagcccaggagagaggcctcaggaggaatcagcccagcccacacctggatctcagacttccagcctccaggactgtgggagaatcaatgtctgttgtttataagccacccagtctttggtattctgtgatagcagcctgaaatggactaagacatctcataagaagaggagatgaggacacagacacacacagagggacgaccctgtgaggacacagggagaagatggtgtctacaagccaaggagagaggcctcaggagtaagcccaggaatcaatgcagttggaggttctgtgtgtgaatggaggagggaagctcacagatgaaggcgttttgagggaggactgaccttacagtgaggtacccagagacttcctgaaccaagccacgaatatgcagctcgtgctccgggcagtgccttctggcctggaaaccaaagctcccttgtgtccagtccccactcctctgtttggcccccaagtttccataatcccccacagttgtatcattttagagacctcaaaagagagtctaggctgggcgtggtggctcatgcctgtaatcccagccctttcagaggccgacgtgggtggatcacctgaagtcaggatttcaagaccagcctggccaacatggtgaaaccctgtctctactaaaaatacaaaaattagctgggcatggtggtgtatacctgtaatcccagctacttgggaggctggggccagagaatcgcttgaacccaggaggcggaggttgcagggagccgagattgtgccactgcactccagcctgggcaacaacagcaaaactccttctcaaaaaaaaaaaaaaaaaaagagagtctaggcagggcatggtggtccatgcctgtagtcctagctatactcaggaggctgaggtaggaggatcacttgagcccaggaggtggaggctgcagtgagctatgattcaccactgcactccagcctgggcaacagagcaacaccctgtctcaagagagagagaaagggaaagagagagagactattttgagaagtgaaaaaccagtcattctcagcccagatttccagtgttctgagacgtctgtcctgaggaaggactttgagaacagcatccttgccttttttgtgaattaaagtaatttcactcttgagccaatgtggataagcacttgacaggtactggcagtgccaggtaccaggaatatagaatgggtacagaaaataaagtttctagtccagcgacaaaaaggtgctgaagatacagactcatgtcgtgcaaagagcttgcactgattatttcatttcggcttcttgaatagggtcaaaggacatttaagctgagacaggagggacgagctaattaatgcttttccagatgacaaatggattcttcaaatatttagggagagtgtaaagtgatggacagggaacaggaggggtcatgacagaaggaatgccacctgcaaaagtcctggggcagggctgggcacggtggctcatgcgtgtaatcccaacactttgggaggccaaggtgggcagatcacctgaggtcagaagttcgagaccagcctgggcaacatagtgaaatcccatctctactaaaaatacaaaaattggccaggcgtggtggcacacacctgtaatctcagctactcgggaggctgaggcaggagaattgtttgaacccaggaggcagaggttgccgtgagctgagatcacaccactgcactccagcctgggcgacaaaagcgaaactccgtcttaaaaaaaaaagtcctagggcagaaagctcatggtaaacttgaggaacatgcaaaagtcattgcaaaaagttttaagaaattcaaatgaagccaggctcagtgtggctaatgcctatgatgattccagctctttgggaaggcaagacaggacgattgcttaagaacaggaatttgagaccaacctgggcaacatagcaagaccttgtctctacacaaattttaaaaattagccaactatggtggtatgcacctgtagactgagctacatgggtggctgaggtgggaggattgtttgagcctaggaactcgaggctgcggggagctatgattgcaccactgcactgcagcctgggcaacagagcaagactctgtctcaaaacaacaacaacacaaattcaaatgaaacggtgtaactcaagcaagatggaaatacaacacactatcaaaaggtcagatgtttcatcctaacatttatagaagtgactgacttctgtaaatggtgctggcatctgtagtagccctaaacagggaaaggtcaacaacgcactttctgccctgttaatttcagagagccctggacttcttgcgaaagcaccagtggtgtaagtttttgttttttcattgtaagctctgaggtggtattatgaatattgtctacatgattaataagctccgtaaaagcaatgggcagtaacatcttttctgtactttggcattcttatttatagatggtatctacctgaaagatgtcattatttttctgaaatcatactgttgttttccaacagatatctacccaaggccaaagccacgccctcaaccccagcctggcaattccggcaacagtggaggtaatgagtatttatttatttatttttattttattttattttattttattttactattttatttgattctatgttattttactttattttaccattttatttgattctatgttattttactttattttatttgattctatgttattttactattttattttattatttattttggagacagggtctcgctctgttgccctggccagagtgaagtgatgtaattgcagccttgaactcctgggctcaagcaatcttcctccctcagcctttcaagtagttaggactacagatgtgtaccacctacattgcaccacctatatttcaccacctatattggctatatttcaaattttttgcagagacaggatcttgctgtgttgttcaggctattcttgaactcccggcctcaagcaatcctctgcctcagcctcccaaaatgctgggattacaggcaccagctattgtggcccagcctgataatcagtattaaagtccattttagaagtgtttggggccaggcacagtggctcatgcctgtaatcccagcactttgggaagccgaggtgggcggatcacttgaggtcaggagtttgacaccagcctgagcaatatgatgaaaccctgtctctactaaaaatacaaaaattcgccgggcgtggtggtacatgcctgtaatccagctactcaggaggatgaagcaggagaatcgcttgaacccgcaaagcggaggctgctgtgagttgagatcacgccacagcactccagcctgggagacagagcgagcccctgtctcaaaaggaaaaaaaaaaaaaaaaagaagtgcttcacgcctgtaatcccagcactttgggaggccgaggtctcctcaggcagatcacctgaggtcaggagtttgaaaccagcggccaacatggtgaacccctgtttctactaaaaatacaaaattagctgggcagagtgacgcgtgcctgtaatcccagctactggggaggctgaggcaggagaatcgcttgaacccaggaggcggaggttgccttgagccaagattgtgccaatgcacaatctatctaggtgatagagtgagactctgtctcaaaaaaaggcgggggggtggttggatacaagtattatttaatgacttaaaaattctcatctccatggtgaaagaccaattgcttttgaaatgcacagacattgttttgcgaggagttcagttctactatccaccagcacctggggattacatttagttgatagtaaataaatttaaatgtttttgatgacattgactgaaaaataccatgcacactaagacatttcaagttatgatggaggaaggcaattttttcttgtttttttttttgttggtctgtgttctactcacttattcttccctctgcaagagttatctgcggccactttgcctgtgttcctacagcacttcccatctccgccttggcaattgtgtctcacgaacgtgagacactcaggaaagagatgctggtctgtaaagttggaagagtctcagcgattccattggtggggcaaatgtgtgcagattgaggaagctaagatacactgggtgtcttcctctctccacctgctttaaccattgggagttcccctgattgtgattgtttcaggacgttgcttggatgttgtcatattcctagggttcaaggcactccgtgaaatccaaggaaacaagctttgggtatgtcccagtgccttttcccttgggtcttgcaactgaagaattgtgtttcttccctagaaaaacgaacacacttttgcccactcacccacctcctgcaagtctccaaaaccacagcgttgtatcctagactatgttcccccaggaggtggttcctccctctgcattcccgtactccatactgcttgatatgttcttacatgcaacaccgtgcaattgtgtttagttgattcctgtgaattagaatgagaactctacatgggcatggatttttgcctttcattcactgctgcattccctagtctggaaagctgtgcctggcacacaatgagtcctaggtgaaggtcagtgaagtcattaatgcttgagtcccaacaggcaaacagctggattcatgaatgaaagacttaccgctacatcccttcatcagggtgtatagcttcaactccatttcctggaaagctctacaatagttcttcctcctcaaaaggctctggtcttgtgattcatagcattcgtccaccaagacatgaacaagggatctttatgtcagaggttccctgttcaaagctgttttagaggccaggcgtggtggctcattcaggtaatcccagcactttgggaggccgaagtgggaagaccacttgaggtcaggagttcgagaccagcctggccaacatggtgaaaccccatctccattaaaatacaaaaattagccaggcatggtggcatgtacctgtaatcacaactacttgagaggctgaggcaggagaatcacttgaacctgggaggcggagttcagttggagttgcagtgagccgagatcatgccattgcactccagcctgggtgacagaacgagactccatctcaaaaacagtaaaaataaaaaagctgttttaggaaacatcccttttttattattttttctttgagtcagggacttgcttggttgcctaggctgaaatgcagtggcgggatcacagctcactgcagcctccacctcctgggctcaagcaatcctccgactttagcctcctgaatagctgggactacagacacacagcactccacctggctaattttttcttttttctttttctttttctttctttttctttttctttgtgtgtgtgtgtgtgtgtgtgtgtatgtgtgtgtgttgggacagggtttccctctgttgcccaggctggtcacaaactcctggccttaagtgaccctcctgccttgacctctcaaagtgctgggattacagatgtgagccactgagcccagccctaggaaacagcctcttaagccaagtgcaatgactcttgaactccccagagcctctgtgcatgctacctcgacttcagcttcacagatgtatgcaactgcgggatcaggttaggggcactcacttaccggcagtcccaaagctctggagagtctgtgctgagggaatggtccatgttaaagcaaagcagaacaaccactctgccttttgtattttatacttgttttttttttgaaacagggtctctctgtgtcactcaggctggaatgcagtggtgtgatcatagctaactgcagcctccagttcctgggctcaagtgatcctcctggcagatgggactacaggcgcacaccaccaagcccagataattttttgtatttttttgtagagacagggggtctcactatgttgcccagactggtctccaactcctggcctcaagcaatcctcccgcctccacctcccaaagtgctgggttgcacccggcttgcatttcacacgtttaataaactcaatcagcatgtttcctaccccctagagtgacaatggtgcacattagcatggatttcttatagatcgagaccaaagacctaattacttatctatagaccaatcttggagaggaaaggcagactccaagggttaattcggggtccaggaaccacagaaggaaggtctccttggatctcgtttgagcctgaagtagctcagtctatgacagacaccatcagagggcagaggcacaggtgaacgcagcagtcggaactttgtcagagcagcaaaggacatcttaggaaatgaggcttgcaaagcagccttgggttattgagaaagctctctcagcgtggattctcagggctctgggatcttctctgccttgcaggtgcctctttgttttttgggaggaagcaggtgggtctcatgtgtcagggcagtaaggagcaggaatgaatggatgaaacaaatctgttggggtgggtagcggctgtgctctggggagccaagagagagacagggggatggtgctggtttcagacaagatagttgagcaggaacttgaaagagaaaaggagagtggatcgtggggacctgagaagctggaattctccctggggaatcggccactgccaacgtgagggctggggttaggagcatgcctatggtgatggagaagcctgggggaggtgcctggttgatggggcaagaggagccatctggagagaaggaaaagcctggagtctccttccgggcttgcttaaggactagggaggggcaggacatgagatgatgttggaggattctgagcaggggatgggcctaggtgggaggtggggcagaaggagagctggacgaggacatggtgagaggtgatgttggctcatccaggaaggacggccaggaggaagcagagggaaaggggcatgcaaaggtccagaggcaggagcaacggggaacatccagggaaggagggaagggcaggggatttggagatggggcaccctgagagagggatccaggcagcaggcagacacgacagcctgagcttcaccccagctcacggttggccctgggagggctttgagcagaagaggggcaaacatcagcaatatgaggccacactgcagacgttctgggccctgcacacgcctccttgcaggcaaggcggccagcccacaaggtaatttaattcctggtgcctgtgggcgtcctgcaaagagccagttggcgtcggaacgctcttctccaaaacctgtgccagtgcccccagcgcagacctggtgtgaaggggacctttggagaggtctcatgagcaatgccgcgtgctctgccccacaggttacttcaatgatgtggaccgtgatgacggacgctacccgcccaggcccaggccacggccgcctgcaggtaggtgccgagcctccccagatgcgacacattgaatttgcacagagagggtgggatgagaggcctgaagttggggatgagagagctgaggttggggcagagttggtgacgagcagacgataagctggtgcaggggatgacagagaaggccccatggccgcatcagtggggtttgcggtctgggcatctgtccgcctctccaggctgggggactggatggaaacaaaatgaacaggcagaactggagggtccactgaaacacttgcggtcatttctgtttagacttgtatatgtgtaagtgtgggtgtacatgtccagacacacctttatatatctgcatgcttatcaatcttcatttgtgtgtatatagatgtttatgtatctttatatttgtgtgtatatatgcttttaaatatatataaatgcatctacatatgtaggtatatggtttttttcatgtgtgtatatacatgcttttgtatatatacagtacgtggatacctttctctgtttttatatatgtatatcctgactttatatatatccttatatatatctttacataggtacatgttttatatgtgtatatatatctttatatttatatgcagatatatgctttttatatatatttatgtatatgtatatcgtttaatatatctttttaaaaatatatcttcatgtatatctttaaatacatatacattttatatacattttaatattttatgtgtatgttatataaatatatatctttacatatataattaaatatatgcctttatttatatacatctttatatatgtacatatatacctttacatgtatgtgcctttatttatatatgtatatatttatatatacacttttatatatacatatgtgtatatctttatatgtgtgtataaatgcctttatatacgtacacatatacctttatgtgtatatacttttatatgtgttatgtatgtacacacaactttatatatacatgtgtatatatctttatataggtatataaatgtctttaaatatgtatatacatatcttttgtatttatttatttttttttgagacggagtctcgctctgtcgcccaggctggagagcagtggcacaattttggctcactgcaacctctgcctcccgggttcaagtgatgttctgcctcagcctcctgagtagctgggattacaggcgcctgccagcacgcctggctaacttttgtatttttagtagagacggggtttcaccattttggccaggctggtcctgaactcctgacctcgtgatccacctgcctcagcctctcaaagcgttgggattacaggcgtgagccactgtacctggtctatatgtatatcttctaatgtatctttatatatatctttaatatatctttatatacatgtacattttatatacatttttatattttatgtatgttatataaatatatacatttatacatatataattatatacctttatttatatatctttatatgtacatatatacctatatatgcttttatatatgtatgtgtacatttatatatacacttttatatatgcatatgtatatgtctttatgtgtataaatatcttcataaatatatttatatatctatacataacctttatatatgtataaatatcttatataaatatatattttatgtgtatatatgcattatttgtataaacacatatttgtaaatgtctttccatatatatgcatatatagcttacatatgtttctatactgttatatataggtgtatacctttacatatgtatgcatactgttttatatatgtgtatataggtcccttcatgtatatatgtatatacatttaggtatatgtgtgtgtgtgtgtgtgtgtatatatatatacacctttatatatgtacatttatctttatacacacagacatatataaacacttctaatataaagttttctctgtaattggaggtgaatgtctatcaataatctttcatatagaaatacaagtacagactataggagacagagatgcatacaacattgggctgaagagtgtgatgtttgaggctttattttcaagcatgtgaggtttctggcctgtttagttctgcaattttattttagaagacataaaggacttgtcccagatattttgcaaagctggacctgcatctttcggacaaccagattgcatccagtcatcttttctgccgtgtttacttgcaataaataaagagcgctgtcttaggatttattacaataacaatcaggaataaactaaaaattactagttatttttgaaaggagaagctgagaacatttacgattgagaccatctgctggaaggtcctcctaatccggcgtcggcgtggctgatctcatatcagtttctcggcaggaagcgggtgcgcctgcgtgaatttggagtccccagggtaaatgttagtcccgtgacggcaaagtgtttttgatagctagagctcagtgttggcatgagttttcccacggggaagaggaagctttggtggggccacccttgactctcccctgctggtcactctttggagctctcttggcagtgacacgttcacacgacttgttgccattcccaatgagctggacagaccaacacctgcaggaaaccccacgctcagacacctgaacatccctcaactctaccttctctgtctaacaggaggtggcggcggtggctactccagttatggcaactccgacaacacgcacggtacccctacatctgggcatgcgatggtgggtggagggtgggaggggtcatctttctagggctcccgcttgcactctgccctgggccttctacctggagtctttggtgagtagggtgctgtgtgctggtgcctggtcttctgagaacctgtctgtgctgggctgttctgcttctgttccccaggagggtgggtgcagccacacatacacacacgcatacacacatgcacacacacacacacacacacacccctttaggtaaaagtaaacagagcaaagaactatacaactaattagagaaagagagcatccaacaaactggagagcatccaacaaattctttaggggcgcagctcgcttacttcaagcagaatagaaaacactttcaatggctgggcgcggtggctcatgcctgtaatcccagcactttgggaggctgaggtgggaggattgcttgagcccaggagtttgagaccagcctggacaacatggaaaaaccctgtctctacaaaaaatacatatatgcaaaaattagccaggcgtggtggcatgtgcctgtagttccagctactcaggaggcagaggtaggaggatcacttgagcccaggaggtcgaggcttcagtgagcagacagagataagatcgtgccactgcactccagcttgggtgacagactgagatcctgtctcaaagaaaaagaaaagaaaagaaaagaaaaaaagcaagagaactcttttggtcggtgcttatgcccagagtgaaagccgtgttctacagaagccataaacaggctcttggcttggttgagtttttctcatggagaccaggggaccttgaaaccctcagatcctctccggtttggaaaacgactgaagcaaaatgtcatcactgagaaagaaaacaataacaaaacactctgtaggttgattttaaaccatcatctccgttttaacattttccctttgttaagagttttgtacaccttcaatgaattgagtaaccatcttttcttttttttttttttttttttgagacagagtttcacttgttgcccaggctggagtgcagtggtgtgatctctgctcactgcaaccttggcctcccgggttcaagtgattctcctgcctcagcctcccaagtagctgggattacaagcatgtgccactacacagggctaatttttgtttttttagtagagacagggtttcaccatgttggtcagattggtcttgaactcttgacctcaggtgatccatctgcctcagcctcccaaagtgctgggattacaggcatgagccactacacctggctaatttttgtatttttagtacagatggggtttcaccttgttggtcaggctggtcttgaactcctgacctcaggtgatccgccctcttcagcctcccatagtgctgggattacagacgtgagccaccatgcccggccttgagtaaccatctttttggttaaaactaatatgtgccaagagctctggtaatgtgggaagtacttttttttctttttctttctttttttttttttaagatatggtctcattaggctttgtgagagccaaggctgttggccccctaagttttctctgaatcactgacatgaggcagcttaattaacaggagaaaaagcgtataaatttattgagtggatatacacgcaaaccttcagaaccaagactcaaccaccaatgggatgcaaaagcttatagaccatcttttttaactttgatgttaggttcaggggtccttgtgtagggttgttacataggtaaattgtttgtcaccggggtttggtgtacacattatgtcatcacccaggcaataagcatagtacctgataggtagtttttccatcctcactctactcccaccctctgccctcaagtaggccctggtgtctggtgttcccttctttgtgtccatgttgtcaatcgagaaaaatgacgagacgagcgtaaaagatttatttgccaaagttaaggttaagggcgcgccccaggagacaggtctgtggccttctccgaagatgattttgaaggctgcaaatttaaaggggaaagggtgggggtagggaaaaagagttattcatgcttttgtctggctcagtgaatctgtgtttttttacataagatggcatagacaaatggggcagagggaaaatgcagggaatctgcatgttgcataagataatctggacaaaatggggcaggggagcaatcacatatgatttgtgtctgctgggcgggggtgactgcaaagctgtcgatttgcatattgtcatggtgaaatcttcacagctcactaggattttccttgtgggcaaaatatgggggagacgtgtagcttttcatcttgtagccattttatttaggaaccaaaagggggaggcaggtttgtgtgacccagttcccagcttgacttttccctttgactaaatgagttcaggatcacaaaatttaatttcctttcacaatgcgtactccgtgtttagctcccacttgtaaatgagaacacatggtatttggttttctgttcctgcattagtttgctcaggagaatggccaccagctcgatccatgttgctgcaaaggacatgatcttgttcttttttatggctgtgtatatgggccacattgtatatgggccacatttcccttatccagtctaccattgatgggaacctaggctgattccatgtctttactatttgagtttgctatttgttgttctttgcaggaagaatgtgggctcagagcatggccccaaataggtgacgttggtaaagcaggtttaacgggtggcaagccaggtgatgagagggagacaggaagaggcctgcttagcaagggggtccttgttatgcagatgaaggttcccaggtagcagcgctcagagacgaccatggtaaatgtttcttttcagacctgtaaaggtgtcagagtctccgtttctctctcctacatccaggaaaagcttagaaagggaaggcctggctgcaacagcaaagatcctctacagatgccaatttccccacctcagtctgctggccctggagcggcaatttcaaaataaggcaaagcaatatattttggagtaaaatattttgatgtccgtcatcttcgttacctcggaagcgagtgttgtcatcagatccatttaacaaaatgaaagcaatgcatgacgctcgactgtccacttcaaaggagcaatagctgtggccctataggtagcccatcctcagaactcactccctatgacacagacaagcttcaggatgggagggggctcatgacaaagtgctcattacctggggtcaagaactgtctacttttggccgggcatggtggcccacgcctgtaatcccagcactttaggaggccaaggtgggtggatcccttgagttcaggagttcaagaccagcctgggcaaaatagtgaaaccctgtctctacaagaaaatacaaaaattagctgggcatggaagtgtgcgcctgtggtcccagctactcgggaggtgtaagtgaccctggaagtttgaggctgcagtgaaccgtgatagcaccactaccttccagcctgggccatggagtgagaccctgtctcaaaaaaaaaaaaaaaaaaaaaaaggacactaaaaaagaattgaccaccttcaactcaacgtactatgagatgagttccttccaccatctttctggaactagctaaggggttccccttacctactacctaggtagacctgatttattaagacgggaatcgcaatagagaaagagtttaattcacacagagctgactgaacgggagcatgtgaagcagctatgctgtctggggtacatacctggggttcattgttgcacgctgagaaagaattcaggacacagacacatgtggttgggttaaggagttgaaagtttaatagaagaaaggagagaggagagcagctccttgcaagagagagagggagagagagaaagagagagagagaaagagaagcatctgaaaaagttgggaggttgtggaccgcagcagcttttgtaggcaggctggaggaggtggtgtctgatttacatagggcttacagactggttcgatcaggtatgacttctacatagtgcgtggggaaggctggtggccccaccctaattttgttatgtaaatgggctttccagttggtcagtgccatcttgtctgctacttactgtacatggggctgacaaagaggagggaagatgaagctgccatcttgaacgtgtctaggccctagttcctgccggcattcacccatgtaagctcctagctggcttgtctatgtctgcagctcaactttattttttattttttatttttttttgagacggagtctcgctctgtcgcccaggctggagtgcagtggcgtcatctcggctcactgcaagctccgcctcccgggttcacgccattctcctgcctcagcctcccgagtagctgggactacaggcgcccgccaccacgcctggcaattttttctatttttagtagagacggggtttcaccgtgttagccaggatgatctcgatctcctgacctcgtgatccgcccgcctcggcctcccaaagtgctgggattacaggcgtgagccaccgcgcccggccacagctcaactttacaggctgctctttgttagaaaatgatttggggctgcttttcattaaaaagaaaagccttaccaaggactcccatacccttgctatgtgcctaagtaattaactaattccttcttaactcctatatcaactggaggttttgcttttttttctttaaacagggtttcattttgttacccaggctggactgcagtggtgaaatcatagctcactgcagcctcaacctcttgggctcaagcgatcctcccgcctcagcctcctgtgtagctaggaccacaggtgtatgccaccacacctgcctaatttttaaaaaatttttgtagagatggggtctcactatattgctcaggctggtcttcaactcctggcctcaagtgtttctccgacctcagcctcccaaagagctgggattacgggcatgagccactgcacctagccaagactggagttttatgactcaaatcagcttcccccaaaatttggacactgggctttttaacgtgtaatttggctggtaggagacccgggcgtggggagtgctgagtggttggttggaggtggaatgacagaggacggacatgggttctttttgttgtcttctgttcttgtgtgggacggcagagctcgctgagccgcattaccagtctgggtggcgccggctggtgcatctcaatgaagggtttaaaaaatgtctcaacttcaaccttaggttttacaatagtgatgccatccctaggagcaactgaagaggtttggaatcttgtggcctccggctgcatggctcctaacctattaatataatttctaatcttgtgactaatttgttagtctttcaaaggcagtctgatccccggggaagaagggagtttgtttcagaaaagggctgttatctttgtttgaatgttaagctggaacttcctcctatggttatctgagtctgtgttcaggaatgaactagggctgttcgagggctacaggcacgatgcagtcggttaggtcagatctctttcactgtcgtaattttctcactgttataatttttgcaaaggcggtttcaatttaactgaaaatgtcaggcaaagaccaaatttaatatttttacagaaagccactgggagtagttttttattgttttattatttatttatttagagacagagtctcactctgttgcccaggctggagtgcagtggtgcaatcatagctcactgcagcctcaaactcctgggctcaagcgatcctcccacctcagcctcccgaggagctggggctacaggcacacaccatcatacccagctaaatttttaagaaattttttgtagagatggggtctcaccgttgtaactgcccaatgggtttaccttgccccctgcctaaacagggccgatttatcaagacagaggaattgtaatggagaaagagtaattcatgcagagccagctgtgcccgagaccagagttttattattactcaaatcagtctccccaggcattcagggtccagagtttttaaagataatttggcgggtaggggcttgggaagtggggagggctgattggtcaggttgcagagggaaccataggggggtgaagtgaggttttcttgctgttttctgttcctgggtggatggcggaactggttgagccagattaccgggctggctggtgtcagctgatccatccagtgcagaggctgcaaaatgtctcaaacaccgcgcttacgttttacaatagtgatgttacccccaggagcaatttgcagaggttcagactcttgagccagaggctgcacgacccctaaaccataatttttcttttcttttcttctttttttgtttttttcgagacagagtatcactctgttgcccaggcttgagtgcagtggtgtgatctcggctcactgcatcctctgcctccctggttcaagcaattctcctgcctcagcctccccagtaactgggactacgggcacatgtcaccatgcccggctaattttcatatttttaccagagacggggtttcaccatattgttccggccggtctcgaactcctgacctgaggcgatccaccctcatcggcctcccaaagtgctgggattataggcttgagccactgcgcccagccctaaactataatttttaatcttgtagctaatttgttagtcctacaaagtccaactggtccccaggcaagaaggaggtgttttcaggaaaaggctgtgatcagttttgtttcagagtgaaaccatgaactgaattccttcccaaagttagttgggcctatgcccaggaatgaacaaggacagcttaagggttagaagcaagatagagtcggttaggtctggcctctttcactgtcatcatttcctcagttacaatttttgcaaaggtggtttcgccacgttgcccaggctggtcttgaactgggctcaagcgatcctcctaccttggcctccataagtgctgggattacaggcctgcaccaccacatccggcccaccttggagcgtgttatataaagcgagccgtccccacacccctacagcctacgaatgagccttttcaccccatgcacgattctctgaaactgctctctgtaaggagctattcgggacacgttcttttgttctctggcatactcatcaggtagaaagaagtgattcagcaagcggctcccctgagagccctgatcgtttcctgttttcctgtgaagttagtctcgggaggtctgcgctgtgccatttttgggggaccattatctggctcccgaatggatcaaagcttactggtcagggggctgctgtatccctggggcaaaactgccagaaaatagcaggtagccctgtggtccttggcagggccagggcccggtggaagcagcagctgggccaagaacatcaggcgtgcatgaggcacagcccagttttgggagcatgacgcttgttttcgaggatgcctgtgctccccttcctgcctggacccctgctctccagccccggcagagcgaggctgtgagtcagcgctcggattagcatcagcatggaggtgccggctgggatgcaagccgccgccatgggatgagtcacgcggcttctccccgaatccccaaaggaggcagagcgtgttaggcttgttctggcttcatgcagagcactgaggggtgagggctgaccgtggctggccgcggagggaagcccaaagtctggcctccctgcggagactggggagaaaatgttgcgctcgtcgtttttaaatactgggggacaagtttcccttgtctgctaaggctgccattgtaaattacaagagtcaggagggctgaagcaaaagggatttcttctcccacagtcctggaggctggaagtctgagatcaaggtgtgagcagggctggttcctcctgaagcctctctccttggctcgtcgacatcatcatctccctgtgtcctcacagggtcgtccctctgtgtgtgtctgtgttccaatctcctctccttatgaggtgtcttagtccatttcaggctgctatcacagaatactatagactgggtggcttagaaacagcagacattgattctctcaccgtcctagaggctggaggtccaagatcaaggtgtgagcagggctggttcctcctgaggcctccctccttggcttgtagacaccatcttctccctgtgtcctcacagggtcgtccctctgtgtgtgtctgtgtcctcatctcctcttcttataaggtctgtagtcctattggattagggcccaccctagtgatctcgttttattttaatcacctctctaaggacgttgtgttcaaatacagtcacagtctgatgccctgggggttaggactgcgacctgtgaatttggagggggatatagttcagcccatagaacccactatccacataagtcattccacttcaaaatcagcacaaagcattagttttaaaaatctcaaatctgtatttttaaaaattgctcttaacacattagaaaaatatagaaaaactttttttgctgtttttctgagacaaaatctcactctgtagcccagcctggagtgcagggacgtgatcatagatcattgcagcctccacctcctgggctcaagcaatcttttgcctcagtcgtctcccaagtagtagctgagactacaggtgcacatcaccacacccagctattttttttttttaagtagaaacggggtctcactatgtttctcaggctgggctccaaatgagctcaagtggtcttaccgccttagcctcccaaagtggtaggattacaggtgggagccaccacacccaacctggaggaactctttttttttaaaattttaaataaattactatttgtggcctgcgttttcatcctattctctttttttttaaccaacatttgctggcatttttttttatgccgaagaaaacacctttgcccatctatgtcaggcctccagaccctcagggatgtacatctaatgcaccttcagccaccggtgtaaacagtaaacaggggccagatggcgcctgtgcaccttccctggccttgggagagcattggaatctctgcagcttttaagagcatcttgcttcaggtttgctgacctgcttgcttctgtaagatcatgcagacttcctgagcaatatctagcatttcatggtctcttttctatcctgcaggaagagggggctatagactcaactctcgttatggaaatacttatggtaaaggaattatgtcttacagaatatgtgaggcaaaactgtccatttgcaaataactaacacactgtctgcactgatgggaagctgatgctttcatccagtgcacaaccaactggccgttcgagtctctcatttgcattttccttggtcatccatgctggggggagatgttgtgcatgccctgaggacttcatttcttcaaaggaactatggcccacttacaggtgttactgggtgcatgtgtgtgcacgtgtgtgtgtatacatatgtgttcacacacaggtatgcttgtgtgtattgtgtgtgcatgcatgtgtacatgtgcatgtggattttgtaatcatgtgcataagtgcatgtggatttcatgtgcatgtgtgcaagtgtctgtgcacacatgtggattgagcacatgcatgtttgtgtatgtgcacagatgtgttggcatgtacttgtggattttgcatgtgtgcatgcttgtgcttgggttgcatgtgcattgcatgtttcccatgtgtgtccattcacatgcatacatttaggggtgtgcaagcacatgtgtgcatgtggatagatgcaggagtgtgcatctgggtgtgctcgtgtggtatgtgcatactgcacgaatatatcatgtgcatctgtgcatgtggattgtgtgtatacatgcgtgtgtacaggcatgcacacacacacatgaatgtgtttgtgtgtgcatatttgtgtgtacatgcatgtgtttatgcatacaggtgtaaacatgtgcacacatcggtgtgtgcatgtgcacacatgtgtacatgtgtatgtttaggcgaattgtgctttatatgtgcttttgttgcctgtgtgtgtggtatgtgcatgtgtgtgtatgtggggatgtgtgggatgtgcatgtgtgtggatgtgcacattgcattgtgcttctgtgttgcatttgtatttacatgttgcacatgtgtgtaaatgcatgtgtgtgtgcacgtgtgtatgcgtgcttgtctgcctgtgtgttgcacgtttgttgcatgctgcatgtgtgtatgcatgtgcacacacatttgtgcatgtcagtgtgtgttgcatgtgcttgtgtatgaatggcgtgcgtgtgtgcatgtgtgtccatggggttgtcagcctgtgtgtgttttgcatgcgcatgtatgtagactctccaatcctgaaattaaagctgcatctccctctccctggtattatccccattctgctaatgaccattagacatggcatacacattcacattcctcctccttatgctgcttggctgtccccctccccccacaagaatgtaaattccctgaaaacagggatctgtgtgctgtgttcacagtcgcatcctcaacagtgcccggcaatataaggccctccataagctctgctgaataaacacgaacatccttttccgcttacaggtggagatcaccattcaacgtatggcaatccagaaggtaactgattgactcacccggtcccaacctttaataagagcacactctcctagatcagtgctgggaggagctgtgtgggcttctgtttcccaacctcatgactttcacggagcactcatactttgtatgtatataaagtagctcctgaataaaaatatctgaccttcagcacaggaccaatcagagttcagagaaaggagaggcaagcattggttttcactgcagaagatgccccttagctctcaaagcaaggctgtgaatgagtgctgagactattacatttctcccagtaccaccattactcccctttctttgaccagcactaacttgaaacccaagaaggacaggagaaaggaaggtatgaacactctgcccaaagaagccatcagagtgcactgtcaatcccgtctcaggtcaaaggagggagaacttgaagcccagaaggctgactttgtgtcctgtattgttgggagaacaggttccccattccctaagggtcatattcttagagatttgggctgacacctgcttgagtttaagttgagagtaaacgcactcaaccccaaggctcttgtgagttttcaattatgggggaggagaaagtgattgaaggtgacctctacctttcaatgatcatgcagagtactagtatcaatatttttggggtatgttggcatccttagaaaaatttatggtttcacctttttccctctgtggtgtaaagtgaggtccagagatggaaagggcaaggcaaataaacaagtaattgcagtcaaatctgatgaataatttcctggaacatatgggatcctgtagcaaggcagaagggatactcctagactaggttaggtgagggaggtagggtttcctggagagaacaatatccaagccaatcccccaaaatatgggtgggaggtgcccaggagaagagtgaggtgtcagggaagatggtgcactaggtagagctggatacacacgtggggacaccggaaattgtgtagccaggatgtggaatgcaacgggaaccagggaaggatgcaatggtgaccaggaaagacctccaggttagcagaggtggagtctgcacttcatagaaccttcatgggaaggagcctgcccctgttgatatgtaggtgaagaatggacctgagggggctcactaagacccagggagacaccctttcagaccagttcagtactccctggaaatgatgacaggctgaattaaagcctgggcaaaggaggcaaagagaagcagtcagcttggatgaccacttggtaatgacaattgattgtacttgattgatttgtaagagatgagagagaggaaaaggtatgtatcagtcagctatgctgtgtcacaaaaaaccccaaaacttagtagctggaaataacaaccatttattatgttcgtgattatgtgagtcagcaatttgggctgacaccattctagtggtcctcctggtctcttctgaactccctctcttgtgtgcagtcaactgtaggtgtggccagcgctttgaccatgtttcctgggtcttcttatgtatctgggactttaggtggaatggctcatctcagcttcatgtgggctctcacatccctccaggaagccaggccaggcttcatcacatggtgaccagacagggtaccaagagcatgaagagaagcgtgcctgggcttagagccaccatgccttcacttgtgtgacattctgttggctaaagcctggattttcagaatgaagatgcagctccacctctggatggggaacactgtgaaatcatactgtggagcgtgttcatgtagggaggggaagaatagagggctgtctctcccaggaggcagggtgtggcgggcggcagcatcagccgtagagcaggttcttgcgttcagtgacaacactcttccccccagcatggcagcctcattcgtggagcagtcttgtgtccctcacctatgccatgccatgtattggcccaggtgttcaaccctgtctgaagaaagccatgcatggaaagggtggctatttcaaatggaaacggtgatttcttccttttttccctttggaagtgttgatttttgtcacatcaagctccttcttgttctttgtgcaggagtgccaaagctctggagcaatttgccatcgaggcattgaggatgcttgtgtctagtgtgtgcttgggtctagagttccagcatgcctttgaaagcaagcctatctggcagtttttagtggaacaatatttttgcatgagtgggcattctacatctaaaaaggcacaaaatagttttgacatgtgcctgtcatcccaactactcaggaggcggaggcaggaggatcacttgagcccaggagttcaggacgagcttaggcggcatagtgagaccccatctctaaaaaaataaatcaggccaggcgcggtggctcccctctgtaatcccaacactttgggaggctgaggcgagtggatcacctgaggtcaagagttcgagaccagcctggccaacatggtgaaaccccatctctactaaaaatgcaaaaattagttgggcatggtggcatacacctgtagtcccagctattcgggaggctgaggcaggagaatcgcttgaacccgggagaaggaggttgcagtgaactgagatcacgccactgtattccagactgggcgacagagcaacattccgtctcaaaaaataataagaaataaataaataaataaataaataaaattaattaaaaggcatacatgaattgacttcaacaaacaaacaaaaatgccaagtgcctcgtctgtgcaaatcctggccttggatgtcttcagtggtaaaatgtggttgacaagcttggctctttgtgaaaacagaattacttcctaaggtttttttttctttttttttaaattaagtttctcttttttttctgtgaatacaagggtgggaagggacgtgatggagaagttactagatagatgcaaaagttattgcagtttttgtcattactttcaatggcaaaaaccgcaataacttttggaccaacctaatatttaagcagttttcctgcagccatgtttttttctcggatgagcttgctttttctccactcctgcaggcaatatggtagcaaaaatcgtgtctcccatcgtatccgtggtggtggtgacactgctgggagcagcagccagttatttcaaactaaacaataggagaaattgtttcaggacccatggtaagtttggctctaaacattgttttgcttgttactaagcctgatttaaaaaaaaaaattactttcagatgtctgtcactagcaaggttatttctggttaagttcaatatacataacttgcctaataatgtgattttttaaaatttatttttattctttttgagacagagttacactgtgttgcccaggctggactgcagtggcaggacctcggctcactgcaacctctacctcctgggttcaagagattctcttgcctcagcctcccgaacagctgggactacaggcatgcaccaccacgcctggctaatttttgtatttttagtagagatggggtttcaccatgttggccaggctggtcttgaactcctgacctcaagtgagctgcccgccttggcctcccaaagttctgagattacaggcgtgagccaccgtgcctggccaacaattgggttttcatggtcaggtgtgagctgtaccttcctctaaaccttgttacaatgaggctggcacattatctgtctaatgtaaaagaggaggagaaaaaaaggaaagaaaaagaaacaaacaaacaaaaattaccaacctacattgcaagactataagcatgacggttggtttaactacctgttctgttttgtattcagtgaaattttcgtcacaggcgagtcaggaaaaatacctgggttgaatgtgaatgttttgcccagaaccccacccgcaaagaaaactaccgaaacactgaattataagcctctctgaaattccgaaggtgcgctcagaccataggggagaggaaagatctgctgtggcttcctggttcaatgccggctccacactcctgggtttgaagaatcacttgggatttgagagcagaggatgccctaaagaaatctctgaaacaacagtcagggattgttttatagcctaaagagtgactcagatctttaactgggtgtctctggaggcttggtttaaacctcaggccacccacgtcagaatctgtctggagtttgcccagggccctctaactcataccttctttgtgtccccgaaggaaaccagaaaggggtgcccattcctacggtgtttgctttaggatttgcatttggcctcaaaaatcctaaaaccttcccatgcgctccctctgctggtgaatgggcagtatcaaccgttagctaatgaacctccgtttggggtgagcctccgtctacattacgccccgtcctgaaattttaggaggaaactgagtttctgaaaaactgccttattttcctggcaacctgagagcagattcttgggttcagtgacaacactctttcacccaacatggcagccatcattaacgaacaccacgtgttaacttcagtagcttttgtggcagtgatttgtaagcctttgttaaccaagggctgaaactgagtaagcagagagaggcacccatctccacaagcacaaaatgtaagggcggggtacaggggtcccccacaaactcaataatcaaggcaaatatattttagtgcaatattttagaaggaaaatcattggaatgggggccagttgagtttctgaaataggtgtagttttaaaaacgtggatgatgcctgccccatttatctgaggtggaaggaagcacgtttttgctaaagaggtataatgtcttgaagctctttcatgccttttggctgcctggtaagtatttttgtctactttctccattgtacttcgatgataccctcaccaggtattcccaagcaccaagtttatcttcccctcccttaaagttcctgagatcagaaaggaggatgtagacagagtgagctgatgttagggagatctcttcaagggtgagcagtgacatttatgtggatcctgggcctatatcacctcgctggctgtaaagcctttatactatctaggaaatatgtgcatgacagcaaatacgtatgggtttggtatcaaatggggctcagagctctgcgaacttgactctaaagttccaggctgctgctaatggtacccagctgtccacctctccttagttaggtcattaattttctctgtctcctaaaggatgacgtacatggtatactaaccatatccatggtgatgtggtgcagtgcacaacctgtggaactgtgtacctgctgaggccatacactgaagcttgcacactttgtagagaaagagttgtagtaacagagctacacagatagaagcagatgtctgtcacttgatgtggacttttaagaatcatactttgcttttattttataaagtggagcaaatgacaacatcacttcagaagttataaagaccaacaaggccatattcgaaaaaagaagttcctacaaatattagttttaaccaaaaaggaagttactcaattcatttaagatcatcaaaatccttaacaaatggcaaaatgtcaaaaacaatgttttcaaaacgaatatttgtttccagatatgattttaacagtttttaaatattttctatttttaatttttcctgctttattgaggtatagttgacaaataaacattgtatatatttaagatgtacaacttcatttctgcatcatttatttgttctaatctatctccttctgccgaatgtaaagcaggtgtcatgtagacagcacatagtctgatcttggttttcttttttttaaaatagatttttcattcttctagctttattaaagtatgatagacaaacattgtatatatttaagatgtgcaacttcatttctgcttcatttttttctgttctaatcttccttctcctaaatctagagcaagagtctcttgtaacagcatagaattggatcttggttttctttttctctgtttaataagacttttttttttgcccccacaatgacatttgtttctaatcttcctttcagaaccagaaaatgtctgaagatgttaagatcccctgattactttgagaaaaacaactaaaacaagaaccgtgtttatcactgttgtggagatttccttttattcttgacacaatttgatgacctaaagtgtgttttcttctgtgtaaagtacatgagctgcctcactaagcattcccaactcattgaatgtgatgtggttataaagataagttaggcagctagaccctgcgttctaaaaaaggattgcttgcaatgttggtttggctattcatttgcacaaagagactgtggctctctgttgtgagatcttcagctacctcatggtgcaataacacacacacgcttaaccatgttgatggcacaaagcggtgagcagtagggaggtagaatatcttggtggggaggggatgttatcagcttctgggagatgaagaatattgttgaggttccaaagatgctggacctgtgctaaattcttcagtgatatgaaaaaatcattgagcattcattattgcgaatgaagtggggatgcattatttctgacacccacaagcagggtttgatcatcctttcagctttgagatatctgcacataaaattattattacctgaagaaaataaggctgcattttgaaatgttaagtgcaaaatgactgatgttaaaaccatctgggggaaatcttgggatgctttttcctaggaaatcatatggttgtgatatgttttggcgcataggagacagaaatagtgattatcaggcgttgagcctttttgtagtatttttagtctttgatactctgtaagtgctagttcctaaggcaccaacattgcattccttggtttatactttttctattcatcagggtaggaagtcttaaatccttaggcatccaagaagtatactagctttttgcttctcttttagaaatacttgtggggagagaaaaaaggatggtttgggcatattggtatagtttgagtaaactaaggttaatgttcatataacatttagactttgccataaatatcagaaccaaagatcaagacattcatgtacagtctggaatgtatatatggggcccataaaaattcccagtatgcatgttttatgctcaccattatgaattggggtcttcaaagagagaaggttgaaagtggaaagcacttgaaagggctccccggtttgtaaaatatctttaatcattcacattaggtacctcggagttgcgggtctcaaatgtggattcatgcatcatttgtgcagtttgaagatagtccatatttcctatttcagtattaggtcctgcaacacttttcaattcttgtagaaggtttttttcaggagtggtgatgtctgatgctcaattactattttccctataagagtttcagcatgagcttaattaaattcttgtgaaaaaacctgtgtttttagttacacacacacacacacacacacctacttaaatggaatctaaacatttttagcctttaatccattccattttctaaaactgtcataaactatttttaatcattttaaataaatgtaaaagaaaaataactggatttgattattgaatagtttttttctatatttcacaaataaattgtatgaaatgactgtagaagtggccccaaaattatgaaccttcgtagctgtgaatatgatgccataaatctcttttaaagctcaagatagactatgaacatatgaaatacatagttacctaatcatgagactaaattcacctgggtgacaaggctaacgttcaagctacttaagatgaaaatatttgaatcatgattgcttgggggaacctctctttgaggggtcatgaggaccacctgctgggcattctgttttcatgctgagaaggtgagaattgaacagatgagaaaagccttgataaaacgtcatctccatgtaatttagagaaggataaccttgactgtacagctgacccttgaacaacacagggctgaactgcacatgtccacctgtatgtgagtttgcttctggctctgccattactgagacagcaggaccaaccctccatctactcaatgggaagatgataaggatgaagacctttatggtgatccgcttccacttaataaatagtaaattcattaattttatcttccttatgattttcttcataacattttctttcctctagcttactttattgtaataatatggtatgtaatacatatacaaaatacgtgttcaactgttaccagtaaggctttcagtcaaccagtatgctatgagtagttaagtttttggagagtcaattcatacagcccttgatttttttttttttttcaattaagttcatttagatggtcagaaatgtcagttaagcgtcatttgaaggtaataactaaccttgaaaaactagtggcttgggtatagttttccaaaaagttaggctgggcgtagtggctcacacctgtaatcccagcactttgggaggcctaggtgaggggattgcttgagcctaggagttcaagaccaggctgggcaacatagtgagacccccatctctagtaacgatttaaaaattagctgggcgtcgtagtgcacacctgtagtcccagctacgtgggaggatcacttgaacacagaaattcaagaccatagtgagctgcgatagcaccactgcactccagcttgggcaacagagtgagactctcaaagaaagaaggaaggaaggaagggagggagggagagagggaggaaggaaggaagaaaggaaggaaggaaggagagacagagaaggagggagggaggaagggaaggaaggaaggaaggaaggaaggaaggaaggaaataaatttgattcttttcgcccataaatttgtgatgaagcaccagttttggaaagcttccctgctttggtagaaatagcagatggcaagattctgatatcttctactatgaagttcaaagcagtcagaagtgggcagcttggtttttctgaaatttatcattctgacatcggactgagacctagaggagattttttaatgccatctgacagatctaaaatacatcttctaagagtactatgcaaaagtggcagctgtcctgtttgcttggcttcattgatccaaaccacagggttgacaattttccttcacatggatacagtgagggattctgcagttatatgaggcatttgagtcaaggtgatacttgcttcttgattccacagatgccactttttgcctttgaggacttgctaaagagttcagacttttcctactgtatgttttctgtgcagaagtcatgttgtgtggtgaggaccatggattttatttcatttcttaacctttctatgcaaatgagaccttgaggctgcagagaacaaaattattgggatgcacaaatccaaatggaaataggctcagtttagctaaggaggacacttgtgttatcttgtgattctaatgacgttcaagctttaatcacaacattttcgtgcaaaaggaaaaatacatatattatatacgtgtgtgtgtatctcctgtaaaataaaaacaatatattgtattaaggaggccttgcagctgttgtccttatagcttcagaaattttatttttttcaatatattattcttaggtctgtagtatgaaagttcttttaaaataaactgtacaacaatttcacaaaatattcaaaataaaaaagagggagtgtttggatattaattgtcactaaatttaataattaaaatactaaaaattttacaaaggggtgaccacactaaaattcatatatccccaaagatctcttaaaaattagatttttcaggctgggtgcagtggctcatgtctgtaatcccagcactttgggaggccaagatggggggatcacttgaggccagaggttggagaccagcctgggcaacagagcaagaccccatctgtacaaaaattttgtaaaaattagctggatgcagtggtgtgtgcctgtagttatagctacttaggaggttgaggcaggaagatcacttgagcccaggagttcaaggctgtagtgagttatgattgtgccactgcattccagcctgaggaacagagtgagagcttgtctctaaaaaagaaaaaaaatagatattttgaacattgcaaaagcctacaatctttttaatattgattactttagttaaattcttctccatttaatgtgattttagaagtaatccttttacatctggaaaatggagaataatttattatttcacccagagaatgataaatcaatcaatcaaaatatagcaatctagaaagctaataaataatgttctaattagggagacctactgccagtaggagtaatagataataacaatactatttgctgaatcattttattttagtagaaaaataagctttcaaagtaatttatttacttatttatttatttttgagatggaggctcactctgtcgcccaggctggagtgcagtggcacgacctcggctcactgcaacctccgcctcccgggttcaggcgattctccctgcctcagcctcctgagcagctgggattacaggcacccaccatcatgcccagctaatttttgtatttttagtagagacggggttttgccatgttggccaggctggtcttgaactcctgacctcaggtgatctgcccgcctcagcctcccaaagtgctgggattacaggcgtgagccactgcgcccagccttttaaaataatttacatactttacacatgtacacataaaaatggatgttggttggatgtggtggctcatacctgtaatcccagcactttgggaggtcgaggtgggtggatcacttgagcacttgagccttggagtttgagaccaagcttggcgacatatcgagactctgtctctacaaaaaaattaaaaaattagctgggcgtggtagtacatgcctatggtcctagctacttcggaggctgagacaggagaattgcttgagcctgggaggttgaagcagcagtgagctctgattgcacaattgcactgaagcccaggtgacagagcaagaccctgtcaaaaaaaaaggatgtcagtgataatgagttgtttataaagatagaattagagttccagggatgactggagaggtatagtgtattataacccctaccatgtgcccgtcagggactggtacttaaaagtcaaaacagtaactgcagaatttgagaggtgtacaaagatagtctctcaaatagtgctcagttattagttcagcgatggtcagtttgtgcatagctatgaaactagcttatcacggtaaaaagtgtgtacgcttcactatcttgtagcatttagtttcccagcagggccatgcgacacccagtggacatttctaaattgtacattcaaa
